United States Patent 10,233,495 (METHODS AND COMPOSITIONS FOR SCREENING AND TREATING DEVELOPMENTAL DISORDERS) - sequence listing, part 199

SEQ ID NO: 1401 - DNA, 835330 bp, Homo sapiens
ttgtaaaacgtaaaagaaatgccccagatattgtgtacttgaatctctttggtctgataaagtatatgggttactgtgaaactctgaaaaaattttaagatgtctaattcattcaaataagttatgaaactcatttgtttattatgtttaatttaaaggacttggttcagatcaattccatcactacctaaatattcaaactggtccccttttgaactgactgaaaatagacattaaattccaggttcatatatgtttcatattttaccttcaaaggtttaactgctttctgcatgtattacaatataggggagtgcatcagggagttcctattaaaatttctttctgcagacattaaggtatgtggagcactgaagatttatcccatggtaaccaataaattgtataactaatttcattttagtgataagtgaacattgctcaacaaacacacatactgcttgtcataccttacctggaaagaggctttattgaacatagctgtaaaattatattttaagttgaattactgaatttgcacaaacatttctacagaattgttttaaaaaacaagctttgtcattttccactacattttgttgtgcttttatattaatatttgcaaatgctataatttaatacttatattccaattgcttgcataatcagtttttttaatcctggggtgttgaaagaacatataataataatattcttcttagacaaaagtctttttaaatgaagttaaaagctgagataatttaaggaaaatgatcttcaaattttcataaccaacaggtttaagtgaaatttacaatgcattggaaaactggctggttaaagatatgatttgtcgtcaggtagctcaaaattatttttacaggtttttgtttttttgtaaaagtgtttttataatcttggtaaaataataaaataatatttcacaatttgcacagagtctgactaaagggcagaggcatattaccctcagagtttagaataaagccagatttttcaggcccagttccactgtagagttagtatgcactgcaatcccaaacattttcttgttccctctaaagctagggccaatttcatttcaaatggaggttagagtaaaaaaatcacttttgtgttttaccaccttctgcactaagtattcttaataaccttttgctctggttgacccatttaataacctggaagaaaaaaagtgttgctccatgtctggtctcaatggaagtgattttctaatggacaataagccgaaaggccatggctgtctaggaggttaaacaacaaatatcttgtctgcatgggcttacgcagcagcttcggtcctttcttcttcagaagcggctttgttgtcttgcctgtaatttgcacatttaggctctgtagtttgtttataaaatagttttacacaaaccactcttagcagtgcaagcttctgagttgaaaattattcaggcttgtttcattgaaggcacttggtttccatggcaatttataaaagatggtggtttggtttcttcattggaacagatgacgtagtttgggtgttcaagtggccgcaagcaaactccgataagcctgtgtaacatgtaagcccaggtttaccatcctggatagtagtgcatgcaaaaagagacagcatacagttatctagcttagccatgggagaaaaataataataataaaggtgggatggggataaggtggggagaaacatgaatgctttaaataattctgagttcgggttattttcaaggaagggtaacagccaaaggtaaaagggcctacatttatttaattctctacgaaaaccttctcgtaaggaaaataaatgccagctcttcacgtaccctgtttacagtgaggtttttgttggcaggccattaggtttccatggtaacaagcaaactattcatttgaaacaaaaccagccatgactttgtgctttgacaaggatttctatagctcttttttttttctttttttcatttttttttttttttccagagttcaaccagatgacgctgtaatctttttagccacaaaagcacctgaaggtctcttctctactcaggtcaagattatcttttatgtttagtctggaataagttatacttccatgatgtctttttatccccagtgcttaaaaaaatttgtttttattattttatttttgagtcagtagtcagtggaggaatctttggtagtttgtttgttcaatgtccatttacaaagactctttcttcatgccagtgcctggtgaatcttttatagcctctgccaggataaggtcaccttcgaggacttaagatagagatgaggacgataatgggaaaaagccatatatgaaccaaaatcccaacagcaccatcaacggaatctaaagataaggaaaataaatgcaaacaaaaaaagaagaataataagcattccacgtagctactaacacaaccttggtgaataataaaacaagtatatggaaaatatttctggaaaatatttatttttattttgttttatttatcagcttcattgctaagggaagtgaaaaggaaaatgaatatatggttaaggcacttgataaaaagatttacagattttgaattgatataatatgctatgaaaacttgttcataacatattcacataggtttgtggttgagctcaatcttaagagttctgctagccacaggaaagcaggaacatggagaaaattatcagaatacttcaaaaagtagattttttttcaagcttcccgaagtggataagcttgaagactgaaagaaaatctatcttaatgaaaactagaaagggatggttatgtgtacagaaattaactattgcaactagtagatgatccatgtttagatcggtccattatctataaattatacaaataattttctctttattttaacttttagaggcatgatgaagtccattcaaactaaaaaatcccttccaccaatcggcctggaaagtcctactgtaattgggatttctgttaaaacctggtgtccagttgatgcctcttagaatgcatgccttactgtggagggataacacagatataattcattaaactagctaaagttgcaaagtggcttgtatctaggggagaattgagtttgaaaattgagacatacaatcttatatctgcatggtgtggaccatagttccatttattgcctggaaagaactggcagcctgaggaatcaggaagaggctttcagccttcaggctggtctgtacttagaatataatattcatttaataatcatcaatcaatcaaatgctagtcataaaatgaacttaataaatggtaattaaatgacacaaatgtaacagaaaactttctgatgccaaatagattatttgtgttcaattaagattatttatttcccctaatttatagagtttaaatataaatacacccaatacatacagggggtgttttcatatttaaaactgccacacatttcttggatttgctagtttaagagaaaaaaaaaactaattataaaaatgttctattgtaatagaacttgtacagtaatgaagtccctatgggctttcacaggcatttactgtggctagttttatcagttatgctttctttctgcactagggagtaaataatttcctttgctttcttcctttgaaaagtttaattcaatttattgaatttatttataatatttgtgcttacattatgaaaatgtaaaatttctgtatatagttgtaactgccttcaattaataaaatgttactgccactcagtcatactatgaaattcaaaagaaatcctattctcctttgaggagaatacatgttttcctgtgcattagaaaaactgttcttttgagtatagctactggttttctaaagcagaactagacagacacaaggatacatttttactaaatatgttacttgaaatactaagtttatgactttttaatatattttcattttatataacaatgagcaaaatggctcattgttatataaaaatcttagtttttgtcttttgacaatacttaagaattgagtcaattcagttcatatgagtaatcagtggacaattgtacacattcaactttcaacatctagactggtacagtttctcactaaatatagaaaattaccaaagactctgatttgctctagatttatacaacatagattttcatgcttttgtatgtgctaaataattgatgagtaatttgtgtaaatttagtttgattactttctctatatatgaccacaaaataaaagattccagatgagtctaagataatccttcaattgcagtcatttttaacaggaatgattttagatttcatagcttcgaatgtgaaatatggagatgaggactttaagaagcagctaaatacataattctaaatctttgtgcattattcatcatgttttatttatatctcttctattataaaatggacctgtgacaaaaaaataaaattaaatatatcattaaaccataatactcaaaaaagggtataaagtgaaaatcaaattattaaacaagcttgtggtgcagataggagattagaccataaatatgaggtctacttcattacttaatatatgtatttaggctctttacaatgctgaatctgttaaaatggctggcaaaaggccaggcacagtggctcacgcctgtaatcccagcagtttgggaggccgaggcaggtggaccacctgaggtcgggagttcgagaccagcctggccaacatggtgaaaccgcgtctctactaaaaatacaaaaaattagcggggtgtggtgccgcgagtctgtaatcccagctactcaggaggctgaggcaagagaatcacttgaacccgggaggcggagattgcagtgagcagagattgcactgttgcactccagcctgggcaacaagagcaaaactccgtctcaaaaaaaaaaattggctaaatcaggaaatatattcactatattcacaaactggacgaatgaaagcatctatgctgacatggtaaggctttgtgtcctcacacaagtctcatcttgaaatataatctgcataatccccatgtttcaagggagagaccaaatctcatcttgaaatataatccgcataatccccatgtttcaagtgagagaccaggtggaggtaactgaatcatgggggctcttcccctatgctcttctcatgaaagtgagttttcactagatctgatgatttttattattattattattattatgtttttgagacagactcttgctctgtcgcccaggctggagtgcagtggcgtgatcttggctcactgcaagctccgcctcccgcgttcacgccaatctcctgcctcggcctcccgagtagctgggactacagggactacacgcccggctaatattttttctttgtatttttaaatagagacggggtttcaccgtcttagccaggatggtcttgatctcctgaccttgtgatccacccgcctcggcctcccaaagtgctgggattacaggcgtgagccaccgcgcccggccgatctgatgattttataaggggcacttcccccttctctcagcaattctccttgctgccttgtgaagaaggtactctgcttccccttcaccttccgccatgattgtgagtttccttaggcctcccagccttgctgaactgtgagtcaattaaatctctttcttttataaattacccagtgttgggcagttctttatagcagtatgaagattgactaatacaatttacattgtaaatatgtgctatgtatataggttcatcaaatattttaatacaagtttttaaatcttctaaaacaaataatatcaaagtgttttaaaatcttaattaaaaatcaaagtgtacttgccttacgtagatctaaatcaaaatctcacttctattttatcttaggccaaatatgtctacaattgaatttaatactttaaaaataactgaacaaactttagggtattacatataagaaatttctaaataaaccaactaaaaataactccgtttttaaaattaattaaattaaatgttaatttaatagtaatgttactttaacgttacaacaaaccaatctcaagcaaagatacttactcttagttgctaggtcttgttttgcacattctccttctgcaattgatacatcatcaatagcaatgtcaccttctattccaggacctcggataccttcaaaaatgagctacaaatatgaatgaaacaaacctaaatgtggagctttgatttgcagatcagtttctcttgagaaatcaaggtgacaaaaataaacttgtcagtaatcctggcatcttttatatttgatggctttcaaaattaaaacttgcagaaaacataaactttcatcccaaaaccagtaattgaatcttccttgcattgtattagtttttcacatcaaaagctctgtgtcgattttaaagcaaaactaaacttaattaaataatacaattaaaaaaaatgactacacatcctcttttaatttttaaggataagaaaaaatgttttatttgaaaagtctttctctgagatagattctttctggttttatctgaacataactcataacattagttttctagaaatattttaaagaatgaatcaattctgaattctttacaacagtaatatgtatattgaagcccggaacaaagtgtttctatctctgacattgatttctcacaaatagattgaataggttcgtcatattcccatgttgactttataatttacctccatgatttcactgctgatattccatttttttaaacttgaagatatgtatcagtctatttatgttgaatatctcacggtatacctttgaatttatggtgtctataacaatggtggtcactgaggctcagtgcatgaatattgaaagaataaatgagtacaatcagaatcctttattattaaatacttaaaacaatgacaatagaagcacaattagcaaatttatatattttttatttttacagaaacaggactcttttagaattttctttatggctcccaaattattccttgctttcagcaaaactttaatctttttgatactgtaaggcaattcatgcatttagtggtgggtatacagttctagaaaaatatttacatgttaaaaggaaatatctgctttggtcattccaaagaatagtttaataaagagctgtttctaacatcaatctggtaatgtgctttattaataacatttctagacttatgtcatcacaacaaatctgacaatgtttatttttatcaatgccaaagtttttgtttttgtttttatttgaaaacatctcctcaaaggcaaatcagagtcatctctgaacttttcaaagctgctgtcctgggaaagccatagcttaattatgatgattttgagagaacttaggctacttttgagaaatttatccaatgttctttgatatgctctcataatattatcagtgggaatctccaggtagtaaccagaggcatcagttgtcaacttttgtattgagaccctgtccttcacttaaatgtagttcatcaaacaaataataattttcatgatttgatagcagagaaaaatttgagttcttactgatatacagatatgataaatatggagtttcctgcttatctatgttaagataagcatgttcttaaagattctccaaagccatctctttgaaagacatttaaaatggtctgtttcactgaagccaaaacaaaatggcagctgtagttcaaatatttagaaccaagttagcagtttagcaaattctcagtcctcagatagaatttacaatgaagtattattttggctgcttggaaatgatgacttccatttgagataggatggtgtctggaaaggtaactgggaagtggctttaaaaagtctcagaagactttttaacagtcctttatttaaaaggtctatgagaaaggatttagaaaaaaatgaacggtatgaacatttgagagaattgaatatgaagaaagggaagtcattttaaggtgcagaatattccacattatggatgtaatttatttaaccagtaccctatagtcatcgttagacattaaaactattgtctcctattatgaacaaggctgaggtgactacgtttcaaataattattattcatacttatttaaagcacattgttctttaaagcctttacaaattgcccgtatgagcaaactacctgtgagaaaatattttcctttttccaaaaagtaggtttttaagtcttggggtatattttccctctttgatatgtgtcccttacctgatagagagtcaatgttagagtaaatcaatagttaatattaaatactgcttgtagagtgcaatacagggtttacaatgtagccatagcaaagataaggggtttgcattcccatgggctttatgtggggaagtgagatgtggtgaagagtctaataaaggtgggttaaaatgctctgcacctgctcgcacttgaaatttacacagataaagctgaagtcaaaatccttttattaggaaggatgtttgaaaaacatccacagtgttctgtatcactgaagccaaaacaaaattgcagtacatggatttcctatcttagctatgtaaaggtaaaaagtttgaagaaaatacactttttcttattcaaagtacacaattgctttcacttagtaagttcttgttacttccagatgggagtcatataaaatggtgagatttctttaaaaatcaaaactaaaacatacatgtcgtcaaagtcatttctgaacttttcaaagctgctgtcctgggaaagccatagtttaattacaatgatcctgccattacttcaaagcatttcaaaacttctcctactactgcctttaaaggattaaacaatcctcctttttatattaattttctttttcatcctgtcctcctgcctccctgtgcagcttgatcaaaatcaaaagattggacctaggcttgtgctaaaaaaaaaaaaaaaagtcccagagcagtgaaattgtgaaagacagacccttttgtagtcagattgagagactgtgtcgggaaaccatctgtagtaaacatcaggaagcggattgactaatgtaatttaatatgtgtgctacctacctactggcaatatgttgactgtaagtctgtggtttgctgaacaacaaaactagcaatcaacaaaaatcaaagcgtcacgtgtccagagggcttcctatacttagaacattaccttatatgaatatttcaccccttggtgataccgaatgaatgaagtggtacagtaaaaaaagtaggctgatttgcaaatatattatttacatttacacttacaattattgatactacattttgtcattgataaagcaaggtaatttctttaagcatagcaggaattttagacattttgtttaaataaatctagttatttattggtatgataaagataatttctagcaataaaactcttagtacagtcataatttgtatttttaatatttatttgtaatcttgtgatgataaagaatctattttaataggccagagaaatctgcagtcttccacaaggacctttttgaacagaaaggaaaagaaaggtcctgtgtagcatgtttatttgtttccttttaatttccacagttttgctattacaaagatgtagattattttttaacaggttgaatttcaccaataaatatttattgcattgttttatttatgctctgagctcttgactacaattatatttctgaattactttaattaaattttatagattcaaacagattcataaatgactcctagactaagatctagagagagcatgttttacttgacatggtttctgtgtgagttagattagacaaatataaagtgtagatattaaatttaagtaatgtgccttagccaaacttttaagcatttgtaaaaataaatctttgctgacgttttctagaatatacagatgagaaattataagtgcattaaaatatgatgtatttagccatagaagatgtgatctttacacaacaaaaaatcttaattatatttatctcgagaattaagactctctagtttaaagagttaaattgtcatatttttatttccatcatttccatcatttatttccatcattattttgactactattacattacagagataaaaccattttcgtttcctcttcagtacttctgaaatgcatttggtttaactaacttgaagaaggaactaacagcaactaggtacccatggagaaaatgtgaaagtttaggtctcctaaaagagggataaaattatgcaaaacctgttcctcccgcacaatagcactattatttaaaattatttcccttaattgaaatgacaagtttaaaactgaaatgttttcacagtgtgttcatgcaacttcgcaaccttaacatacaaaaaatattgcctaatcagaaaattaacttttggtaagtaaattcaaacgggaattctaaaaaattaatgtggatttctgtattagaattgtacctcacaaaattgtttcattaattgacagtttcttacatacattataatgctttaaaacatataaatatagatgtcaaaataaagatatagatgatgctataaaagtatgtgtcaaatgtaatttctcagcaagaaaagaagagctacatgaatcacgaatgtgtaaaagtagatgggggaattaaataatacaatgcacttctgatgatttgccttcattgttaatggtgacttctgcaaatatttacaacatagtttcttcctgacaaaaggcaaatcacttctaatcattactgctaaggcaaatgcaaaaccctaagactgcagtttgaaaattgacagtatatgtcactttgaaaaacttcaggatataaatatatttaaaaataaccattagcattaataatgttatctttattttatcactggtttagcaaataattgaactatcctcaaccattacaaaacaaatttgaagagagacagcataatagacatagtgggtagccttggctttttccctggggaaactacccaaatatgaacagtgagtttaacttaacaatactctgccagttcatcttgtgggacaaatgtcaattagttgtcaacatttctaatattaaataataacatgagagtcgactgttgggaaagacaaagaaatgcatcaaattgtgagctgcaattggtaaatgttttcaatggttaagtcaggagccaccattgtgtccatataattgccctggaatgtggcttagaatgccagatatgctacatgagcatgtaatgtctactaatgaggacaatattttctagcttattattattcttagttggaacataaggcagcatgatgtaaggagagcagtatagtctcttttccagtccctgttacagtgttaagcatttgtatcttaattttctcaaaaatttctcaaaacctgtttctaagtctttaaatgaatatgtaagagcaggaggtttccagaatccctttctcttaaactaagaaaacgtaaagagcatcttgtgtctcacaatctagttgtacactttacccctggaaaacatttgaaatatactatgaaagaagtaaagcattaaaaggggatggttaaatattttccctggtatatgatgtaaaattcattgacattataagaatatatccattttgcttctttggaattgttgccctaatttttcccaatgtagcaaaatctgttttcatcccaagcactgatcatgctaagttaattctagtaaatgaacccaacataaatttcaatagaataaaacttctacttgtcttgaaaagtactaagcaataattgtattttcagctaagcaaactaattggacacactcaaacaaaggactgtccaagtaattttataaaggatttatggatcaaattaatttaaagtcatgcaactcaaaacaaataaaacagtgtaaatgctagtgaaagagactcaaagtcacttatattctgtgtaaaatttcaagaggtaaaagttgtgccgtccacttgaagtaaatacatcctcaaataccagaaagttacatttgagtaatattaaaacctctcaaaccttaatttatatagtaatatattggtatcattgttgttatcaggagttcctagaagacgttacataccaaataaagtatttttgagaagtttgacaagttataaaagatttttgggtaaaaaaaaaaactttttataaaacaattcaaaacaaatttctctaaaatgaaacgagacaaaaacaacaaaagtggcatgggattgtttagttgtgtttcacgtttccttgaacaatcaagattaatgaaataaagtccttagccaatagacctagaaatatgttgggaaatgaaagagcgtcgatcaaaatgaaaagatgattttatctatctttattttccactggtaatttaaatagcttaaaaatgcatcaattcaaactatttacaaatacagattgttccatttgtttccatgaaaaatagagtaacaggaacaaggctatatttctactttaaattaccaaataactgggccaaccacagtgttcaggatactagatatcagataatgaagaagtgtgatccctgggaaatgggagtcaaataaggtgaattctcttgaccaatacaaagttttaggccatggtgcaagtagaggaaaagaaggtgaaacctggtagaaaatctgagttgaggagatgagagttcaaaaaaacaagggaagctggaatgttcagggcagaataccagagaaaaacagtggcagagaaaaagaaagagagagagaaatagagcactgcagagagtcctccttgagtattcagcagagtactgatcaggacatgaaatgagcaatctacccaatacttgggaaagaaacagaggggtgaatttgagttaatagtgcccagcattcacaggactgggaatggtgactgttcccatccaccacatggaaaaacctcataatacatgggacatttggtagacgactcagagtagtcttgcctccatcatgaaaaataattagccctataccaaacattactctagtctcgcctaagaaatcttaaaagcaacacctaaaataatcaaactcttctgaagtaactcaactatcttccctgaaaaagctcaagaatacttataagaatacaaaaatatgcagcacctatcaaggtaacagtcacaatatctggtacccaatcaaattaccagacttgtaaaaaaaataacgaaaacagtgatccattatgagaagaaaaatcaatcaactgaagccaaccaagaacttatacagatattagcaatagcaaataatgatttaaaatggttattataactggatttcatatattcaaaatattaactaaagacatacaaatattttttaaaagattcaaattgaacttacagagatgaaaaatccaatgacttagatgaaaaatacactgaataaaattaaaagtaaattagacattgcagaagaaactattgttgaatgtgaagacataataaaaactatcacaaattaaacataaatagaaaaaaatgaaaatgccttaatgagttgtgtgacactttcaagcaattttatgtatgtgtgattgaaatcttcgaaggagaagaggagaaaaacctcaaattttatgaaaactataaatccacagatccaagaaattcagtgaacacaaagcacatatagaaggaagaaaaatatatcaaagcacatcacaatacagtttataaatacgaatgataaggaaaatcttaaaagcaaacagagaaaaagtcacattacatacagaagaataaatttaaggctatccacagatttattcctggaaacaatgcaaacaagaagagtatggtacaatatctgaaaagttctaaaaaaaaaacaacaaggatgctataatcagtggaaatctttcaaaaaatgtgtggtatattatgaccttggtatttttgtttattgtgaactttgctggaattttgtgttggagaggcagtcatgtggaaagtgaaagtatatctataataatatcaactttttagaaaaaaattgctttttaatgacaatatcagtatatacatcttaatattaaggttacttctatcagtaatactttggaatcctgtcttcccagtttaatttagtttgatgatatgttgtcattcattttcacaattgtattgatcttcatagaaacaaaatgattatttttcagaatcatatgggaataaatcttttatatatctgtagataattagccagtcttactctctgattgtttatcattgtgaatgactatgtatttttatcatcctggtttgatttagaagtgcaatctccaaagcaattagaatttatagattagattacaagaaaaggtcattccaccaattaaaaactggcacgattttctatacccttacaacatatgccatgaaatgcataaaaaaaatcactagtagattcaatgctataaatataatgtcatgaaatagatttgaattcttttgaaataaagcatagagctgtataagatatatgtcatagactttgaagatattttaccatatttttaaaatataaaaatatttggatatgtatatatttatatatgtatatatgtttatacacattaaaatcattaaacagtatattaactccactgaaatagcttaatgatctgttgtctctagctatcatggccagtgtggcagtctttacaatttctatatctttactggtaactctcttagctaactctctaagctttacttcttttctatatagaaacaaagaaaaataacttatttaaagtcatcttaattttaataatcactgatcaattactgatatggcattaaatcagaaggaactttttgttgtaagtatataaaatttaatcaagaaaaattcaaacagattgagaattgattaccaagttccattattatagaaacttataataatttttttttcagggagtaaaatataagcatgtgattttatagaaatggattacattttttccaggaaaatcatttaaattttgataaagtattattcaaaccaattacttgatgagtattaatgaataaaggaaaagcgcatttatctttataaaacagcttttagaactaaagcaaaacctaatcatataatttttgtgatgcttatatcgtggaatttctgaatattcatattttaatatttgctcaagatccacctttaatattatgctcatttacagcaattaattagccaaaactacttttcttacctgaaatgaagtaattgggtatatattaacatgagcctcattccatctttgtcctttattcccacttgaagaccacagtggattctctattgttgtttgccctttcaaacgtagataaacatttaagacacctaaaaatgacaataaaattttattttgcatattcattttcacctcaaatttgtttttccttgaccaaacacttgtaaactttttaaactgaaattttacagaacactctagtgtcttgtcctctcttctcctctcatttcctatcttgctcttatgacatttgacatttgatccaaaagtaaccatctcctaattccctagaacatgtgcatgttgcctgatattgcaaaagggatttaaggattttgcaatggggagattattctagattattagggtgagtcctaaatgcaattacatatagctttataaaacagaggcagagggagatttgatacaggaaagaaggccatgagagatagagatgttacatggctggtttccaagatggaggaaggggctacaaggactactggcagcttcttgaagctagtaaaggcaaaggaaagggcttctttcctggagcttcagaagaagtcagccctgctgacatcttgattttaggcccagaatgctttttttaaatttctgttctccagaatgataagctaataaatttgtgttgttttagatcatgaagttggtgatcatttgttatttgttacagtagcaagaggaaattaacatagcatgtaatcatgtactgaataacttgctcagagttggactctaattctgtcgtcttatattatcatttagcatcttattttttcagtttgatttttacctgtctcatttttcttctaaaagagttattggaaaataaaatgaagatagcttttatctcattatttgatatctctctttcaatagtttaatgtgctgtacacagtaatgatattaatgatgataatgatattaatacaataaatatatatcaaacacttactccagatgaggaattaatcctctcaacaatcctatgaagtacttattattattatccccacattatagatgagaaaacttagaggggttaaacaatttgctctatgtcatacagtaagaaaatagcacaagcaggatttgaactcagggagtttcagagtcttacatcttaatcactaggcaatcaatattttactagataattttaaaaatcaactgtattgaggcaaaatttacatgcaataaaattcattcatttctatgtgttcaggccaatagttttagactaatgtctactataatgttagtacttgatcaagataaaatcaatgcatcttgattgtatcaatgttcaagatacagaacatttccatttcctcaaacaattttctcactttcctctgtagtttatcttcccagccaccctccctttgctagataactagtaatcaggcttctatcactaatcaatgatttcttttatagagtgtcatattaatggaattaggcattatataatttttgtgtgtttggtgagtttccctaagcgtaatattgatgatatttatgttattgttttcttagtcattttaaattcaatgtttagtttacttatgtttaatgtagctattgatgtgtttatacttaaatataccatcctgttggtttgcatttctttcttctgtttttccttctccctctctccttccattcctttttatcaggaactgatttttttcaggatttataaaaaaataaaaatttaagatttcaatttatttactctactgacttaactttatctccttttactatgcgttagtgattattttagagttaagatataacttctcagagtctaattagagtcaatattttacttcttcatatctacaagtcataattcaaactcccttcagatgttccactattaccttatcctattcacttcactttctatatctcactccacaaatgtaacaaccttacacaacattataattcatttatctgccccatttctttactcaaatatatcttttacttttgtttacattgtaaaccttaccttccggtactattttttaagagccagatatgaatatattttctataaattataagaagaaaggaaatatggcgtttcaatttccacttatttccatttctggtggtttacatttctacctgtagatatgagttacaatctggcacccatggcccaaagggcatcccttagcattttttgcagtggtgagcttctagggacaatatttctctgattcctttaagtaaaaatattctcatttctctcatatttcttgtgaggtttagaattcaggcgggttttttttccacgtattaaaggtgttccattatcttctgcatgctatttctaatgtgaagtaaaccatcatttatttttgtttgtcttgtatatagtatgcttttctttctctttcaggctgctttagagaatttccctttggtttgcagtagttgattgtgatgaatgtaaatacggttttctttagattcatcttgctcagggttatgctgagtttcttctaagtcttttccattaattctttttaaaatttgttttattttatcttattctttttttaagagatggggtcttgctctgtcacccagactggtgtgcagtggtgccatggcacctcacagcagcctcaaactcctgggctcaagggatcttcccacctcagcttccaaagtagctagtactacaggggcaccccaacatgcctagctaatttatttatctttttttatgaatggggtctctccatcttactcaggtagatctccaactgagttcaagcaatcctcctgccttggcttcccaaagtttttgggattacagacttgagttaccacgcctggtcccattatttctaacaatattttctgccacatgtctctttcctctcttttgcacaattaacttatatataaatccttaaatatatatgtatattaaagtacatatatataaaagtacttatatataatgtaacttgatattcttgtataggtcattatggctctgtttatttttcttcaatattttcccctattttctcaaattggaaaattttctttgtcttcaagttcactgacttttttttttctgtcatctccagtcttctgttaagcccacccagtaaatttttttgtttattgtactttgtagtataattcttatttagtcctagccctttagtatagtttctctttctctgctgaacttctttatccattcacgcattttatttcctttgattctttcagcacattctgttatttcacggaacacatttataatactttttttcttttctttttctttttctttttttctttttttttttttttttgagacggagtctcgctctgtctcccaggctgaagtgcagtggcgcgatctcggctcactgaaagctccgcctcccgggttcacgccattctcctgcctcagcctcccgagtagctgggactacaggcgcctgttaccacacccggctaattttttgtatttttagtagagatggggtttcaccgtgttagccagaatggtctcgatctcccgacctcgtgatccaccagccttggcctctcaaagtgctgggattacaggcgtgagccaccgtgcccggcctataataccttctttaaagcctctatctgctaagtccaaagtctaactttcttaagtttggtttctacgaactgatgttaactttttatggctatgaatcatatattctatttatttggatatctagttactttcagtgagtaatgggcattgtagatagaacattatagagactcttcagctgtaatctttctcagaaggctattggctcctgttatagcaaaatgttcagttataaattgaccatgctgaacttgtataggcttggttttccactactaatgcagatctgtgaaaagccaaaattgttgccctaaattctctaactttatgggactcaatctctaaatctgtcttacctatgaatcttactggggcttgcatttagtttaggctgttttggagaatgtctagagaaggcctttctcccaagtatgattctagcctttctggtttcattgtgctgccaggggttttatgagatctctacactctcatgaagtttcatggctgagacttcaatattccatgctgctctcctctcaggtctccttgctctccccacctttgttgtgctgtcaatctcacaaaggttgctgtattataagtcttggtttttctagttttctacatgtacagtctagccttcagcaaatagtcatgagggaaccccatacagacttttggattcaaccctgcatatcttttttctttctgttaccctgacccacagattccaatgacatcaattgtacagtacactaatctttgttttctgactgactgggatcttcacattctgcttgaatttctgggatctgtggcaaggtcaggaaattttcctcaggcagagaacttgactgtcatggagatcactccattagtttctcttttctcatccattgcagtcctaccctgttttttggtctattctctaaaaaatggtttctaatatattttgcccatttttatgcttgtttagggcaacaggacttatctgatatcatttactactccttggcctttagatgatctcattttgattacagataatgatataaattagtaatatgttaatatatacgcttcacaatatacatataaactttacatataatgtagtatataaacttatttatatgaatatgctacataaattctaatgaacagaaaagacaatataacattatcattaaatcactcagagggtagccttcttaacattttggtgtatgttgctttagcctttaaaaaatatttacctgcttatgtatcgttatatgatatagagtagcttatccttcaactttttaaagaaattttctttaattatttacacataagaccacatgtatgcatataatagaagtatataaatatgggtatccactttttaagcaaaaactgcattctttatatcacagctggatgactctggcttcatctctaaatctctcattccctcaacttcttcatcaggcaaatggtaactaaatgatgataactagcataagtttttagtgagaattaaagtatgtaaaccatatattatttctcatataatcagcacatttattattatataaaatattcaactaaggtttctctattcctctattgatgtgttaggttatattaatgcattccataatgttgaactaatcgtatattacagaaataaaatgtactttataatagaccactgacttttttttataaggctgaatcaatttgctagtattttattttggaataattcatggatatttgtccttatggttctccagttttcttttttgattttatctttcagtgttgcattttcactttttgcttcaaaattaccttctatcatttttcctcttcagggtaagaaagaatctcaaacttgtcttccacagaactgactttaatttccaaaccatattgtttttttctgttgttttgtttccaatgtcatctttattctgctattatactatttaaagtgtatcactcttttgtgacctcacagaattctcctttatatctagactttatccagttccatctttttcttggtccactgttctcttatattctttcgtaaagttcatattcttatatgctttgttaaatatataaagcatatgctgtacacattttactttcacttgaagtaattcagtaagtctttttcaccagtatatgtttcttctactatgtgccatgtgagccagtttttattctatggaatcttcattagaacctcatgtttttcctctctccattttcttcctctttattcattcttgaataataagaagtaatcctttggcatttttcaccagacaatttttgaggcttctcttataccctttcatatagagttttatttctcttgggttgcatgaccttttattttgatttaattgacaggaaatacatccaatcaagaaatgcactttttaaaaaacattaaaagaatatttttaagacctattatagtttgctaacaaaatagtgcatactatatgtccttcagaattcatgcgttttaataaatacatgatttagtaaaacatattaatatgtgtgacttatctttcttatatcagtaattatagggtatcgtgccagtactgaatattgtttctcactaagggaattctgtttgcctgtaattatgtttatatttcttaacattttctttttacatatgtaatataaattcaaacttgagttatttctatttatgtttgttgaatacataatatgtaaaaaaatattttgcctaggtttaaagaagccaggtgtaaattatcccagaggtcttattaggtttgagaataggctaaacaaggtgtattcaattgtggctagatgttatttaaaaaggtaaattttacttgtttgataagaaaaagacacaagaactacaactgattgaaataaatctttcaaatataatttcaatgttttacatatatagtaataattatatgattatcccagtcagtgaatgcaaactacttattactgatatattttagaggtgatgagaaaagcagtgttaatcaacaaatgattttggaacttttctcccaggaagtttctagttcttaagtttataaaagagaaatcagtgccaaaagatatttaaacttatgtcaagtcatcttggtcaacaaaattagaacttgtgaaatagaataaagctattcaagagaagttagattcagcaaagctgattcagcacattatagtattatagtaaaaaaaactctgaagtgaatatgatggattgtgttaatactccttaaaagtaagtttaaatccccagagacactgtgttcatgctttagtagacatcagataccaaaacatataaatttaatcatctccaaggattttcaattttataggatttttcaaattctatagttctagaatataagtttgcagaagctaagcaaaactcaaactttttcttttccttagtttcttaattctcatcttttggtcaccactctccaaaaatcaggtgctagagcttagaggactttagtcagctcttatgtttaaagactacaggcaaaaaggctaaatgacacaagtgctgtcttatctcacgaataatggccaaaactttgaggttattcatggcattatgcaatagcctgattattattttaatattatttaatatatattataatataaactataatttgcataaataatatttatcactactgttaacctagttctcttaagttcttaacataattttacttttaattattgtactataaatatgtattatatattttagataaataatttaagtatatgtcctaaaatgtgcatacatattccccatagagtcttgaaattgccacatttacatgaattaatttgcaatttggtatattctgaggtctggagatcacttgcatacaaatcgcattgttataatcagtaacacagacttactgagtttcacatttcatgtaaaatgaggatgtgccaaaatcatccagctctaggcaagatctatgtatattgataggtaattgctagcatcatttgttttatacatacatacaaagtgagaaattataaaatcattattttctgcttgaataaaaacagctgcccatgtccattgatattttttcaacatataattgcagtgctatcctaaatgaaaaatgccagtttattttctacagttattaccattccttctggtgcacaggtgaatttgtacattagagtccaaaatgtttttaaattatagctttcctttctatttctctgatgtaagtcagatcccttacgctgaccttttccctctttagttctatcactttctctactcttccataagcacagtattctccattgtcatacattggctttgtccatttctcatattctttggcctttgttctccacctcctatataattccctcttttgtaggatgctttatatttcttctcttccatagacacttttattttaatgtacccctcagtcttctctcccttgttcacccacgccatgggcttgtcctacattttgatacatattactttctgacttttattttattcagaaatttattacctcaaaaagatgatgaactatttgatgaataaaaaacttttatcatatttgtcatttattctctatagaattctaaacactaggattaggcacacagcctgtgcaattcatcctattgaacagaaatgagtgaattcaaacctaagggtaaaaaatacccattgtaataaatccttaatgtcaatgaaattagttttaaagtttggtacactggatgagaaacagaagcagttaactcaattgcttaccatcaattcaattgatgaaataatattgtctattaattatactgaaaattagacttatatggtttgaagtagcagcctttctcagctactgtgttctcagccttactcagttcatatcattaattttgcttaaacacactagattttattacatacattgtctaagggaccatcatcaatgaagaatagaaaaaaaatgagtttagaagtagttagtggttcaaacctggattctaaaaagataaatgtattaaagattacatatagttttactagcaggtctataacaagtacctgtaaaaagagttttattatacattgtcataagtcatggctagattctatccacctcctcaattttaaattcatctcatttaacaaagcagttacatatgtatacatgtgccatgctggtgcgctgcacccactaactcgtcatctagcattaggtatatctcccgatgctatccctcccccctccccccaccccccaccccacaacagtgaaaagccaaagctaattaatagtgttaaaacagtccagtgcttccctagggtgagagtggtgggaggagattggagaaagggacagaaaagttttggaatggtagaaatattgtatgcattgatgtgagggtggttaaatgagtgtatgcatttgtcaaaactcatcacacttcacttaaaatttgtaccttttgttatatgtaaattatttctaaataatgttgacttacaaaactagaagtgatgcttagtcaatctaatacttcaaacattctaacttaattattttgccttatttttatgtctttacattttagttctttacattttagttcctataagtctggtttttattgctttctgtaaaaggatgtactagactccaaattgagagttgtaaacacacaaatactgacatatcttgttttgttgcgctttgcagatattgctgtttttttttttttttttttttttttttacaaattaaaggtttgttgtaaccctgtgtcaaaaaaaaaaaaaaaaaaagcagtttactgaatgaatgtcttccatctatagcattattttcacatttacagcattggcattatcagcattaaataccaacaggacttcactgagagcatagactaattcttaacagaaagcgtgacttaatatcaactattatcaaacagctcacagtttggtagttattccctaatatctaaatggagaacactaaggagccttatctatcccctcagccacctaagagttgtcttcttcaaggaacttaattctgagaatttatcagaatgcaagtaccttaatattttatatttattccactgagattctcctagagtcagtgaaatcaaggctttaaaataatggctccttatcttaacattctttctcatatggcgtttaactccaagggaaaaaaaatcccaatatgtgagctgatttcctatttgagaatatatttgatatgtaagcaagaatcttgacattttgaattctaatcagaagaaatacagtctttgaccaaaatgagaataaaaatcaaactcataaaatcatgcaaaataccatctttgctttctcaatatcttgtataaaaatatttaagttcctagtttaaaatccttgaatgccagcatatctgttagaaagcattaatccattcttgcaaaactcttgattaatccacatgattatctcaatagatgcagaaaaggcctttgacaaaattcaacaacgcttcatgctaaaaactctcaatcaattaggtattgatgggacgtatctcaaaataataagagctatctatgacaaacccacagccaatatcatactgaatgggcaaaaactggaaacattccctttgaaaactggcacaagacagggatgccctctctcaccagtcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctcctgaagctgataagcaacttcagcaaagtctcaggatacaaaatcgatgtacaaaaatcacaagcattcttatacaccaataacagatgaacagagagccaaatcatgagtgaactcccattcacaattgcttcaaagagaataaaatacctagcaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataatgccacatatccacaactatctgatctttgacaaacctgagaaaaacaagcaatggggaaaggattccctatttaataaatggtgctgggaaaactggctagccatatgtagaaagctgaaactggattccttccttacaccttatacaaaaatcaattaaagatggattaaagacttaaacgttagacctaaaaccataaaaaccctagaagaaaacctaggcattaccattcaggacataggctgggcaaggacttcatgtctaaaacactgaaagcaatggcaaccaaagccaaaattgacaaatgggatctaattaaactaaagagcttctgcacagcagaagaaactaccaccagagtgaacaggcaacctacaaaatgggagaaaatttttgcaacctactcatctgacaaagggctaatatccagaatctacaatgaactcaaacaaatttacaagaaaaaaaaaaacaaccccatcagaaagtgggcgaaggacatgaacagacacttctcaaaagaagacatttatgcagccaaaaaacacatgaaaaaatgctcaccatcactggccatcagagaaatgcaaatcaaaaccacaatcagataccatctcgcaccagttagaatggcaatcattaaaaagtcagaaaacaacagatgctggagaggatgtggagaaataggaacacttttacactgttggtgggactgtaaactagttcaaccattgtggaagtcagtgtggcgattcctcagggatctagaactagaaataccatttgacccagccatcccattactgggtatatactcaaaggactataaatcatgctgctataaagacgcatgcacatgtatgtttattgtggcacttttcacaacagcaaagacttggaaccaacccaaatgtccaacaatgatagactggattaagaaaatgtggcacacatacaccatggaatactatgcagccataaaaaatgatgagttcatgtactttgtaaggacatggatgaaattggaaatcatcattctcagtaaactatcgcaagaacaaaaaaccaaacaccgcatattctcactcataggtgggaattgaacaatgagatcacatggacacagcaaggggaacatcacactctggggactgttgtggggtggggggagaggggaggtatagcactgggagatatacctaatgctagatgacgagttagtgggtgcagcgcaccagcatggcacatgtatacatatgtaactaacctgcacattgtgcacatgtaccctaaaacttaaagtataataataataaaaaaagagaaacttaatgattagttaatttcagattctttacattccttctctacattaagttagatcatcataaggtgacatacctggtccttaatatttcagctgaaaacaaaaatgttattttatcctgtattatggtttatcaatatattaaatttttatttgaacaagttttatatctttatcctttatatgaatatcttagtaagtaaagatattgctggtaacattactcaagtgtacttttataatatgcatttctctttgcattaattgttaagaatatgtgacacttttgcttttctttttactttagttgccagagcatatagatgaaaattcaagttaagtcaataataaacttcatcttctgtctgtttttttttttacaatctataatgtcttaatgaaactaccttctatttccaaactaaactgcatactttcaattcccttgttttgttattctagtatatccagaagcaaaagaatctagtttggatcattctttaaatctattgtgtaaatgttgtttccgagaatcaaatgtaaataaatcatggttactgctctcaaggagtttacaattttacaggggtcagtgtgataaacattatgataggtatacatatcaggagttttgggaacaaaaggagcagagaagataggaaagaatttcagcatatatccctgaattgcttttttaaggaaggttatgcatgacttagatgattaaacaggagaaaaagtacttattcaattagataaacaaatatttattaatttttttgggggagtacttgaatatttacatgcagggcagggtgtcatcagaagagacatcatttctactcccatcaagcctacagttcagcaggacaaaagagacagcctgtgaagaggcttcaggcacaagagagctttacccgaaaaacttcaagtatgactggaacagactatgaagctaccccaaggaaaagccagaggggcatatatccttgaggtcctgttactgcttttagagaaagatctttaccctggaagctatggactttttaaaaaagacagcaagaaaatcagttagcaagcgaaatgcagtactacgcacagatggggactcaaactggccattatattccaaaatgcgtttcagaaacctacagattgatgtcctcatctccaacctctccagctgtctctatattgtcagttactttgtgctcccatttaccactctcctaaagctatctcctctttgaacatgtacctctgtatctgttttgcagagaaaatggagactgttaggaaggcaacttccatgtcagcttgctgttattgcagctagaaatctatcagaagccatgttactattaatactgaattcttttttttaccgctttagtggaaatggcatcagtttctctcttaaaagtctcattccacagccagagctctaaattcccatctaagcttaccctttttattacctctttttcctcttaaaataagcccttctacaatcccacatctctatttatcagttcttttacagtctcctgcttcttcattaatgaactcctttgctttccccctgtttactccatagtggaattagctttctagagacacaactttattgaaccattcgtatcaagtacaatgaatgtattcataagtgccttaatttcctgatatgatatgacctttacattgcacattctttttttaaagaaatgaatgatgcatttaacttatttttaatacacttttgtcatatctagtgatctcctatgagattcttttttttttttttttttgcaagaacattagaaattcagtggattcatcgagaattgaaatgtccattagtagtcacaggaatgctgaaagaatcttttattattatcatggccagatgttgtatcacttacatataaatcagcaggtactttaaggataacattatagttttcatttggaaacatgtttttttcttcaatcaattttgatgaaacatttaactaaaaagaaattgtaccaatgtggcagagctcaactcaacctaggtcctagcatgaacactcttgggcatttctctccccttgggtatgggcttgaattatcaactcagtcacattaaatggaaccagacagacatatgggatatcacttcaggggttaggttatgaaaaatcctgggcatgcattctctctctcttcttaatggattacttgctttgaagaaagcctgctgccatgttatgcgacagccctgtagagatgtccacatggtgaggaattgagggaggcctccaatcaacagccagcaagaaatcagtatctatagtccaatatcttaagggagcaaagcctgccaaaaatcaagcaagtgggcttggaagtgtatcctccccaaactgagtcttcaaattatggtggagtccttttctggaaggactataaccttaggagagactttgagccaaaggcactcagttgagctatacttgtattgacccacagcaactgtgagataataaatatttgttgttttaagtcacaaaagtttggggaaatttgttatattgcaaataataagtaatgcaacatatttaactttagttcaaagaggaatctcttttcttagtagggtattgctcatttctgtattagataattatgaaccttctcaatggtatactgtcctttagtcacagttaaaagttcaagatttatttacaattactcatgaagttataaatttaattaggctattagaaattcaggacaaggcatctttgaatctggatttccaaaagaatgactaaaactgaaaatacaatttgtaaaaccagtggctataaatgcctcctgagtttacagatgaatgaaagtccgaaaataatatatgcaaagaggggatgttttaactaccagcagatctctctaatgaactatctcatctagctttaactgattactcaatgtctggaccaggtatttttgcctagattttagtaagcagcatgcctgcagcttgctgagaggaactcaagtaatagacctgatacccagcctgcaaccttcagtctgatgaagcaaagaaatgacataggggtcaaaatgtaaatgtttgccaagaaatggagaactgtcctcctaattttccctcatcccaaaataatcagaataaaactagcagaacgtcaactggacatccattgacaataaagaagataagactaacaactattaagttaaaagtatattataatgatgtattaaaagtatttttaaagtatcttaaaattattttaaagtaaagccctaaaatctagtctcataaataaggtgaacatattttatgactttaagtaattcagaatattggtcttggaaatatttatttaaaaatcaattaaaatatgtgatccaatgtaaattggaagaggagaaagaaagtacatgacacatattcaaaacaaagaggaaacagagtatacattattaacaaaaaggaagaattagagttgagctaatcctacattagtaataatatagtaatcccacaataaataaaatggcttggcaattatgcgatttgtttcctttcattggttctttaagtgattcccagtctagattctgtttctgaatgattttacctatttttatgtttattttcctaaatcaaatatctcattatgctttttgattgcagaaaatctaataactcacaccactactaagtaactgtcacatacttagctaggcttgcaaaatcttccaacaagtgttcctgcacagtaataaaacaggcagactctgtccagcttcccatgtttgtgttatggcttcactacttagccaggtgatgggcatggtaactaaagtcctttgtatttcaattttgttatctatgaaacaggataatgattttaataagcacaaatgttgatcgtgaaaattaagagaaataatccacaaagtatcctagcccatgatgagtactccataaatgtcaactattattttattattgctattattattgctatttcagattcaaagtaacctaagattatgagtgtctgccatctggttgaagatactatgtatgttgcctaatttaacttaaactacagctttctgaaataagagttattattctcattttacagataaggaaaccaaggttcagacattttaagtgatttctctgaagtattacagtgatgaagtgctacagccaagttcctgcccaggtctcctgacttcaagtttatagtagtttaacttctcaaaagctttctggctgggcacaatgactcatgcctgtaatcccagcattttgagaggcgaaggtgggaagattccttgagaccagcctgggcaacatagcaagagcctgtctcataaaaaataaaaataaaaataaattataaaacaaaacaaaaaaacccaagtgctatccatttaggcttgtcagtatactgtgaagaatactagttaatactgttgggtatgagtttgaatcccagcacaaccatttacttggcagttcacacaaacttcttgaggttcagttttctccacggtaaaagatggacagtgacgttcacttttacaaacttaattgagagtattacttagcttaaataatatggtggctgatacatattatgtgtccaattgtattagtttacatcacatatatttatactatcactttattaatttatataaagacactaatgtaatcctaacttctcaaattttacttccttattaccagtgctttaaccctccctgtgctaatctctgcgtattgaaaacatacctcttttgcataccagagaaatgttcttgtttgtattgatgcagtgactcattcctcaactagataaagatccacaatccctggttcaagctctatggggttagatatacttcattatttagaattttgtcttatgttagaaaggtgagagattatatcacttatatcatgtgatatcttctggaatggtctcgagtagaatcatattattaaaaacagtaatatttttgctgcaaatggtataaatgtccacattcatttggatagagactatacataggttcatatcagttcaggttatatatcaggctaacatgtaatgtcaaataattaaattttaaaaattgatattcagttctcaggattttagaattgcacataaagaatggtagacctgcatgatctttttccccacagagtttactaggtctactctcagtgtaatgtcatgctctatctagcacagttgtgcatctgatcttatcctctattactgtacaaggtctcaagggaaggaaatgtgtctttatctttgtatgctgtgcaggacctagaatgttcttaaatcttactgggtgtgtttggcatactttaaaaacatgaaaaaaatcacaccaacgtttcaaatatgtggatggtgctaaaaataactgtcaatatagcaacatgacaatattacttttcatcatgattaatatgcattcagtcactgtcgaagcatgtttcttcggaaagaagcagcctaaattatgctgtgtcaattccatgagacctggtaaagaatttaactcattgattgtctacctgatttaggattccaaagggaggtaggtgatgatctaaaatgtcaaattccaaatctaaattagatggtgggaaaaaattcttactatcttattttgcaatttgcagataaatcatttaaaaagtgaattatagcattctttgaccaaaaattgttttaatgctgtgtgtttatgaacctttttcttcttagttatcattaattttgtaagaatcagtaattattgctatctcacctatatgttgtccatacatgtgataaaagaagctgaaacaatatgcagtgtttgtgggtccataagggtttttgggagctatgctgaaaacagggctgagaagtcgagccttttcgccttccaatctgggtcgtgatgtctcaatgtacatataaaaaccttaaaacagacaaaataaagtgtttaaacacattattcttaggcataatgaaatttcaaatcactgagaagtcttatagttttcatacaaaataaagatggataggaagatttgcatctcatttataaaatctctatgtgtatatgtaactaatagtggctgtaacacaaagaataaatgatctaccaaattaaagataaaatgtataaaaagttgaaatttagacttgaattatcaaaaaattcctattctctctactatatgtatcagtgaagtctgagaaaaaattaatgtctacaaagttttgtaaatatctaaattgatactgtacagaaaatttaatattttattccataatcttcaaatatatggctaaatattagtatttcatatttatagcagtttttaaaagtctctgattgctatgaacacaaaaggtcatacccccataccttctttggagccactacggtcagcattaggtcctgtattaggagtatattttgtatttcttgttgctgtactttgctttgtccagtcaaaattatctgtatcatcttgagtgaacaaacaaatattaccatcttcaaatccacaatgaaattctcctgttggtaaattttaattaaattaatattaattaaattaatacacatactgcaatattttcataagaaaaatgtaaaatattacatagcaataataatgcaagattgtgacaatggcatgagagccataatggtgcagaagattacaactaaacataaaaccaatctaattttaatgaaaaagtaaaagaattttacatgtaaattaatatcttattgaataattaagactcaaacaatttttctctaaaatatccagataactgaaattaaagaatataatttatgcttgaattattgctgaagaattttcccaactttcattttgtcagtatagaaacaatcaaaacaaaactgtcaattggaaaattacctttattaatttacctgagggtagttttaaattggtatactttaagtttataatttttcatgcatgtctagagatgcttttaaatatccatttgcataaatggaagtgtgtttagggcaagctaatagcaaattattttgaaaagtatttatccttcctactttatctgaatgtgggtttcccagatacttgaacttcagtatggaaatgaagtaattaaaagaccttttaaagactttgaaggactgtgatttctcggatgcctaacgtatgttgagttcagggccaacacaagttcagagaaagactttttcaactatccctgaaatgtgggtggtagtagtaatgtttctaggtatcaaaggttttcttactgcttgaaaaaaataggtataaataagttggtaaggtccactagacacattattaaagagtgtgtatccttgagaaagaataaacataatgtatattatttcactcagcctcataacaactctgtgaaatcacaataatccttactcatgaggctttacagaggagaaaactttggcaaaggtcagctattaaatgataatgtcaaatggaatccaaattccctggaattcatagagatataaacacttaaagaacagagacttccattttagtctctctccgacctacccataaggggttagatttatcagatatccttggaaatggagtcctggttgagatcatgtacctgaattaattgaaaatttttggtacttacaaataaaaataaaacagaaggcttttcctttaaatttagggaatgagtttatgttttgtttttgttttttagacgaaacacttgctttatctctttgtatttatttatattctatattctgggtaggtaatgttacaggaaatatacatatttaagggagtctaaataaataactcaataaatttctgaataaacattattgtacataaaatatttattagacacatatttatgtcacagaccttgtaccaaacaagacatgaccttttgatgctatcagttggaaaaataatgttggtaacagcagtgtagcagtgtatgcatttacatacatgcacgtatttctttaaagatattttaggtatgacatgaaattccattagttgctactctggcggtttgaataccataaaggcaatgtttgattttgaatgttttcagttatttaattatatattacatatgcacaaaaaagagtcacagaacaaatgtaaagataaaggatttcagtttatgtatctactgccaagtcttactttttatatgttatttaaaattatgtataatgaatttttataacactgttgaacctttttttcgtaatttaaacttggttaaaaagagaaaatatcttgtctttaaaaatctatacaataatttttgagacctaaatatttaagtctttcatagtaaaattaagcaataatgcagcttatgaaaactacaaaaaatgtcagttgtgcctaaaatttttcatcgtttaggttattttatatggtgtaagttgtttataatattataactagtgtaataattcaaatcaaacaaagatacttaagcaacatcaatagctctcgattccttctaaggacatatatctttacaataaataagcctattactgaagaaaatttataaaaagttggcaggtaaaatgaaaataaaactcactagtcaaaacccaagaattttatgatagtcctgtcactttaaaaagagacaattataaatatgtgcaaatacatttattcatttaaaaagtttattagaataaagaatatctgatagataatgataacgcaatgagctgtacaaacttttcaaaagtcaatgtaatataaaatactaaaagagtaataagtataaataagtaataaagtccaggattttcacaaagatatagaactgagaatcaagtggatcttgaattttccactggttttctaattacaacatgattttagcagagtttctggggctacatagaaataattaaacatatcttaaatattctccattacgtggtcttcaaaattttgctttatttggtctgcagaattttccctgaatccttctcaatatgatgaaaaaacaaaacaaaaaaaaactcaggaacaagaatcctgatacccagtggtccttttgcacccagagacgatgctctttagtccttaaacttgtaagaaatctaaccttaaattacaaataaatagctctgattttagaatatgtcttcatagtaaatcctctgttgatttaatattattttccagggagagagaagttttcatatatgggaatatttttcaggtagatacatatcatcttataacatttaatataaaacaaaataaaaactttccagaagtccccaaatttaacaattttatagaattcataacctaaattagaccaaatacattggagtgtaaactagtgttctataaaagaaagtctcaattaaacccatcaaataccaactttctaagtaaccatactcttttataagtggaatatagacattcaaagaaggaaaatcaaagaaacgtgtaacaacgataaaaatgatatgcaatcccacaaaagaaaaaaataatcccacagctgcagaaatagcaaatattaagcaggttggtaaatggctccatatttcaatatttaggaaaatctataaacctcaattatcagtattaaaaaattgtatttatactcctatcctttgaaatttaaaatctacatttaatgccaattttactgattctgaacaattgtgttttaaaccaactaagaatagttactaaacaatttttgtatatttataaacattatatttttgtatttattaaatatagtgccattttgtaagttaaaatatacttactcaaatgaggatttacaggagctacaagaaaagcaaaagaaacaaacaaacaaaaaaacaatgttagcatggcttgaatgtcttttataaataaaagtctaatcagtgtctcatagttccttaccaaaacttaatgatctttcccactgtggccattgagatttatatctgcaatccattttgttttagaggattgaatataatctgctttggagctcagcaataacagcctcaaattaccaaaaagaccaatgctaaatagcacaggaaatgttcccttttcaaggtatagagtttctgacctcttaaatatctgaactagtgctaaacaaaaatactcagatatcaaaactgaggctgaaactaggccaatctataatctaggtgatttaaaaatgaaaacaattatctagcagagtttccacttttgttttttgctgttttctacttctactgagagtaaagtagaaagttcatggcacagatgaaaataaagcaatcctgatatcatgttgtaatatgtgtactaaaatgaatagctacatcaatgcctttttgtttaattacagtaaaatatacacatacatatacacgtgtgcatgcacacagaattttaaaatgatgagcaatacattttctgttctggggtaccaaaagaattttttttcccctaaaactaattatatttgcaatacaagtgccaatgaatttccacccaaagagaaatgaatactttaaatattactaacacaacaacaaaaatatctctcatctaagggccaaatttgtatctgtatatatcaattaaccacttatcactctgagaaaatattccaatctggatgaaggacagcattgatgtaattccccaagattacaatgggcagaatgtagtttcccaggattacaattggcagttaatttacagtgcagaacttatctgatttgtcattttcttagtggttgtcattaaccacttttgttaaatttgtgcaacagtaataaactctgacgggcaaaaatattcatatataattgcaacattagtatacaaatgataaattttaacagagtaactttttcaatgatttccactattcctacatacagaagacaattcccattactgtagttgtttttctgattctacattccacattgcaaattatgaaaagaataacagaaaaggaactgaaagtgaactaaaaataacaatttaattttttggcaagatatccatgtattttaattttaaaattagtaaaaattaaaattatttcatagttaatatgaaattcttaaaaaattatgtgctatctttcaaagatgtaagcgtccttgaattataacttagttctaagatatgttgtatgtacatgtaaagctcttaccagactgaattttaattgagactttgcctccaacatttaattcaccaaattcactatacataatgcagttaactttgtgaaaatttgcacaaacttctaaatagttcagcgagtccagttttttcttctttcatttgaacttgcatgtataatttttttataaatgcatattatagacaattgtgtccccataaaaatgcatatgtcaatgcctaatccccaatgtgattgtatttggggataaatcctttagggaggtaattaagattaaattaatcttggccccaatccaatgggattggtgtccttataagaggaggaggagacaccagagagctctctctgccatgtgaagaagacatggtgaaaaagtgaccatctataaattaggaagagagctctcaccagaagctaactatgccagtgctttgatcttggacttctcagcctctaaaagtgtgagaaataagtttgtgttgtttaagcctcccactatggtattttgttatggcagcccaaacagactaatacattgcctctaaaccattaaagtatacattgcccaaacctatatcacataaaaataattttaataaaaatgttggagatctgaatatgtatgcctaagtatgtaaaaacaattttgaaaacttattattaaaagtaatatctatttcctgcatgtgtttttcattttagtttgttgcctcagagttttcaataaccactactaagctaattaactttttaaaatctcttaaggaaagtcataatgatcaattaactttagcaaagaagtaaagatcttctctaatggagtggtgaaccctaattctagtcaggtttgtcatttcacagtcatttaactttgcaggacactgaaactttctgggtccgaatatcttcatcttttaaagatattgatattaatgcactctacattatacatcttatttatttggtaaaaactgtaagtacaaacaactttaatgagttgttaatagttttacttcatatttcacgtttgacagtattcactactttccccttaagcaggaaacgtatacttaagggtaaacacaatggagtacttcagctgcaaacaaagcattctattatctttttaactcaggctctgataatcagtgataaaaagaatcacgtttggccgggtgctgtggctcatgcccgtaatccaagcactttgggaggctgaagtgggtggatcacctgaggtcagaagtttgagaccaggctgcccatggagaaaccccctctctactaaacatacaaacattagctgggcgtggtggcaagtgcatgtaataccagctactggggaggctgaggcaggagattcacttgaactcaagaggcggaggttgcagtgagttgagatcatgccactgcactccagcctgggagacagagtgagactccatctcaaaaatatatatatagtaataataatattctactgaagcaatacaataaatatgaactgtttaaataatgattcattcaaacctgaaatacattgaaaattctacagctaacactgaatattaaaattctaaaatgcacacaaatttcaatttttgaaatatttatctctttagtatacagtaaaataacatatctaggctgagtgcagtggctcatgcctgtaatctagcactttgggaggccgaggcaggtggatcacctgaggtcgggagttcgagaccagcctgaccaacatggaaaaaccccttctgtactaaaaatacaaaattagtagggcatggtggcacatgcctgtaatcccagctactcgggaggctgaagcaggataattgcttgtacccaggaggtggaggttgcggtgagccaagattgcggcattgcactccagcctgggcaacaaaagcaaaatcccgtctccaaaaaaaaaaaaaaaaaaaaaaagaaagaataaatatatctaattgccattgtttctctttgagatattaattctagataaaagttttagatccacttttaactttttcaaagttctgcactaatttctatttttctccaaataggacatttaagtagtgaagaaatattttatgcatatagttaataaaaagaaaactatcactaacacacacacacacacacacacacacacacacaaacatttagcattttttaacattagcaatatgaaaaatgaatggccaccaacaaccaagaccaaaatccggcaactaagatgtcttttgatatgtatataaataaactggtacatttatgcaatggagattattcaatgataaaaagaaatgtgctatgaagtcccaaaaaggcatacagaaatcttatgtatttctaagtgaaataaggcagtctaaaaagcactacatgctgtatgattccaaatttacaacattctcgaaaaggagaaactatagacagagtaaacatatcattggttgcccggactggagaaaggagagataaatgggtagagcatgggaacttttcaggcagtgaaactattctgtgtgatactgtaatggtggagaaattatatacacttgtcaaaatccatataactgcacaacacaaataactgtaatgtataatactgattttaataataatttcttagtagttgttaatcaatttttaccaatgtaccacaataatgtaagacgttaataatggggatactgtgtcagggagacggggctctgtatacttcctgccaattttctgtaaaccttaaactgctcaaaaactgaaatctattaattttatttaaaaaacagaaaatgaattttgatctttttttacttcttaaaaagttttaaagtcatcaagaatttgaaaagataaaatgcagacaaatattgtattataacttgtaggatcaaaaataaagaaacattgcttatatcacataggttcacaattaactaaattattctatatctctacatttgtaatcaaatgtcacatttatggtgattaaggtttttgtttttgtttttttgtttagttaactggctaatgatccagaaagtcaatatgctaagttttactttgtgtctaaatttggtagatagcagcaaccaaaattttccatatagttaaatatataaataaataattttaaatgaaaggctacttaccactatatttgatcacacgaattgttgaatctccttcaccaaatttggtgagaggagtcagtcggacttcataagcttctggtttaattagctctgtcaagttatatgtaattaattctcccttttgaatattcccatttattttaatctcctgctcccaccagcgctgctgtccagcctgaaatcaaaacaataatagaataatgttcccagtatgttcttcagaggtactaagaaaattgaaaacaaattttgaaattttattaaatcaaaaagtacgtatattaatgaatacgtattattaaagttcaagtttctataatgataaacaaattttgagatgtttgcatgcatatgtttgcaggtaattgccaaatgatcagaggtatttaatagatttaatatatcatctaatgtttagtaagagtcagaaaattccaaagtgtctctgatcttgaagtcgggagagatcaaagtttagctacttcttgcttaacatattaatggcatacgagattcttgaatacttacaactctatcacattagcaaacatatgcattgcatatataactgttcccatatattatgggcattaaaagtataaaacaaagacaaatccttaacttttcaagtttattaaaaagagaggcacaataaacaaatgtataatataaaatttcagttagtcatatgtacaatagagaaaaataaaaaatcacaaggagattgaaagtcatagtgggaaggctggaaaggggcactctttagttaaatcagaggacatctccataagaagaatgttaggaagttaagatgaagggtaggaatttaccatgggatttggcaagatggaagcgatggtctccttgaaataaatggtgtcagagtaatgaagatgaaagtgtgattgtaatatgttaaaagaagaatgagtttcacaatgcttccctcactaaaaaatcacaatgctcagataatttcacagcacagttatcaaaatgttcaggaaagaattctaatcttttacaaaatcttgcagatatttttaaaaagaaaaacaataactctccagctatgttatttaatttaaaccaaaaaggatggtacaagaaagaaaaacttatgtatacaaaccgaattcataaagttttaacatacaatattgtttccaaattcatcatacagtactgttatcaaattcatcaagttttacatccagtattgtttctcttgcaaggatgcaagaattgcttaacattagaaaatgtgttaacatagttaactggcaaaagaagaaaaaacatatttctactagatggagaaaaatttgggaaacatcaactcctatttataataaaactatgaacatgctaggaatgaaagggaacttgattaatctgataaagaagatccaacaaaaaggtagaggatgctttatttttaatgcttatatattagaaatttttttagaattacaagtgagaatgctcaacattatttaaaattgtactttagtaacaataaagtgtataataattggaaaaacaaaaccaaaatagatctatagagttgtctacgtaggaatctctctctttccttttctctcactctatccttccatatgcatatacacttgaatgtcttttacaagcactttgaagctttctttattaaatgtatgcatataatttattagatgagataacaggtaatccacagctttgtttgctattgtaaattgtaacttttaagctattaatattttgctggcttatacaattgtgacagatttttttattctccttaattcagatatatatatatgacaaatacagtcctctttctatatgtatctaaacatatagtatgcatcattgccttgtaatatgtgtctgatatttttcttagctgaaatctatggtatcctttttcatggggcttttctccttttatttgcttggttatttttcactggtgctgataatatggcttaaaattctattattgggggttatctgtggcctatgacaaagacatattctgtatagatgtaccattgtttctgacatgctcctaaggtcatcaacaacatggcctacttttactttgattgtgaaactctttggtgtcacaaattagagtggagaagatcccttgctttgagaaggccttgagttttcattgctgtctgcctcaatggtgccaaactattaagaatcaaagttcaagtttgtctgggttggcaaacagctgagggcaaaagtagtttgggcagaaattctgttacttttgaatgccattttcccttggatttttacgtagtactttctctatgtacacacacatacacatgtacacattatatgcacaggtacacacacatacacatatcacataatatgcacatatgttcacatatatgcacatactatatgttcataagtatttgttttctgaaggttaagttagtcctaattatacagtcttgactgctacatttctggaaataaaaactacaatatgtgtgctacagcacagtcctacacaaatgacaaattaaataatggcatgggaagaaagcccaaatataaaatatatagagtgtctgcacagaagagagaaaaatatataccattcaattggttatgcatatggaaaaaaaccacttgaattggaaccttatatcttatacataaaattcagtctcaggagtattaaacaattaaatttaaaacatacaatttaaatcagttaggaaaaatacagaaaaaatgttattatgatctcaggtaatacattactttcttttttgttttttttctgagacagtctcgctctgtcacctaggctggagtacaatgatgctatctcggctcactgcaacctccgcctccaggattcaagcaattctcctgcctcggccccctgagtaaatggaattacaggcatccacaaccacgcctggctaattttttgtatttttagtagagacagggttacaccatgttggccaggctggtctcaaactcttgacctcaagtgatcacccaactcagcctcctgaagtgctgggattacaggcgtaagtcaccgtgcctggccaatatattgctttcttaaacagaatagggaaggatgaatcatgaagaaaaagattgagaaatttgtctaccaaatttaaaattaattaaatataaactttcaagttaaaaaatttgttctcatcagtattcaccattaaacaggaaaaatacaagccagaggtttgaagaagatattatacacatgttaatatacacaattaactagactttattaaaaactcattttgataacaaggaaaagaattcagtagcaaattgagccaaataacaacaagtaattcatagatgaggaaatccaaataagtaagtaactaaagaagaggcttagcctcacaatgaatcaaggaaatggaaattaaaaccacaactttattttccaccatcaagtaggcagaaactttttaaagattaactattagggctttgtatagatgtaaaacaatgagaatctttgtgcatgtcagaaccagaggattggggtgggaaacaaatgagatttttatcctacgtataagctaacaagttagcctgccacaatatcatgaatattagcagaagactggagactacttggtcagagaaaatgactcatgactcagcataaatcccaagctttattttagcattgatcctccttacctctgaagttccacagaagtactgcagatgtgccaaggaggacgctgcacatgccttgattgtgcgtcacatctgaaggactctgagtttaagaaaccttagtctttataactgatagtaaccaaatgtgtccaaccattgcccagaaaggagacatcacaggacatcaaacaaacctcccctctgttccagaagaagacactacattcaaaagacgtttgctatgctaatgactcgaaaagacaggttgtaataaaagggcaactggtgcctctgggcacaagacacaaagaaatataagcaatccatgaaaaattgtctttcaaacatgtgtccttgatgaaaatgcaaattggtataagtttggagagtaatttgcattaaaagccatgttacaatgagaacagataaattcttatacttggaaacaagtatattcatcgcatagaaaatggaaaatgatctatacctcaatcgtttaagaggtgataatgaaattgtagactcttcataaactggaatataaaatatagcatgaaaaaggaacctatgcaacatacatcaacatggaaaattttcacaaaatattgaactaaaattaattttgaagtagatatgttataaaatttagttttaaactatgcattttaaagaggatgtatagctatgtacatattaaagaataaagaaatgaagagaaataataaacactgagttgaagatactgtttaaataggttaggagagtgcaagagatgatgatgcagttgtgaggggtaaagaaaggacttcaactctaccaggtgatttttgttttgttttgttttgttttagattaatggtagatgtaaaaattatgattatgttattttgtgtaggcctgaaatgtttctctgtttttaataaagagaattagagaataagagagagaaggaattctgaattttcttaaaactctttcccccttgaattctatgacagtgctctctctcatattgcttcccacatcagcatctttggctactccttattttcttttcctgtgttctaaatgttgatgttctccagaattttgtatatggcgtttgtggtactctgtattagtggttctcatatttctgcatgcatgagaatcactagatgacactgttaaccaaaattctaagtctcaaccatcagcaattatggttcaatgagatctaaaaatacgatctttaaaaagcatctcctctcccacatagtaatttggacacaaataatccagaggctacatttagtgaggcacagattagtcctgctaaaccacctcattactattagtagcttcttctaatatctctacattgataacttcctaacttgtattttcagctcagaaaattaagaaaaaaaatacatctattagtctttaccatgtgccactattttaactgtcttatacctatcattatatgtaatatcccacaaaccctagcaggtagtaactatatttagccctatttcatgaatgaaaaaactgaggcagagacaggttaaggtaactcttttaagtggcagcttcagaatgtggttagacccaaaatgactctttttggtatcacttcctcctttgttttccctgaatatactgctcccttaattgtttttaccagagcccttatatatttagttataatacactatgtctggtcattaacttgataaaaatatgatgaaattaaacgccagcatacaatgtatttttaactggcctccaaggagtacggcagaaaatcaaagttatttcagtgaaaactgcatacagtcactgaatttacatacagtggtgaaggataaaaatcctaattccacagaaagcacttatctttcagataagcatgcatagttaatactaggtattatgaagcttctattagtttggtaggttaaaatactataacataatataaatgatgacacttttactgtctcttaattttagatttatatatatatgaacaataggcaaagtgctatgattttaaaagatagataaaatcaatttaaacacacaaaaatatatacagaataatttatttgatattttacttttacctaaagacacaagtttaatcaaggtgtactttccttgatgttaacataagtttaaataagagtttaataccactgaaaatttgtagtacattacaaagggacactgcaggtatcctcttgttataatgagtgttctactcaagtaattttagtcaggagatacgttgatgttgttacttattacaaactccagtgtccataacttcatatgtgtattaaaaaagcaataactttgattccaagtctttaatttaagctgtaatgaaagtgtatacttcagcagttggcagaataagcaattaaatacttcatattgtatctcagtgagctgtgcaaaatgtaaaaatggaaaactaaatgcaatgtttgcacatacataaaaggagatgcaatattattccactgattgaacgtaataccagaaaaccctcagagaagatgggttctaaacaatacagcagatgacaatcccagatcatacttataagcatgatgatatgtaagtaagtgttaaaccattttcttcatgtcaattttaaaaatccatttaattttttcttttatccccaggaggtatattccattcagatgatttagaggttagcctaaaacctcccaagtaccctaaagtgagactttttattaaaaactataatttgttatttttaccacagaagataattaaaaagctattgctgaaaaggtctcaggaggaaaaaacatgttaattttttctcttaattttataagaaacaaaattgactaacttaaaagcagaaggctgcaacagattctgaaatgtgaagggaataaaagtggtaatgttttcctcttttttttttttcttggactataaatctttttaaccactataatgagctccattgaaaagtaccaggtaagtaaaaactaaaatagaagaggaaatgcaacaactgaatacaaggcatatatgtgtgtttatttcatttatttttatgtaactctataaaagattgatatatccattttataggaaactcctattcatgtttagcaaccatactgatagtaaaaataatagctgacattaaaaatccaggtattacagaccctaaatcactcacactaatgattatccaacagaataagaaatcaggaagatgacattttcatggattaaaatcaaattgtcttataatcccaaataaaatgtaacactgatttttaagatgcactattgttttaataaccccttttagggaaaggagataataactaacatggcgttaaatgagtcttatttttattttctactagtaatagcaaacatttattcaactaattatataacttttcttctttcattaccacaaatttgagtatcatcttctttacattcagcaagaattcttctgagtaggcacttttcacatcatagaaatattttgcttatcatactttgctcgtgctattaacacctttagaagtgactgtgtattttttagatatccagaaatttataagtttttatctgcctttggtctttggaatcttgtattatttttcttaattgaattatgtctaaattaaagagttttccttgaaagcatcctggtgtggtataggagagaatacttcttgtttgaactcaacttcaacagttttttctagttgtgttctagcgtctagcatgcatagcatttattttttatgtccttggaactgtcttggcttttagtcactagttctattcagtctgcatttttcttaagcaaatcacaagttccttgagcctaacatcattatctttcccttttcttttgaagcggtgtgggattggtgaatcctgacagcttccccagaactacagtaaggcaaagaaataccaggccccattccttgaaaatttgactcagtctaccctactatgctacttgagggctcccccaagtgggacccagatctcagaacttctaggcaagtcttgcaatcttcctcaactacatgttgggaagtgagcatgcatccttctttcctactctggtgggttgtagatgccttttatcagggaatataggcacccactctattgcctttctttatcagggaatataggacccactctattgttcttctctcacttatgctaaaataatcctctttaccatgcctggaactctgtatttgctttgggaattgctcctgatattttttattcctgacataaagcatttcagaactcaacgctttttctcccccagccacctcctgctcacttccaccaccatgacctctatttgatttaaatactaggttttcaaggctactgtttttgcttggactttatacaatctattaaaagttcatttgtcacctttcttgttttgtgcaggtgtaggttggtcttcccattcttgtgccataagccttagccttctctgttgtaattttaagtaatgagagagcagttaataaagaaaattacaagaatagaaaaatgcatttgttaatttgccaaattctcaactgaccttttcaaaaagtttttaacttatatagcaaactactttcaacttgcatttagctttgagtatcttgaaaataattccctatagtatttcttatttatatttcttttagcatcagttactgattataaaacaaaacgaacacagcagccctcaggtaaagacagcattgaatgtgtccacagcatcagtgggtctctcagtctttcatgcagtttagcaagttttcttccctcacctatcttagtgagccactgctgtctgaagagatgtgaactggctatgcaagcagagtctctggtaaagctcaccagtaaataaatgaaaggccttgcaagtatacttcaaggatctttttaaagaaaactaagcattaagcacagagaacaaggtctttagtgacaaccaagggaaatattcttgccctgcgatcacagaaatagaagtaatagaaaaagtagaaattgaagttgaaaaaacattgaatctaaaacttcctacataaattaagggtgttatgataaagttaaatatgtagttccaaaacaactatgacacatacaataaaacagaactttggaaaaaagtaagttctttagtaacttgaaaaaaattattcctttcacagtagctaaagctgaagtgaagatgaaaacaaagactgtcattttacgtagtctttaatattcagtacatattttatgtgactttacattcctaatgtgtcagtttaaagtatattaaagggatatgtgagaatatttaaaatatagccaatatttattgagtgattgctatgttcttttaatcccaagcaaatcaatgaaatagctcattaactttaaattgtttctatatttttatattttaactctttctattaaaatgtgtagaattactgtttctaaatataataattctagaaaaaataaaatgataaaaatgaagagaaaagagtaaatatggtatctcagaaaacatacagaataaataatgttcaaatgaatcttgttagcctttcttattcctgcccctttgtaatatttgaaaggtaattgctaacacttaccttagggaatgattaatgtttttaactttcagagcacatttatcttattatattaatataatttatttcctgttttatatagttagcaatacgtttaataaggaattataatcgtgattaagtaaattatattgaataatactgttcatattcatgatttggtagagtttaaaacatttgacatttaatgaataggacttaagaaggtgaaatttcgatacattaaataattttttgttttagtttctaaaagaataggttattattatttaaaatccagcacatatataaaattctagtaactacaattttatcaccaaagcatttccttattattggatttttttaatgacaaggcttttttataatacttataataaatatcataataaatattttaagacttaaaaatgaaatgatatttgaacttttgcaagtttcctatctaaacttacaaaagtaaatgtgttatgtagtagaagttaatatgagacattctggctcataatagtcactttggtcacagtcaggttaacataccctcatctgtggggaaatgagcctctaatggaaaacatcaatccttaacatacaagtgacaactttattaaaaatgttttttaaataagcttatttaaagaaaataatataaaaatgtgttcacaaagcaatagtaatcaaaacaatattggactagcataaaaacagacatatagacaaatggaacagagagcctagaaataaacttaagcatatgcagtcaacaaatttttgataagtccaccaagaagacccaatgaagcaagaatagcctcttcagtaaatagtgtgggaaaatgaatatccacatgcaaaagaatgaaactggctcgtatcttacaccatacacagattaactcaaaatggattaaagatctatgcataagacctgaagctatacaatcctagaagaaaaagggatggaagccccttggtattggctctgacaagaaattgttggatatttaaccaaaagcataagcagcaaaataaaaaataaacaattgggactacatcaaactaaaaagcttcagtacaacaaagggagcaattaacaaaatgcaaagatagcaatgaactgtaaaaatcatgtgtgaaccacattatcagataaaggggtaatgtccaaactatataatgaactcatgcaactcgacagcaaaaaaacaaataatctgaccctgcaaaaataagcaaaagacaatagatatttctttaaagaagaagtaaaactggtcaacaggtagatgaaaaggtgttcaatatcactaaccatcatgaaaatgaaaatcaaaaccaaaattaaatatcatcttacatctgttggcatgactattataaaaaaaagatgagataacaagtgttggcaagggtttagagataaacgaaacctctacactattagtgggtatgtagattggttcagccattgtgaaaaacagtatgaagcttccttaaaaagttaaacatcgaactaccatatgacccagaaatctcttttctagatacctacccagaagaaatcaccaacttataaagacaactgcacacccatgtttattgcatcattattcctaacagccaagatatggaaacaacctaaatgtccatgaatgaatgaatggataaagaaactgcaaattacacaattgaatattacccagctttaaaaaaacaaggtactgctatttgcaacagcagggcggacctagaagaattaagctaagtaaaataaagcagacccagaaataaataagagtgcatgatatcacttatatgtggaatctaaaacaaaacaaaacaaaaactcaaatacacagaaatagaacatggaaaaatggctaccaggggtgtaagtgtgaggaaaatggagagatggaggccaaagggtacaacgttcagttatgtaggataaataaggatagagattaatcacagaacagaaggaccacagttaatagtattacataatataaatttgctaagagagtcaattttaggtacttgtaccacatatacccacatattgacaaacataagagaactatataagagaatgaatacgttaatttgcgagactgtagtaatcattgtattatgtatatttatatcaaaacatcatgttgtataccttaaaaatgtacaattaaaaaagacaaatttaaaaattattaatagtgtattcacattttaatactacaaatttctaggaacaattttgacgactacattattctttacataggaattaaaaatgtaatcatagagattgagctattttaaaagttatcttctgtgtttttagtacaaattgtactgtcagtctcccttaaattcactgtgatttcagccagtagggtgcctaaatatgaaatttataatgtcaccatggatattttataaatttttttagacttctatgtatatgtcccttaattccaccaccagacatcagaaaggctgagcctttaatggcacatttgattcattttccacaatttttagaattgcagtttggggtgacagttgagaatactcaactaaagtatttttgtttactaagaaaaacgaaaagtagtaactctaatatttttgaggactcactattgccagatattttgctaaatattttacacattattttaatttaaatcttataaaaaatctatcgaggttagtattattatcttcatttcctcagttgaagaagtagattaaaccaataaactttcccaggtcatacagttggtaagaagcagaagataatataaatattattacccaatattgtccaatttccaggctactcttgtaatcttaatcactattctccatttcttcttcttatatcaaatgtgttgctttcagtttttcctgacaaatgtgtgctttatttacattcctttagaaatttataaatttttttttcaccattgggaaggcctaattatgttgaactcaattacatagcaaggggcaacagaggaagataacaaatctagcttttatctttaggacaagggttagtcatacaaaaagcttttgattttgtgagacctgacagttaaagtgaattctgattctgctttccattttatttagagactccagtggatgtgtgctttggttgtgctgagtttgtactcataactgttacataaatcattaaatgacagggtatttcatactgcctcaggaaagaatttgtatgtattactgacatatccccctaccatgtatttattactcccatctgttaaagcaaaacaacattgaaaaccacccaagagaccatgtgtaacagtaaaaataatcattctttagcagcttctgataaattactatgaaagaaaaacttgcttcctatcaagtttggaaaaaacacattctaattattttcttgtcatgcttggatcagcaggtgaaaggacacctcaacctaaaaattaattttgttatagatttcaatcctgataaattggaattaagcagctcagtcagcatctttcttcatcaggtaggttttctaaggactactacaaaaatatccaggaggtagtaataaattaataattagggtttgagtttttagtttttattcatcttggtatctgatatggtttggctgtgtctccacccaaatctcatcttgaattgtagttctcataatcttcacgtggtgtgggaggaacccagtgggaggtaattgaatcaggggggcagttacccccatactgctgttctcgtgatagtgagtgagttctcacaagatctgatggttttataaaaggcttttacccctttgctaggcacttttctcctttataaattacccagtctcagatatttcttcatagaagcatgagaatggactaacacagtatctattttatataaggggaatcataatcacttccttcaattatttttaagaataactaggttggccaggcgcggtgcctcatgcctgtaatcccagcactttgggaggccgaggcgggtggatcacctgaggtcaggagttcaagaccaccctggtcaatatggtgaaaccccatctctattaaaaatacaaaaattagctgggcgtggtggcgggcgcctgtagttccagctactcaggaggctgaggcaggagaattagcttgaacctgggaggtggaggttgcagtgagccgagatcgcgccagtgcactccagcctgggcgacagagcaagaccctgtctcaaaaagaaaaaaaaaaaagaataactaggtatatttctataaacctacaggatattttactactgctatatgctatattctggatttattactaatagtcttaatattttgattctgcaatgccgcctgtcccttccatgtgtcattgataacttcctttcacagtctttcaactgaagttcttgcttctggtgagtaccgattactgtccatagtacgtattgctactaaagttcaatcttattctcctgctaaaattatttgagtcattgctcttttgtaaaattatttataataatagctactatacactttgatggattattcaatttaactgggttaaaatgtataatgtcaccatggatattttctaagttttgttaggctattttagcttgatgtctcttaaatatccatttgggcagtcattttggttaatatattttcatagactttacacagtagagaatgttgatatataaatttaaacatactgatgtaccatagctttaattcaattattgacaatgataaaaaatttaattctcaaagtgtcctaaaattatagacatagaagaacaaaagtaagaaaaacaggcaatgcttcttgttgtgaatacttacacaaatgtataaatagagattagcatcacttactacactttggatttaaaatgtcagtaatattttcttctcatagaaattgtacaacattaattgatacatttattcattcatttaaaatcatctaacttatgttggcacgaaaaaagtaatggaggatcaagcagagtaaactttttatattactgttatatatttgatatttataatcccaattttaatatgagcattaaaattggaagtgtaagggagaacagacatgagcatgaggatgttatctaaaacatattcaaatataatttaacataacttcaagctctctatacgttttctttgagtcttagaatattcaaaatttaaaattacctgaaatacaatattgtattttagtgattttatggccaatgaaacacaataactttctcttaatgaatatataggacaatatgacaagaaatgctacttgctaatcttttcccactccacttactcattaacaatttttagcagtgctgtatttctgagcatccctccaaattaggtgtggtcatatgacctagtcctggccaatgacatgtaagtgtaggtgctgtgtgaggcctctgggaaggcctacatcttttcagtagtaactattgaaatagtgatatatccagtagggttctttgtttaaagagataccataaacatgcctcccaaatggcacaaagtaaatcgataattgaaccaatcaatgacaatttagaatacatattttaaatgtttttcagaaagccctaatgtgatatccgtatttattcctatatgaaatccatatttagattattgttctctactaacatacttatatttactaagcatctaatctagtatcactctccactgaagtgtgcctatgtttaaatattattttaacttattatcaacctcatatttgtactgcatattcctgtcagtttctagaaaaatgttttttaattatcaaagatttcttaacgcattgctttaggaaattaacagttggagaaacacgtgatgtcttatacaaagatgtacattaaggtcatttgatattttgaatggcaaataactacaacattctattttaatggaaaatgttgcacaatatcgtagattgattcagtcattgaaagccatctgttgagagcctattacttaaacaaattagacggagtctttgttctccttatatgttaaagtctaacctatacctgcctcattgagttattctgaggattaaaagaattaatatatataaagcacttaaagatgtttaacagtaagtaagaattatacaagtgttagctaatgcaataataacatcttctattcctactaccattatgactaaaattacttggttgcaattggtacatgtgtagaaagagtgcagtgagcaattaatttaattatcactcaaaatgtataataataatctgggaacatataatatgaaaaacatggagatatgaccttgcttagaaatagtgacaatctttatctatttttggaaatcggaaaatttaccaatataaatgatagatagatcctaatttaaaagtaaaaaatgaaattataaagtgttacaagtaaatatttgagaatgtttttagatttttgagtgcattatgttttctaagaggatctgaaattcagagaccatacaatggaaaaattgcataaaaatgtaaaaatatgaaaaataaaaataacaaataaatgaaaagataaatgcatggaggactatttccaaaacatatgacataatccttcttaatatataaagggtctgtataatcagtaagaaaaatattagcaattaaaaatatgaaatataaatggaaaataatttggagaacgagagtttattttggaagagactctggtaatttctctggtaagaaattgaagttagtgatggtggtagatatgaataagggttgaatgatttgaagaatattgaaaaataaaattggtagaaattattgattaattggatatagagaataaaacagagaaaggcgtcaaggtacatttcttgctggcttgagcaatgggacagataatggccattcagtctaatggggatcacaagaggaggacaatgtttgagatagaataggttagaatatagaagcattaagtttgggaggccactgagatatccaagtacaggtttttcaaataaataggtctagggaggtaacattaaaactctgacaacttcattcatcaacatgttctttggtacttgacaaataatttgaagtattatggcaatcacatattgtgtgttggctcctttaaagaacacaaccaaagaaagggagttaggaaaataagagatttatttacttcagaacaagactacaagactggataggacatgaggtttggcaggaaaatgaaatatttcattaaggtcagacaactgactaagaacaaagggtgtcaatctttttaatcatatagatggcatcaacaaaaataatgaaacagtataaaaatattagcttaggataagcaaagaaagtatttaattgtccacactgcagttattaattaaaaagaaaacacaagaaaaactaacagaatctctgcccctccccaaactcaaccttggagacactataaaattagagggagattcctgaacctaaggggaaaatcgcagccgctaatggaaaggggattatgtcacaaacaggaaataggttggcatatgatattttactttttctctcccacaccacatcatttttataagtcagtcattactgaagatttttcctctgagaaaacaaaaattaattataccaggtaataggtcaggagtagataaaatttgtaggcaaactggcaacctgagtgttttctctcctccccaccctttttttcccaaaatgattacatgtgaaggagtcttttcaaagcagaattacaataaatttccctgagagttatgataatacatggagaggagtcaaatccagtctgcaatgccaaaggctatactctgagatgaatcatttgtaccattcactttctatttgattcttgaactcaggtggttagaaagaagttacgatttgagctttagcttatctcacagaaatatattactgcccaagacaattaacatgggcaaaagaatatgtgctcaccaaaagaatatgcactcaccaagaatatggggctcacagaaaagctcaaccatgataaataatgatagaaaaaaaaaacctagaccagctgaggatgcaattaatgttaaatttttaaccgaaatgtaagacaaaaattttaaatcaacaaaactatcctcaaggaaacagaagtgattttgtaagttgctagttggcaaaatatagctttaaaacctttgagaaatactggatactgcaatactaattgcaataaagaacccaacagataggctgaattgcaaaatagatctaacgtaagaggttttgaaccagattatgtcaaacaatgctctcagaaggcatcagtagagtatcagtatagtttaaaaattacaaaagaagtaaagaaatatgtaggaaagaaatgtgtcaatatccatatatacttagaaaagaaaaaaataaacaaagtagtcactacttgaaaatacaatggtacaattttctaggatattacctcatattttttaaaagtgggcaaaagacatgcacagacatttctctgaagaagatatacagatggaaaataaacatctgaaatatcatcgggcattagagaaatacaaattaaaactaaatagatatgactacacacctatcaggatggctgagatgaaaatagtgaaaacgacaaatcctgataaacatatacagaaagtggctcactcatatatttctagtgggaatgaaaagaataaaaccacttcataaaatagtttggcagtttcttttaaaactaaagatggacttactacaccactcagcaactgcactgctgggcatttatcccagagaaacaagtatttattttcacacaggaacttgtacatgaatgcttatagtacctttactgctaatagctaaaaacttgaacaacccaaatgtattttaaagaaagaattattaaacaaactgtaggacacccataccattagaatactactcaaccatgaaaagaatgaactactgatatatgcaacaagttggataaatctcaaagaaattacactaaatagaaaagttaatttcaaacaaataggtattgcataattccatttctgtaacaactgtgaaataatataattatagggatgaggaggaaattagtggtttccagggataagggatataaaagagtaacatcagggagtctacggtgatgatacagttgagtatcttgtttgcattatggttacacaaagctacgcacatgcaaacacagatacacaaacaaatgagtgcatgcatgtacaatgggtgaactctgattaaacttcatggattgtaccaatgtcagtttcttggttttcataatgtacttgtgtttgtgtaggattctggcttgaagtgggcataatgggagaaggtttcatggaactttcctgtacatttctatgtaacttcctgtgaatctgtaattatttcagaataaatgattttaaaaagaaaaaaaacactgcttattgaaaaggcttttaaagtactgaaggggatatgtaagggtgagaaaaagatacacaaatgacacacatgaatacttacacacaaacttgttatagtaaattttaagaatggaaggggaacatcacacaccggggactgttgtggggtggggggaggggggagggatagctttaggagatatacctaatgccaattgacgagttaatgggtgcagcacaccaacacggcacatgtatacatatgtaacaaacctgcacgttgtgcacatgtaccctaaaacttaaagtataataataataaaattaaaaagagtatcaaagaaatataaaatattggaaaatctaataagcatgagtattcaagcacaaaggatggaaaatcggactggcatgcttcttgatagcatctgtgcatacaaaagtcagtggaacaatattttcaaactattaaaggagaggaaaatcaaacctattcagctaaagtatcccacatgcattttattcatttattcagcaaatatttactgtacaaccactatgtgccaaacagtaccagacattgaggataatgcagaaaataaaatgagaaaaatatcttattccatgcttttatgcaattgtaaaagcaatttaattaacctgtaatgctctccacatttctcaaccactctggaaagctttgttcaaaccttttcctttcctttaacaactgaggctccctgctagggtttaaggatggtgagctgagcctgtgaccaaaactgagcattctctgaaccacattggcatggcagtcttaactgagagctatgtccaagtctgaaagtaaactcaaaaaggaaaactgtggcttgtgtggagatcttaattattcatcatcatgaggaatattgcttgggaatgaggatgacttttaagcaattacttcataaggtatatccagatgccactaggtttaagtgcagttgtcaccgatgaacccctctttcttgttccctcccttttagggatataaaaccatgacttattatttgccctcattttccccttgttttacaagaaggagttttatgcaaaccatatgccactgtagaataagtgtaatgtctttatataaatacatctatttttagtttagttgatttttttcaacagtaccaccatgacctcaattttgaaagtgtttgcatttgaattgttattactatttttgtttacttcccaatgttaacgtaagtggtaatcagtggaactgtatatttgcttcagaactcttttcaaaataaataaaactttgcagatatatggaacccacattctatcttttctcaaacctgttccctccctccctcactacagggaagaattatatacagtaggtacttttttttcttttcccaaatatggttttatacatttccagcatatatttgaatacatagaaattacactctttgaaggaaaaaatcttatttccttccaaaatatttgctttcttttctatgctaagagaaattttctacaactaaggttttgttttgttttttaagcaactgaaataaggtaagcatagcattgtattgatgcagaatgtatataatacaaggactacagtgagttccttcccacgatttgtctacttttattgcttcatatatggccatgatattttcacactctcaagtaataatgtctaagaatctgctgtatgttcaaggtaatgctatctagaattttatggtagagaatataagcattttctcaagatttacactacttaatgtgacaatgcttcatttgctataatttctaaggcactaggaatacacagacctagttaaatatacagattaatcagtgtttcttttctttatttcataacctaatgatagatgcaggaggcaaaaagggggagggccccagagaatctcccaccggcctacacactgcaagaatgggttggagccacgggaagtttgagccatttgcagcagggaggagctgcgcctcttcagttcctgtgctgtggcctgttattcaatctgtgaggtgggagcgctggcaggaatccttctcattttgctaagagtttttgttgttgttgttttgtttttttcttttcgtccaataaattccgttcctgtcacctttcaatgtgtccacatgcctaacttttcctggttgtgacacaagaacccagatttagctgaactaaggaacagaaattctgcaacactaatctcccttttagaatatattttaacagaaaggggtatggggttgtttcatgtcaagaagcacattcttttaattttattgttagggcagaattagtctagtgtaacctttataggtcagaatgtaagaatgacagttacttatataccttgactttttattacctcaaaacagtaaattttatttgaatgatttagaagacttatgttagaatcttaaccaaaatgtctaatcctatacttgacttcagagaatgtcattctatttccaatagatgaaagcatttcccctcttcatctttactatagagccattgctctataattaattattatacctctatttattatagatcatcaatataatttaatttttctccaaaaattccagttgaagttaatattagtctaatatatgtgctggttacattatttgtaatatgtggaatactggaatgcctgttttactctatggcaaaaagcctactttatctcggtttgtgcctttgcccatttactaaaaatgactgtgtgatttattatgattgcctggtttccaagcaacagttttttcaagttgaaataaaattgaataccttaatatataacaatgtattcatgctttctgtatgttcatcaaatttgaattgtcaaatccagttcacattataaaattgtcatttataaaggaagatgatttttaattgtcaatgttgagtcaattacaattgctttataaacaagggtgttttcagtgtatccatttgttactgaaaggaagacatataaaaatggccaattttgggccaggcatggtggctcatgcctgtaatcccagcactttgggaggccgaggctggtggatcacttgaggtcaggagttcaagaccagcctggccaacatggtgaaaacccatctctactaaaaatattaaaaattaaaaattagctgggcctggtggcatatgcctgtaatcccagctactccggaggctgaggcaagagaattgcagaaacccgaaaggcagaggttgcagtgagccgagatcatacctgtgagagagagggagactctgtctcaaaaaaaaaaaaaaaaagccaattttattttaaatatttgattaagaaattataattcgtatggccattattattgatactggcattaatagcagaagtgctaattaggaaaattcagtcaaaattgggtcgaatctacaaaagaatatgtagctatccagagctttgataaggctaagtacttttatgtgcctaatacaatccagccgtgagcaacctaaaaagcgttgcttattactcatgattgttcaaatgtactaagaatatttgagaaaattcataccaaagccatttatttttatcaaacatttttatgtctgtactacacaagctaatgtgttcccgtgttcatagctacatgtttacatttaaagaagtagaagtccataaataatgaaaacttacatagttcttaatccttaaactcctaagatgaaactcgactagaaaccccaaactcaggtgatttctctattgatatatccaacttcaggctttcaacatccttgtttcttagaaaattcacatttgtactattagaaggctacctccagtttctgaagttgtattatcagggtagtctatgtggaaccaatggaaataaatgggaatctctgtaactatgagaaaggatatggaagtcacattctattaaaacagaaataatggaacatgcagggacagccctattcaaaccagacaaccaggcacatttttaatgttgcacaagactctgtacctagatgattatcttttatttcatatttcattctcacaatatcattattaagttcccatgagataagttaagtccttaaagtgagtcctggaaaactcattttatacaagaagaggtgtggacagaaagtatttcagatattcaatgaaatttgcaatggtgaaattttaaggttagaaaaggctatttttaagcagttgggacttcttgaaacctgtgacaaaataagtactaaccactgcaggagcacaaataaaacaatttctttctatttttttttcacttggcaagtgtattcattatgcttccaaattccattttacagttttatttaagtcgttttgagattgcgtgcaaactatctcatacataattgttgataccaatttgtggtattatgcatatgcacagtaaacaatgcacatattgaaatgcatgcaaatgcaaacagattgaaaaagactatgtaatgtttcttaaatcttaaaatttatcaagttattatctgggtatccaatatgttacaaaaatattgtaaaagagttactatattgctagatgctttgagcatcaatatgactgatgatctacgtgacagaaaaaaatgaaatattcataagcataaagttcaattcatgatgacaaaaagaaaaaagcatgttcattgaaatctttgaaaattagataactgaaacaaaacaaaacaaaaaaacacaaatctctttggtgagcagccatagttaatcttttctggaagtagtaaaagtaaccaaattaaacataaatccctgagggtcaacaggtatatagtgggcactgaaaatatgcatagctgcatagataaaattgttgaaaatttaaataaaaatattttgttatattaatgttaaactcataaaattttcaaaacttacaatggcatgttgtcattatataaaagagtcatcaataatttactaatagcatataattagtattaatattatacagttagtattgatattgcatattaagccactctgtgctagatactgtactgtagaataagcagggggagagggagatgtacttcagaaaggaatgacatttttcttgcttttgaaatgatttcataaatttatctgtacaatgtatacccccaaaatgagtgcttaagcttacttttcttaaaatgagatgagtccttaaaataataataataataataataattttactgagagtttactgtgtgctactaaattcatagtcctaaaatacttaaaataggaagtaatagttgggaccagaattactgaactttctttttggaagtaaataggtgcctaggacatgctgaataaacctggatattgatagaaacactgagccttgtcattgccttgttttataaaataaaacctatcatggcactttctagtaaaaccattaattaaaaaagatgattatgcacaagttctgtttaaaatttggtaagatttcactattctatcactgatataaattagagtatatatttacttgccatctgttagctagaactttacactttataactgtctaacaataggttaatgtatcctttataatacaactctaggaagggagataattttctttgtttgaatcactgtaatattcccacagtctagactagtatttattaaaatgatgtataaccataatagagtcaattactcagtagagagatgtatctttctggatcagaaggaaatcattttgcccacccggacaaaatgtgccattatttaaatttaatggcacattaaaaatgtgccaatacatagattaattaccaattgactgccattaagcaatctcaattacaacactgcattctttgcttacctttttctttttttttttttttttttttttgagacgagtcttgctctgacgcccagagtggagtgcagtggcacgaactcagctcactgcaacctccacctcccaggttcaagcaattctcctgcctcagcctcccaagtagctgggattacaggctcatgccaccatgcctggctaatttttgtatttttagtagagactggggtttcaccatgttggcaaggctggtgttgaactcctgacctcgggtgatcctcctgccttggcctcccaaagtgctggggttacaggcgtgagccactgcacctggactgcttgtcttgctttctagcaaatcagttgtggattttgcattttcatcttccactaacaagtgttctatcagtcctctcattctaacaatttgagaatacctgctgatctaatttgcaaaatgccaattctctcctgttgacctctatattattctaatgattagattcacatgacatttttgaatttagacctctattgttctcataatataccactgtaaattttgtccaagagacttttgatgaaacagtgcctacagaaatagatattatacatatgtatttgatttccatatgtataatttgcttaggcttttattttcctattgcatacttatgtgttgctctcatttcttagctgaattactttgtgacaccatttttcatatcattcatgtctctactcaaatgccatctccttagagaggcattccttgaccacaatatcttatacaaaagcaatgctactctttttccattatctgattgtattctacccctcaaaaatattactagtacctgatacaacagtaactgtttatttgtatacagtattagtatttcttcctaaataaaaaggaaagtttcacaaagtaggaatttttcctgagtacgtagttaaggtactttctgtcttctccttagctcagaatgagaggcacatctttgtcctaggaattagcatattatgtaccaatttaaaggcaacaaaaagagttgcaggcaccattgtgttacattgatataagtccccacgaagagacaataaccctcacacatatcatcacaccactatcatatcagaaataaaaccaaaatgatccttaaaatcacaatttctggtgcttattacaaaatatgaactaacaatttggagtggtataaacctctttcaaaatttcagaagctaaaaatgtaaaacaaaagctatttgcagtgcctagagtaggctgactgaaaggggatggaaatagctaaagctctagctctttatttcctagtactttatatgctaactggaccaaattttatcttctgccacctctctcttagcttttgtggcactctaaccctgatcaattctttggagctatttaggattattctatcctattttaaaattgtgattattgagatagaaaatttaaaataattatttaagtaagcatgaaaatgtagtattgattgaaacatttaggagtcttaaccactttcaaagcaggactaattgcctccacgacaatgcctcctggattctcataagttcttattcgtcaagagtttgctgtgcaagtgatctgtcttataaactgtccataggtttttacatatccaccagacataatacatcctcaaaatatatagatttaaactgtattccagatctgaagatttctaatttcttactcctgaacataatttagggttataaatgtagccactaaatctttaggtaatttaccttacctcatatagtttttaagaataagtaaaatgtcaaatgaacatgagagaaattattgcttcatttcaattagtgtgcttgattatttgaaattagattccttctttccccagattgaagtataagtccactttccatcaagatggtttgaaaattgtcccaaaataatgaacatgtgggaaatgtaaagatcagcttctgctaccttcccaaattttcaatcatttggcatacagaatgaattttaacgatgccagctttccctctatgtctgttttatttgttgcatagcattaattgctttctaaccgttaattttttgtctgcttcctactctaccaaactatacgcttcatgagatcatggatattttctgtctggtgcacttcctatctcatgtacacataatagaacataatacatttaattgcaaaagatgaatcaaatctttattcttattcctttagtattctacaaataaaaagtagatctttttgaggttatatttttagaaaatcaaatgcactattaatatattcaatcaaatattgctgttcagaaaggcagaacttagtagtaatttgagatcttcataagtatttggttcttttatttcttacaagttcaaggaagaacattttttttcccatgttttcctcagatcaagtcaaggggctgcttgggtgaagaaagtgtgagcagaagcaccgtatgtccctttcaaaaggagaaattaaggcctggtacctgcatcaacatgctccctccaaaatacagttgacatgccaaagataattttatatcaacacatagaagcacttaactgagttcactaacattaatgggatactaagataccttctaatatgaggcaaggataatcaaaaaattatagaggagatattgtaaaggacaaaaatacatctaaattgaaactatttttaaaaattcttcctttataaaaattatgacctatcattgcagtaccttatattatagcataaacacatatatcttcaaaatcagcttctctaagcagagaaactgcttattcaatataggaaaactacctatgaattttgtattgtgtcattttgctaagatatggaactctaaaggaaaagttttagcttaagatctgtagaacacaaaacaaaagaacctcatggatatattagtacattgcagatatttttatattttaacttgaagctttcctattttgtttataaatgttacaattttacatttccttgaaaatattccattaaacctgtgcctaacatccatctcaataagagttaattttcatttttaatataaatttcatttttaatataaataatcatgttcaagggtatgttcttaatatatagaaatgagacaaatatttatatgaattgacataaggttatctaaagacaataagcatgtaaatagtgaacactgttttcatccctgcctttttgctctctcccttcccctagcctccattcaatcatcaaatcctccagattttgccacatatatttctctcaaatttccaatgcagcatcagattcaggtcatgctatttcatttgaaaaaaaagaacagcttttactttgtgcttgtcccctattaatttagtactgcattaatgactgtttgatttttctcttttgactcttttagtgtctccccacttttcaaggtaaagtttaacttctttggaactgttcctatggtccttcatgcctcaaaataataagagccatctatgacaaaaccacagccaacatcacactgaatgggcaaaagctggatgcattcccctcgaaaccagcacaaggcaaggatgccctctcaccactcttaattcaacataacaatgggagttctggccagagcaatcaggcaagaaaaagaaataaaggacattcaaataggtaggaaggaagtcaaactgtcagacttaatgacatgatcctgtatctagcaaacccatagtctcagccatcagtgctcaccaatggtagactggataaacaaaacgtggtacatatgcaccaaggaatgctacgcagccataaaaacgaatgcaattatatcctttgcggggacacggatggagctggaggctattgtcctcagcaaataaatgcaggaatagaaaaccaaatacagcatgttctcagttataactggtagctaaatgatgtgaacacgtggacaaatagagggcaacaacacacactggggcctattgaaggggtggaggttgggcggaggaagaaaatcaggaaaaataactagtgggtactaggattaatacctgggtgatgaaataatcttcacaacaaacccccatgaaacaagtttacccatataacaaacttgtgcatggacacctaaacttaaaataaaagttaaataaaaaagataagtaatgcctatgatatctaaactatcaccttcaaatttctactcaaattattgcttccatctttttacaaatggtttccaaaacttgaagtctgataaagcaatttaaacatcaatgatattttgcatttctttcttgaacattttaaaacagaaaacagaagctgggaaaacatagtccattactgagtagttgtacagcagtagttacgtagttttattgacatctgtcatgtcaaacatttattattcaaagataaatattgtttcagctattttagttaaatcttttaaatgttgaaaagcagtcaggtttttggtataaaagtcatgtaaagatgtggatgactccacatttcaagataatttaagaaactttaactacaactgaaaatgataaagctaaactaatagtcatttatcattaaaattataagaagcaattgagaatgatgattgattcaaaatcaactgcaagtttaagtgaaatgacatataaggaaatcaattttacctcaagttaatttatatctaaacaagagtaaagatcccatggcatatttctggtaataaaaacatcacgaaacttctaaataaagccccaaacacttataatattaaacataaaataaatgtgagctatacgtacatttaagaaatattaatacaaacaaggaagataattattacccaataattccagttgagggtcatggggtggggcagggcttattccagcagccagggtgcaagacaggaaccaacactgaacagggctccatcccattgcagggcacactcagacacacacccactctcactcagactgggagtgattcatttagacatgccaattcacctcatgggctcatgtttgggatgtgaaaggaaaccagagaaatccacagacgagggagaatatgcaatctccatacagatagtggtcccagccaggaactgaatttttttctcatcaacgttataaccatatgaccttaaacaaatgacattattcaaggacctgctgtactttgctcataagcaaatttgcattttcatattttaaaattttgtttgtaagtacaaacatacacacgaatgcacattcacacactgtcttcttagtttccatacaaatacaagatttttctaccctgcagttcgtttttgctggaaattctattactactgtcttcagatgaaaaatttatgcctaaatttttaccaccttcagtttcatatctaatgcttttgacttgtaaattaacatattgaagaaaaagtgttcacccaaattctagtagcatgtttctaatctggataacggttttatgctcccctatcactccagcctaacaagtccacatgtgaaaatatgggaatacttgtaaacattgattaaaaatcttatttatgtcaataacttaaccctctttcactcttttaagtgtctttgaggttgcttgtttcctccacgtttctaattaattttctcaaaccatatttctaaacagaattaaatctatacaaaggcaccagactcagagaaaatcctcaagaagtatttggagttttccaagacaaggtacccttattttacagaaccttctacatcagtcaagggtccatccctgacccaggtctctcaaatttaccatttatatatcccttctcataaacacattgtaaaattagtttgtaggaatgaagcagatatatgcaatgtccttcatttggaagatgaagataaacttcactttttacaactgacatatggcttatttcttttccagagccagagagaccatttacaaaatggtttctctacatttctctgagtccttcattctctctcatctctatatgtttaatgctttccagagcattcactaaagaaattgaagtgaatgacagagaaataaggtcactatctttttcaaaattgttccccaaaacaaagtcaaaattcaagttctgcctattttaacgttttcttaattccatttttcttcttctcccctttcactattctaatctaaatcatcagtacatgccccaaatatgtgcctaactgttgtacctgtctctattataataacattcagtatactcagtatggtattataagattaatctatgcaagatgtcattttattcatgatttaagattatacaaagaatccagattatcaaatctccacagattttcctggacaggcatgaaatggttcctccaaacagttcttgcaataaaatctatctaaatgggctaagtcaagcacaaaacaagcaacaataagcaaaaattattcactaaaataacttttaaaaatgttttaactggaaggagaaataagcaatagctcaaccattatagtcacatctactgaagaccaaaattaaatttgtaataaagttatccaacaatcaattgtatcaaacatatcttttttgcttattactttttattagtaattagtgattactcgtggtcaccgtttaagaaagtttaggaataaacctataaaattaacaaacaaatgaagtttgcacctcagtgatcgtgtctcttgccccactacctggcagtactaactgcccccatcgatttctatgatactctttgtttatttctattaaaccacttacttttataagacgttgaggacaatacttcgtttttaaattcctggaaattaccatataactaatttaatcaaattttattgactgaatgggagagcaaataagtatgataattctaaatattttaatacaacatgacttaaaaaaggaattggtcaattatggatttttttaaaataaaatatcctactttccaaagatacagtcaaaaagtcacatcattgtgtatttctatggctgaatataaaaaaggaaactgtataaaattgtgtattatttaaaactgtaattgtgtacatttcaaatgaagtaaaatgatgtttacgttgcttggtatatttagataacttagaaacatttttcctgttttttaattccttagataccaaggaaagtagatattcaaataatctttttctctttcctgttaagcaacaaatgaagcaaataattggaggttaatagctgtctaaggagattaaacaattgcttagctgagcctaaaaagtacaactttgttaggacataaagattctgagaaaacttttttccacaaattaattttttagcttctcattatatattagttctctttttaagtttcttaaagcagtgattccagaatttcagtgctttttttctagatataatgcattattttacaagaaaattgtgtaagtcaatactgaaatctgagacaactttcctaatcaaatttaagtacagaccatacagtttaaccaaaagggaatgctgggttcaatttatcaaccccctacatctatgagtttaataacacagcaatggtttttataatcctatttaatttaagaatgattaataagatttctaaaggtttctggattaaaaataaggtaaggtcttaggaagtgaatctgctattagtcttaaagaatcgaatttgttttcagacttcatctcatacacaaatgcattatgtaatcaaggcaatgtttgatattaagaggtgagatttttgtactagataacctaggtattttatggatagaagaaatcatgtacatgtataggctaaaaatagaaatattgcctaaaataataagactttaaaaatcacaaaatatgtaacataaattaataatcctttgaataaaatttggccttctagtaaaatatgtgaaccatagttattaggacataaatccatgtatttaaaaatgtatattgcttaggccacatgcctaactcagtgtatttaaaccatccaagttatgtttactatgttcaaaagctcattgatttaggattctgaaatagtttggcagatgaaaaaggctacatgcatgtaatataaaatcttcattaaaataataaacagttcagaattcaagagtgatttctttatccaaaggtgatttttaaaagttagtatctgattgtgtcctaagataatattgatatttaaatgtcaatgcctggtaaaggagaaatttaaattttctgagaaaatataaaaatgctagaaatcttcccaacacacagaaatgacaaatactcgaggtgatggataccctaaataccctgacctcataattacacatcctatgcatgtaagaaaatttcacatgtaccccataaacatgtataaatatagtgtatcaataagaacagaggggctaatctaatggagaaagataaaatcctatcactcatttaccaaacaaatcaacagatttttttaaaggttagttttagtgttgtaattatcatttcttatcttaaatctaatatgaagaaagcccatattctaaatctctttcctttctgaggaaggagaaaagcatcaaaatcaattgaaaaccttgaagttcagcagtccctcccaaggcagggtcacgcctgcttccactcaaggtctgcagaaggggaaggtaaggaagcaaagcggcaggaggcatcattaaggaactgcgggggacatgtggactagaagaaaaataaaccacatccaatacactggctgtgcatcagaattacttgggacacttgctataaacacagcggccaggcttctgaacccaggagcttgtattaaggaggagctcacaggatcttggtatctgcttctctgggtatctctgggcatctctgggcatcctgatggaggttgtctacaaacctcacttccagaaaacctggcttataatgtcattcctaaagatgacagagctggtgagacaggtcacacttcgaggagaacaaagaagtagtttcaactggtctgtggtgggacccagacattagcccacatgtaacactccccaggtgattccagtgggcagccagggttaacactgccctgtctggtaacatccgccacatagataaaactttgcctgttctcattaaaaaagctcatcacttcctactcccaagacttgttcaaaatcccattagtcccagcatcctccataggatgaagaggggcggaggagctggggtccatgagaaacgtacagagacctgagttcgagccttggctcagctactaactggcttcgagatcttgatcctcagtctccccatctccaaaaaggtaatgtttgcaataaattcctttagaatgtaaaaaaaaaaagcacctatttccattaatgcctttgtttcctgttattaaaaaggaattttttaaaaaagaactacatcgattttattgtatctagaatacttttgccctaccatcctaaacttttgtttgtaagtgaatcttcaaaggcaatgttgcttgctggggccattttgcatgtagagatgttttatgcaagagttcagtgcagaggttatagttttgaaaaaaagaggcgtgtgtctacgtgctccttctcttcttacaccccatctacaaacagcaccatcttattcacattggcagaacagcacaaagtcattactctttattgagacatccctgaaagatacatcaaagttttctctcccatggaaagagtaaaattaccaattagaatacggcatcataaaaagcaccctagaaaaaaacgcttatttctaaatataaaagaaaatcctaagaacaaaggagtacagaaaagaatgtatacagtggcaggtaaagagttagcttcaaaaattgagtaagggaaatatttgttttctgcaccatggtttattacactagaaatatgttttttttttcctctagtgaatagcatgcatcttacaaaacctggaaagaacagtattagtatcagacttactgatccaatcaagaaggcttgaaatgaaactcgaagtggaagagaaaaatgtgaatcaataacatagatcttacagaagacaataggtttgaaatgaaaatgagacataataaaaaaaggtctagaaattattttgtgaaaaccatgacttgaaataatgcttaggcttagaataaaactcaaataataaaaatactacacatgctcagctcatgaaatgtactcttttaaaaaatctgtatacaacactgacagatgagtataagaattgccataactgtttgtgcaaggagtgccctgcacaagagtacctggcctgtggaacaagtgggggacataatccacttcatattccaattgcctgacaggtataatcttcaatttacaggattaaaaacccaggcttagatatgctcagaaacatgctcaaggttatgtagctataaaaatatgaggccgtattggctagaattggaagccaagtgtgtctggaattcattattttaaaaaaacatagaaaagggaaatttatacatacatatggaatcatatataatttattctaaagaggaagagtaggagaaaattcactaatttttcaaaaggaacaatacaatgactgagaaatgtgtgtcactgcgtatcagggagttatacaccagttttatgataaaaaatataaaaaattgaatttggagatgttcatgtcaggaaaggaaaataaaagaagactttgtcactggaaaatggtgtagcatttcccagcaaaaaatattacagaggatagtctgctaatgagtacaagatatggatgagaaagagaaggcttaaatgacgggatctctcttgggaggaattctaactcatttaaatttcgcttataggtaaggattttgatttgcatccacaacacagatactaagtagaaacaaagtatttgaggtgcataaaagtaaaggaagaagatgatgagaagggttgggtaaattctatgaacttaaaacacacagctagtaatgggaagttacccagagactccaagaaaacgtaactgaggaagaaagtaagaaactaaagatacaattatgactctatctttgcaaatagacctataaccagaaaatagcacaataattacctaaagaaaacaattgattttacaaatgaaaatttagtcatagattcttacatttttacaaagcatgtataacaaaaaaatgaatatgaatgattaaacaatgtagtaaggagttttaaaaagagtatgaggtgtgtaaagtcaagaatccttatagatactccaaatatgaaaggttataaaatattagctgtgttaaggaaaaaagaaataagcccacaaactgagggagaaagaactgctaatttgttttgttgctgctattgtttctatcttctctgtttaagaaaattagcaaattagaatgggtagaacgatgttaatatagatttcggttttgctcagatttacctacagtcctttttcaatgagggataaccagagaaacactgtgaatgatccactatggtctgctgtatcggtagcctgtgtgcacttagagaagaatccagtaattatcaaaggccaggatgttttcactaggaaaagctctttcacttttttgagaatcttaaacagggtgaataagaatatgctacatacagtgtatctttttttttttttttttggaatcggagtctttttctgttgcccagagctggagtgcagtggcgcgacctcggctcgctgcaaactccgcctcccaggttcacgccattctcctgcctcagcctcccgagtagctgggactacaggcgcccgtcaacatgcccggctaatttttttgtatttttagtagagacggggtttcaccgtgttagccaggatggtctcaatctcctgacctcgtgattcgcccgcctcggcctcctaaagtgctgggattacaggcgtgagccaccgcgcccggccacagtgtatcttaatgtgagtaatgtgtcacacaagtattttattgtaaaacacaatggttttatgatagaatagctgaatgaatcgttggaggttgatcagtcttactcgatgaaaattttattctctctaccatcccaattcaaaagatttttctgtgatacagttaaggaagtggaacatgcactttgccaatctagggataatacaaggttttgggagagagctaaaagattatgtggtgatcaaataaatcttcaaaaatgttttgttatgctgaaattcatccagataatatgctaagaagaaacaatgtaaagacctccacttaaatttcaaaaatatcatttaaacaaaggatacgtgaatttaacattttaaccctttgaaaaagatacagttttttccacataacccttgatcttcagctcccttaagaaactatcatactttaatttcttttcattttacaaaagtatttctatttctcagacatattaaattagcttatgcaacattctgtatatgtcttgaacccctaaagcaaaaatatgtacaacttctggcttcttaggaatcaagacaaatgattatgcagtataggtgagtgtgagcacatctgaaataagttccttttatgaagttataccatgtaatttatctctcttatctagtgatgaaggattttagaaggctcaaaggctgtcactttagtatgtctgctgtcatagtgaaaaatatgtaatttcaaagatttttcaagtaagtcggaacagtttatgtggagtaatatacatagggtgaaaacatatctatctgtctatctatatacagaaacacatatacataaaatatattttggaattcatgcaaaactcttagaaaaatgataacaacaaggtcttcacagaggaccacaaagaaaaaaggacatcagttagatttctcacctgcctgatgcccaaccggtatgcaacaatccgatccactgcatcaggattcatctgtgtccactgtagactgtaagaataaacacggtgtctgttctgccatactggattgtaggtatcataatagaattctggagcataggcctttcctgaaaacagaaagtgtgcttaaatttgaatgatgacatattgtagtgtaagcatacttattccctttggcccttttaccatttctactatatttttcattagtaattataaaatccaatcaattttctggatatgttttgagaacagatgtgagatttcctggttgattggatgggcagtgtgagaaaagaaggaagaacacaaagcatttggcctaagtgattggaggaatgggattttcatcaaccaaaatggaaatccatgggaggatgaaatctggagaaagaagatcaaagtcatttttaaataatttgagtgatctaaatggatacaccaagtatgcagtaggatataactagtctggaatacaagagagatcaagactggagatataatcttgctaaccataggcatgcagatagaatttaaatttaaagccaagagacggatattaccaaggaagtgtgagtagatagagaaggtgaaagtctgacactggggcaatccaaggttaagagttatgggaggagataaaaaccacaccgatgcctgagagggaacaacctaaatttggggaaaactaaaaatgtggtatcctagaggtcaaaagaggtatttcgggaagtgagtgatccactgtgtagaaaacaattagtggaaatgaaaatttgtgtttgtattacctgcagctttcatcaataaagtgaacttaataaaacttaaaacaattaattaataaaagatctggtcaatatttagcttatatttagatttttaaagaaatgtgaattacgtatagtgtatataccacatacaaaccatctcagtttttcttaattgccaaaatgaaaagtttacacaccatttggaattatagatccaccttcccaatattctgaagtataattttttctattacaaataacatatttatttaataatacaacaatatttaatgagaacctattcaatgcaaaatattgtcctacgtattaagaacacaatgaatcaggtatggcctcctcattcatggaaattaattacattttttttccagacttttcatgtagcttcgcaattcttaataagttaaaagctgtatttttatcatcactcatttaacatcttttctttttttctttcttttaattagattaggccagctgtagggctcgtgcctataatcccaacactttgggcagcagaggtgctcggatctcttgaacctagttgttaaagacccaccaacctgagcaacatagcaaaataatgtctctaccagaaaaagaaaaaaaaaaagagccaggtgtggtggagtgtacctatggtctcagctactcaggaagacctacttgctgtggtgggaggatcacctgagtctagggaggcagaggttgcagtgagccaagattgtgccactgcactccagcctgggggacagagccaggccctgtcaaaaaaaaaaaaagaaaagaaaaaaaagaaaagtctcaaatgagaggaaaacaacatactgagtgaaggaatcaacaagcaaaacattcttgataatttgtatttgaaacaaaatttttcaaaatgaaataaaggaggtgaatttagtagtagctgagttagacagctagaggttttaattaaaaatacacatccaatacctacaaatttactaaagaagtaatgagctgcttagatgagtaacataaacctagagtgttttcattacagagtggtatctagattgaattggggaggtaaaagtctagtgtttcttttctatgaggactgaggggttgcttctgttatttaatcaaggaagaaacctaagggtgattgattcagttctaagtagcccattcttaataaaataaacaattcattcaaagagaatcaagaagagaatacagggacaactaggggttttttttagcatggataaaaaggcgggggggcaaacagaatttttaggagttgaaatagatcacagaaaaaatcagaataaatgttaacagatacatgaaataagatgaataccagtgatttccgaataaaatggtaaatattttgacttagaaatgttctaccaatgacctttgaatatggaatggcctacctcagtagactataaatttccctttattcgaggtatttagtcaacacttaaacagccatttagcaggactgagatgggtagctgcccacaagatggtcatttaaattaactttcagtcccgaaactgaactgtgtaggctgctataaaacatttgcctgtcaaactggatttgatatgttaactaattttagattaaatatggtttaaatacggaggaactggcacttcaaaattatctcataacattaaaaaagttcctcttgaaaggccatatttattaaaaagaataaggtctttccaaatatagtattcataaggatgaattcatctctaaggtggtgaccaggaatccagacattctcaaataccctaggttattctgatgcaacgaaatacagaccttacaatttggaatgctttaaagaggctgaaatttctctctgaaattacctccaggtctatataacaaaagatgtaaaaacttatcctaaagtcataagaaacatctctttggtcttcttcctcctctgagactggcagcagcatgcctgatccaacagccaggatctctctggggcaagactgagagacatcagataatgcggatggagcgaagtaggatagaataataacaggaaatattcgaagcatttcaggaagtagctatcttattatagttgacttttgttgactaccacgaggataactggctgcatgccatgaatacaaattgccattattctaggaacattatttatctaaatgaacacttttgaagttactgaaatagttttaccctgaagttgaaaaacagatcctcatgatcttgtgagtaatatgaatttgtttaccaagatccattttcaaggtagtaaaaaattaagctccaatctaacccattaaaatattgcaaatatatcaaatttcactataaaacgttatctttatatttaattgcatgctctcacaaagactttccaatgtatttttttaaatgctttatctgtattgggtaaatcacaggtaatattttttcatggagcattagattagaaaatactttagagattatttcaatatctcatattatagataaataaatgaaggtgcagaatggagatggggataacatatgaaaggttatacaaataaataatcaaatacaataagatccgttactttttttacttagaatcatgagattagaaaataaagttttttttagttgaataatcatattacttggaattaaaggtaaaaaacgtttttagatggtgcataaatagtaatgattagtaataagtaattgctaatgagaaataattttcagttgttacgattaaatataggcatgcttacttatgcctcacagcatactttctactgagcctactgtggaaaagctttaaaaggaaaaatgcttcctgattttattggaaaagggcatcttaaattttttgaaatgagacacacttaattttctcctctaatttcagagccaattatactttatgcttatatattcattcataagaaagacacagtaaaaccaaagaaatatccttataataatcttgggctttgacatccaaacatgacatctactggttgaacagggaaagaattcataaatatatatatttttaatgcctcaggcattttaattcttccaataagcataccaagaaaattttcttactctgtcacattctagttttattcctatactatgttgttccaatctaacttttcacattctagttttattcttatacaatgttgttccaatctaaatattttcagattaactaacctagaactatattcattaactgaactgggaggtaaattttggaatcatcatgtatgattatatataaatcttggatttaaaaaatatccctaaaatatctatatagaaaaaatttgtttttgaaaatttttatagatttatatagaaatactggtatttcattttgcaaaatggttttgaaaaatgattacattgagattgcaaaatataattttatgcataaagttcaaacataaattaaaaacaattattattcccactatgaacacttaaaatgtgctcggataaaggaactgatttcagtaaagtcaatacagattttgaaataaaaacaaaataaggtatataatactgatcaagaccacacatatcttgcttttgaaaataattcacattttggaaaatagactgtatgaatataaacttaaaagaattacacaggtttataggacatgtttgcaaatttagggatatctatcaatttttcactttgtaaaacagacaatacatagctaatacatattgctttcctacgaggtgctgagaaaatctagataaataaaatgagcccattttattatcagattgcacaatctcagaaaaaaaaaactcatacagacaacaaattctgatacagttggtggcataattgactcaaaacaagaacaaatttctttctttcatctagaaatgctagatgaaattatgccaaacctctttttagatgtatgtttgcaagcaagaaaaagaagtctctagggatcaaaaaacactgctgaaaacaagccatttaataagagtttggggagaaaaatagagtgctgttggtcttttttaccattgggagatggattttcaggcccatgggagataaggttaatagactactgcaagaagagaagttggtaatgaggccaccacctatgactaaaatctagaaaagttatagtttcagacataggatatgctagaaaacatttgactctcaccagtataggaagatgacaaaaatatttatgttaccataaaatttttttgacttttgatactgctggagtgcttgaaaagagccaatgacaaattgatcttgaaagacatgctgtcaacttaaagcgcagagaattcctctaaatcccaatgattataaattcacaaacattttgaatacacaaatacacaagaaaacgttccactgtgagagactaacaaggtaaataaatagtaagattagacttaagataatagaaaaataaaatagaatttaggctgggcacagaggctcacgcctgtaatcccagcactttgggaggtcaaggtgggaggatcacttgaggtcaggagttcaagaccagcctggcaaacatgttgaaaccccatctctactaaaaatacaaaaatcaactgggagtggtggcaggcaccagtaatcccagctattcgggaggctgaggcaggggaatcacttgaatacgggaggcagaggttgtagtgagccgagattgcccaactacactccagcctggaagacaaagcaagactctacctcaaaaaaaaaaaaaaaaaaaaaggaaatagaatttataagtatacttaataagactgaagtcatacaatagaaaaatataaacgaacaccatggaacattctatgaaagaataattgatactgtctactgggaccaaagaaaggcttcacaagaggaatgtctggcattttaactgatcttaaagaagaaaaaatcaaatctctcagacagaaaaggttggttcatgaagggataaaaaaagagaagaaataaagcatgtccttaggtggagaaaaatgaatatgttatagatactttagaaactactgtaggatatggtactgttataacattcagtgcccacctttcctaccaaactgtgcacttctcaagaacagggatggtatcatcagctctcaccactatggctgacgtaatccatgtgcttgcagaatacaggaaaaatatgtcagtgctaacttgtgaagcatcttagtgatataagatgttgaatatttactctaaagtccagttattctgaaatgactttaaccagtcctcatgaaaatgggagaaaagattttatagtgaatccactaattttcatttttttagtgtgaaaactgagtgatggcaaataattggataggaaccaaataatttaaatggcggtaaggaaagaattccacaaaagacacacttgcaaagtatcaaaaataataaaacctaatttaaaacttctcatttaaaacctaatttaaatgtatactgaaatccaaggtgaacttaaacgccaatgatgcactgatttgaaaaaaaaaaaagccttctaaaaatcagaaatcacagctctagaagctaatacatatagccaaacgatttgagaatcaaagtcatatagtgttcacatacatagactggctaaggcagtgggttatgtgttaaaatgttaggtaaaatacacaataaaaatatacgcagctctctgtcattcctccatagggcaaaacagaacatgcaattattggaaccaaaattacattatcttcaaattaatgaatcttgagtaaattaattagaaaagaagagagaaaaaaatgttgctacagaaacaggcatttttctaaatgtttaatcagggaaatgatataaatttattttatgttttacaacaataactgctgggaaagaagctaatggattgaatgagtgagaaaccttaggcaggaaactagtaaaaaaatactgcctatataaaaaaaaagatatgtgatttgagaaaataagaaaagctgatgaattcaaaagtgattgcgcatactgctgatcaacatgtgtcttctgaccggatcctgagcgtagactcctaaattttcagtcttgagagaagaatggtcactagcgtctctaactgagagggaaaatgactgtgagtatctcatcctggaaaaggagtcaaaaatttcattacctcttgagattctgtccttctgaaggcttattgttttagattcaaagccatataaaagtatgtgtcatgaaattgggagcataaagaatactttgaggaaagtaagatttaattctgtcaagtcaaaagaaaattctaaaaaatagcaatatactcatcgctgttatctatatttggcatttatttgtagggtatttaatattaggtcttatcatattaaaagtaagtaatacaggaattattaccaatttgatgggttctacctatttcattggcttgaaagatactaaattaatatgaagagggaatttaaaaatgttaaacatacaagcaatacttaagaaattaaacaattgtatttgattttaaaaccatatcttggaattaagatgaatgtcatagcagcaataaaactcaatgtcattaatagtttgttcaacagtgataacttgtcaatatgtatgcaggaaataaaaacataacaactaattaatacaacagtgaagtcaatgacaacatctctcagttgaagattcatttttaaaatgaatgcaagatgtgtgtaacaatttataatccaactaaatcatttaggtaaagcgcgtttgtacttgagacagagaagtgtttatcaaaactatgtcttcccatttagtaacagcaaatatatttttcaatgactagtcattatcacaacattatttttaaattgcaatatagctggtgtattcatcccttacttgaattcattttcttctgctcgaggcagagctgtacacatcacattaaggcagactaccctgcgaccacacttcagcactcaagagcttcctaagaatttatagccctggaaagcaggtttactgattagttaaataataaaactattgatacattgtcagtctttacaaatcactgggatctttaaagaaagcctttaaatctgcttgggcataaggtacaattgctttggttacaatattatgatttctcttgtaggttatgcctcttcaaaataaatctgctgaaaaaataaatgtctcatttcccagaaatgattttatttaaaacattctgtatcaagttagtcttcctattattaatctggaaaacttttttatgaaaatcaattttagcattattttaaaaaaattcagtcacaaaaacaatacattcagccaatatatgaatttatgaactgataaatttgtaataatatgtctaaagcatttttatgatgaacatataccaagtgaaactgggaacaagctttatggaatttatggctgaattcacttataaaaggaagtcttgcccagtcatctttttctgattcctctcttgcatttatagattcatcttttagattgcctcttctttgtaactattagagtttattctaataacattgaatctcactcttatcacttcacaccaacaaaagctttgtaactcagtatttattgaataaatcaatcaatgaactttccacatgatttcacttctcctatccactttctagtgactcagcatgccaataactgaatgtttctaaagccccagtttcatcttcacacaccttgatcccataaactaaaatactttcctcctgcagttcctctctgctttccaattgttatctatcttttaataccaaaatcatgactatccttccttcctttagtaactctttgttctatgataattatttacatcatagtacttagcatttaattacaaaaacatatcataattttatcccaatatgtaagaattctggaaaatgttttctataaaatcatttttatttcttgttgaggtcctttcccagatttagacataatatagttgaagccagtagagggtactgaacaatacaaagcaaccacactatttaaaatgtaaaaatcattcttagctcatgggccatatacacacagttggccagctgaatttggctctggggtcacatgattgctaaactctgttctaaattatttcaggatgttacagtttgcagtgtattgttactaggttcttatctgagagttcagaatatgctaagtttacatctaaaaagtgtctttcttaggcttgacctgtctgacgaattgttattttaaacaaatatgccatttatatatgtatgaaccatagctttggtgaagagtgaaagttagccacatagaatctctaactagcaaagtataaaacttgaaagaccccaagcctagattccctgtgctaatttgaatgatgtatatttaacatttatgttacatcaaacccctaaaaagggaaaatgaatattaggaagttacatctgatagatttggtacctcctaaatgtgaatactgggtctatggaattacttgcttggaaactttgctaattattcctcaaggtgaaggttatgaaaggcctatgatttatgtgatctggttttgacaacagaatttatttggtagggcaaatgtatatatatcaagtatatatacgtgtgtgtgtgtgtgtgtgtgtatatatatatatatatatatatatatatatatatatatatatatacattttttttttttttttttcgagatggactctcactctgtctcccaggccggagtgcaatggtgcgatcttggctcactgcaacatccaccttccagattcaagtgattttcctacttcagcctccagggtagctgggattacacatccatctaatttttgtatttttagtagagacaggtttttgccacgttggccaggctggtctggaactcctgacctcaggtgatccaccttcctcagcctctcaaagtgtgggattacaagcatgagccactgcgcccggcccatgattatataatttgagagggtgacaaatgcaaaagttacctaatcatgcaatgagttgacaggttatttgtgctcctatttttattattttcggaattgaccatgtcattccaattgtaagtattaatttacaactgaaaactatttatttcatgagtatgcaacacccaaagaagaaaaaaaaactgaaaagattgagaagttcaatatttctaacatgtaatacccaaatgttggcaaaagtttaataagtttaacaaagtttaataaagtttaacagaatttgtctcccacagatagataattaaaacttagtcccaattgcactttgtagatgcagtacaagcaatcctttttaaatttctctagaacaaattaaaagagatttaagatgtcatcagcatattttttttaaaagccaaattactctcatatcctttttggtattctatgcattattctttcatataccaacatcagtaaaaaaaacaaactttggtaaataaaaacagtaatatttagaacatttaatggacgttttaaaaatcacaaacttaaaaacccttagaagaaaacttcagctaaaataagtgcttattttccttgcttaaataatcttatataagaccggtttaatgacaaataatgactaagaagattctatttatcacgtgtacttgaaatgagaaagagttaatcactctggcaaatcttttctttccttaggattattcataaaatccctatccttataactaccttcattttgataaagcgactgctgttactaaatacaatacctccatgaaatgaccacattatattttatcaccctttcaatagttaattgtcttaatttatcttcctgttttttaaataaattataagctccagatggcaaatatctcttcttcatatattgtcccatcggttgaggatctgaaaggaaatcaattgtacttaaaataaaactctttttaaaaatctcaaaatctgggccaggcgcagtggctcacgcctgtaatcctaatgctttgggaggccgaggcgggcggatcacgaggtcaagagttcaagaccagtctgactaacatggtgaaacatcgtctctactaaaaatacaaaaattagcagggcatggtggcacgcacctgtaatcccagctacccagcaggctgaggtaggagaatcgcttgaaccagggaggaggtggttacagtgagccaagatcgcgccactacactccagcatgggtgacagagtgagactacatctcaaaaaaaaaaaaaaaaaaaaaactcaaaatctttttattgagatagtcttttgcagctggtaggaaagaaggagtaattcaggtacttacttcttacagagttgttatcagaaatatgttaaattttgtcaattgaaagaatatttttaaatttgttaatattatcagggaaaatatctcccctgaataaagcactcaaatatgtaccacgtttttcagtagaactttggaggacaatttcttttataatttttagttataatttagaaaaaaaatgtgtttcattccaattgcttttagtttatttttgctttttttttttttttgagatggagtctagctctgtcacccaggctggattgcagtggtgccatctcaactcactgcaacctctgcctcctgggttccagtgattctcctgcctcagcctcctgagtagcggggactagaggcatgagccaccacactcagctaatttttgtatttttagtagagacggggtttcgccatgttggccaggttggtcttgaactcctgacctcaggtgatccaccagcctcggcctcccaaagagttgagattacaggcatgagccactgcacccagcctacttttgttactataattgagaaatgtaatcaatttaattgtagtcatatgaataaaaacatttttaaatttttcattaaatttttatttaagtaaataaaaatgactggagtaatccatagaatatcaaaaatatcgatggaataacaataagtaatatagagcaaaatggaataatgtgtgtgtacataacccataattcgacaaattccaattaagctttatgttttttacagtactcaatcttcagagatgcatttaaagaaaatgccatatagcaggattctcatgatatacagttcatttcctttattaatatgtgttagcataaagaacgatagctattaatatgtgttagcataaagaacgatagcataaagaacgatagtaattaaaattatggcaacttcaattttcttttcctaaattaaaaaaaaagaaaggaagatctttagacttgtatgaaaacttgtaacttagtctttttataatttgcttcaataatgtaagttcacatgaatataatattacattatataaactaatttcctttagatactttttaaatgtttagatattcacagaatgtatgtttataaaaatatatacttgaaaagttatttaagtataatgagttaaaatgatctaaatttaaaaatcatttttcttcaatattttaaatataggatgaacataaatctagttttataacctttcctaaaatcatcttcctgtattaatattttataaccactagaaaggcaaagataattaaaataaggcccacgatgatgccctccaggcttactgctaagaattagaaactagaaaaatgatgatcagatcccaagactgtataattcaccaagaatcctgccattggttattaggaaacaagtcactcagactgaaataggtgggcaaactacttgggttttcagaaataacatggtttagtaattacttcatccttacaacattatgtctttttttttttgaaattaaactgtctttatttgcaaatgacacgattatcagcacagataatcacgagaaatatataaaaagatttctagaactaataagttagttcagtaaggttgtaagcaataagataaacaaaggaaaatcaattgtatttgaatgtatcaacaataaacatatggacattaaaattaacaatacaatataatttatgttcattaaaaatataaaatgcttaggcataaatctaacaaaacccccacagtacttgtaggtgaaaacatatctgttttaccaaaccatcaaatgttcactccacacatactccacatcagttgaatgctaacctgatatatttcccattgtaaaatttctcccccagtttaagacacgttccagaaaagttcatgtcatttgagtagagttctgtcatagaaaatcaagagactttactcacaaaattaattaataaatataggtaatcagcaaaataataatagcaatagattgatttcattactagcaagaagtctttaaaaaaatttttttttggttctcaaaatgacaagtactttatgaattgggctagaataaaaagacatatctgaagatccaaaaggatcataatacacaaattattatttttaaaattatctgattagtctatataatatacctatcagaacattgggcaaaatataagtgtttaataaatgttaatctcccactacacttcccttgccaccccaacaacaaaagaaaatcaaatcaaataacattctttgggaagatttccataagttaatttgattattgttaacatatacagaatttgagggaatttgaaaattaattagacaattttaaatgagtttgcatttattttcttgaaactttaaagaggcattatttcaacacaattatgtcacccatggcttctttttgacattgtcctacagaactatacaaagttctactggtttatgtaacaaatatatatatatatatatatatatatatatatatatatatatatatatatatacttttcttggacaatataaaataaattcctgcatttaacagataaatactgtttcaacttaaatgaataactccttgactctaaaatcctggatacactttgcaaaaaaatgatgaaaaatatgagtaatacatgtcaaattttttctcaaaataagtttagttaagaatcttatccaaaaattcaaaaggattacttaaatttgctgaaacgatagtttttacacttggcatgcaagtaggaaattgcctaggactcaaaaaatgttgggaaataaaaactatattttcatttatgttatacttggaatcttcaaattatctatcctcttgtttgtctattatagagatttccaaggggccttcattcaccactactctagcaagtatttaagacacataccagaattatggtcctgcactgctgtttataaattattcttttataatttacaactaaaaacatggacttatggagcaagaaaaaccttgataaatgaaaatggtatctcagttttatataggaatttacagctcacaaagaactttcacaaatattaacttagttcagtcttcacagagctgagggaggtcaaatacacagaggcatatttcttggcttgaactgcaaatcttaaaagttaataagactatcataattactgaactgacacgtactactgtccttgtctggtctgcaaatcttacctcaaaaagatccaaatggatattttgtcagaaggaagagaagttgcataattcacctaaacatacaaagaaagctggcattcaaactgagaggttctgtgtctaccttccttaaggtatattatattaggaatgttagggtaaaatgaaacaatcagaaatccctccttatggaaatattacagcaaatgctgtaagaacgcagaaagaacacaaacctacttttgcttaattttatattaaaaaaatcatttcattaatacacggtgtatgtcaattgtcattactacttttttgtcagtgggtgaggaaagcacaaggtcaaaatagctatgacatgctgcatttggcttttgtcacagttaaggctctgggtcaattttgcgattctcttttgcttgtacataatactctccaaactactgcttcaagagttatgccacttcatctccaggtggatagtgtcagaatttaaaaaaaaaaagagttatgccacttatttcaaatctcacaaccatatgttttactgaaacaactgtagagtatgtgaattggtggcatggagagcacagatattatcaggagtgcagaagaaattccacggatgttatttaatgagatggaagcagaaaatgattaatgtacattatgcccaattcctgagatcagcacaaatcgcccattttgtagtgagtgcacctttgttacaaatctcccatgttataggcaccgtgagcacactttagttctcttaccaatccagctcaccctacatatcccgcacctaagaaatactacttgattccctgctgaagactcaatccctaaagtatctagtcaatcatatagaaactcaattgcttatttgcatgtgggccataaaagaagcataaatgttatctgtactcctcctaaatacacaagatatacaaaagcatttataagccaatatgtaaaataacccaaaactgtgattatttattagaacccacattcttacaagccccaaaaccttttcctgcctctttctgggaatccccaagagatttctcacatgtaatcacaaagccacttaacattaggttttcctgcccttcctttcttgctccatcttccaccagtccatgataaatgcccacaaagctagctagacaaagctaaccactgtcttcaccttcaccatcaccaccactaccaggtattctatctccagaggcttccaacacttccttgagtgtggaatgcagggatcggtatggcagaaagtgtttgggttgacatggagagttgggagaagttgcgacacttccattttacttgacagaactgatttattcattaggcacaggagtcacagcacctaggacctatgataattcagaggtccaagaaaatgttttaaatttaattcattttaaaattggaagaaaaatgaacataataatactaaataaataataataattgggattgtagatcctatttatataaatacagtcatacatatataattttaaattttgatgtattactttattttttaatgaaggaagtggtccacaaagacaaaggtgcctatggttaaaagtcataatttgtccctgccagtcaatcacttgagctcctgttcatgtctacaatttcgttcttgaaaagttctgtcagcttctgacaccagcccataagataggggcaaaccagaagcaaagggacaatcagagaacagatatacacctttcccttacatcatctttgctcttctgctgggccttctcttctcccatgaggaactgctatttttcacctcccattattaaataaaatatctttatttatgggaatggaggtccatgtatattggtacatgtagggagatgttatatgaatttgaattgtataagtaaaataatatgtgaaaaaataccaacatacaaaatctgaaatagcatatataaccaaacaagggaaaaatctcacttacaatatattagaaatttaatttatttttgttcatctctgtaatatcagatactgaaggacttttctcttcccgtcatatactgtggtatggatagcttccaaatatcacatcaacaggataaaggacaaaaaccatatgatcatctcaatagacacagaagaagcatttgataaaattgaacattccttcataaaaaaaaaaccaaaagctctcaataaattaggtatagaaggcccataacacaaggaacttcaacacaataatgtctatataggacaaacccacagctaacatcatactgaatgaagaaaagctaaacatgtttttttcaaagaactggaacaagacaaggatgcccactcttaccactcttattcaacgcagtactagatgtcctagccagagcaattaggcaagagaaaaaagtaaaaggcatccaaattggaaaagaggtcaaattgtccctgtttgctgatggcatacttttatacgcagaaaaacctaaagactctaccaaaaaaactcttagaactgaaaaataaatttaataaagttgcaggacacaatatcagcttacacaaatcagtagcatttacatatgcctggagtgaacagtctgaaaaagaaataaagcaaacaatgccatttacaacaggcacaccgctcccccgacaccccccccaacacaaatacctgaaacaaatttaacaaaggaagtaaaagatctttataaggaaaactataaaatactggttaaaaaaaattgaggaagacaccaagaagtggaaagacatcccatgttaatggtctggaagaatactgttacaatgaccacacacaaaagcaatatatagattcaatgcaattgctgtcaattactaatcaaagtaccaatgacattcttcacagaaatagaaaaaaaatcctaaaatttgcatggaaccacaaaagattctaaatagccaaaacaatcttgagcaaaagaaacaaagctgaaggcgttatactaccaatttcaaaatatactacaaagctataataaccaaaacagtatggtgctggcacatagacgaatggactagaatacagaaccctgaaattaattgacatttccacagccaactgatttttgacaaaggtgccaagaacattcctttgggaaaggacagtctgttcaataatgatgctaggaaaactagatatccatatgcagaacaatgaaactagacatctatctcttactctatataaaaattaattccaaacagattaaaggcttaaatgtaagatctggaattataaaactattagaagaaaacataggggaaatgcttcagaacactgggctgagaaaagattttatgaataagacttcaaaaacacaggcaacaaaagcaataataaacaaatgggattacattaaaccaaaaagcttgtgaacatcaaaagaagcaatcaagagactgaaaagacaatgcagaatggcagaaaatatttgcaaactattcatattacagggaattactatccagaaaatacaatgatctcaaacatctctagcacaaaaatatacaatctaattttttaaatgggctaatgatctgaatagacatttatcaaagaagacatataaatggccaaaaaatatttgaaaaaatgctcaacatcactaatcatcagggaaatgcaaatcagaaccacagtaagatatcatccggctgggcatggtggctcatgcctgtaatcccagcactttgggaggcctaggtgggtggatcacctgaggtcaggagttcaagaccagcctgaccaacatggtaaaaccccttctctactaaaaataaaaaaattagctgggtgtagtggcgggagcctataatcccagctactcgggagggctgaggcagaagaatcgcctaaaccctggaggtggaggttgcagtgagccaagatcatgccattgtactccagcttgggcaacaagaacgaaaatccatctcaaaaaaaaaaaaaaaaaaaagagacatcatctgaccccaattagaacagctattatgaaaaagccaaaatatgacaaatgctggtgaagattgcaagaaaggggaactcaaacattgttggtgggaatgtaaattaatatagccactacagagaaaagtatggaggttcctcaaaaaactacaaatgaaagtaccataggattcaacaatccctctactgatatttatccaaagggaaggaaatcagtacagtacagagatacttacactcgcatatttattgtagtactattcacaatagtcagaatatgaaatcaaccttagtatccattaagggatgacttgaaagataaaatgtagtatatatacacaatgaaatactatttggccataaaaaagtatgaaattctgtcatttgcaacaacatggataagcctggagggcattatgttaagcgaaataagcaaggagcaggaagttgaacatttcatgatctcatgcatttatggaagctaaaaaggttgatctcataaatgtaaagggtagaacagaggttaccagagcctggtgggggggtagttgagaaggagagaatagggcaagatttttgagagaatacaaaattacagataggagggataaattgtagtgttctatagcactgtaggatgactatagtttacaatatattatatattttctagtagctagtagacgggatattgaatgtttccaacacaatgaaataataaatgtttgagatagtagatatgctaattactatgatttgatcactacatattgtatgtatcaaaacattgctttggaacccataaataagtaaaattattataagtcacttaaaaagtttttaacaagattctcatgaaatgctttccactgagatctttctattcatgaccttgtaaacctgcttccagtgttctaccacagaacactgttcatagaaaatactaaaaatagcagtttctaaagcattatttggaagcttaatctttgataaaacaattatttctaggcctaaggaagaattggtgtttaatctctcccagacagaacaaaatgttttaaggcacttttgttgttagttgctgtatttgtcaggcaccatgctaatcaacttgcatacatatgttttttaatattcacagtctcatgcaagatggcaatatccttatcattttgtcctttcacagactaaagtgaagattagagatcttaagccactttccctatagtaagcaaccatcaagtcacgaagctacattttgaactcaggctgtccaaagtccattttacactaatttccaatacctttgggtatggttgctcacaaccaagtgcatgccttgctgaaagcatgactgaggctgaaatccaggctgtattactcttgctacgactcttaccctggtataggaactacatctacttcaagaaaggagcttttctctcctcctaatttacagagttattgtataggctagtggactttctgataggatggaggacttattgcaaaagggtctccactttgcctctgtgagtatggaaacttaaactacaagtttatccctaggactcaatcatatttgctatatcactatttgaaagtattgtcgactcaggaatttacaaagataaggattgactaaatctctagaataagaactacaagtactttgttaaatatttaactcaagaataataaatatactataagctgcatataaatgtatttagtcttgactaaagctatatctttccttaaaacctaatagttccggccaggcgcggtggctcacgcctgtaatcccagcacgttgggagtctgaggagggtggatcacctgaggtcagggattcaagaccagcctggccaacatggtgaaacctggtctctacaaaaacataaaaactggccaggcatgatggcgggcgcctgtaatcccagctactcaggaggttgaagtggaagaattgctcgaacccggggggtggaggctgcagtgagctaagatcatgccattgcactacagcctgggtgacagagcgagactgtctcaaaaaaaaaaaaaagttgaacttaatagttccaaaatatctaaaagccttgtattcatttaaaggaccattggttgagtgtgtgcgtggaggggaacagatggatgaactgatccagcgactcccaggctgaaagaactgaatgttcaatggtgtacttatagaccacattaacttcttggcaagtgctgctgctgcacatgtgggtggtccatcgctgaatatgaatgtgctgaatatcatttgggcaaggagcaagaggtgttcaagtgagttggagagaagcccagaaggtatgctgtttatcttctaggaacatttattttctgcaaaacatataacttgagttaataaagtagatttagatgtgaataaaggaaaccggttattgaacctgcatcactgtgcctctccaggaataactaaaagttttgaatttgaatcctagaacaagaaaaagaatagagcacaaataactgctcttatcaccttgcaaggaatcactggactggatctgactgcaaagcaggtatctatctgcctgcagttggatcccgaggctcctagtaactgtctttgtcatacattcttttaaaatagacaaagtcattagaatgataagagaaggagatttcttaagtaatgctcacttaagtaatgtgaaattataagactgtggttataacctctggtctgaatccttgacagaatttgtaacaagaaaacgtctattgactttctcaacttagagccctgtcacaaaatctctcttgataaaagatgccagatcaggctgtgggctatcatctgtggattctctctcctgaccactcttagtttcaggcatgcccttggaacacactctgcactgttctcatccattaatcattccttcagggtgaaggacagaggccaggtgcttaaacagacaccgggaggtttgagagatggctttgattccactgaactaaaaagttctgtgattccttcacagattggttttattaccattcaatttctaccggaaaatctaaatgtgctaagaggtaaataggcccttaagaatagcagtactaaacataggatattaatatacatagatgtgcttttctgtattcagttttctttgttctattcttctctggtgtcagtacatattagaaagtttcttttctctcagaggaaactgtttgaatttttagactgtttcttattatttacaaattagatctaatgcagactcaaaagtaatgtgagcaagctgtaagacacagttttgcaaccctacaccctagcttgttcgagactgatatctctgtctttccattattttacacagcagtgactgtctctgcttacaaaatggtaatactccaaacctgactgatatctttctgatttaacttttatatatgacttttgctaccaacaaattgggtctttctatatttttgatgtaacattcgctgtctcttaatgcaagaaatataagagagaaacattgatatggagaggggaaatactgtgcagaataaccattttagcttccccaactaaaataattttgaaggctagtggaggagaaaaaggaacaaatcattcttgaggaaaaattaattttgctaaattactttgcatatgttactacaatatgcattagaaaaattacatacattataacattacatggaacaaatgtcattcacattatgaaacacttcctattctgaagcctaccttagctagcagatgttttattcatttacaacacaatagtaccttattcagatataatttacatataataaacttcataaattttaaatgtgattattgatgggtttggaaaaatatatattgctatgtaatcaccaccataatcaagatatagattcccatctctgcagaaagttacctcctgccccttcgtaattagtcacctccacccttgacccaggcaaacaaaaatccacttttcattactaaagattagtttttcctattcaggaaattcatataaatgaaatcataaaatatgcactttctgtatttggttcttttcactcgacattgtttttgaaatccatccacttgcatgtatcagtagttctttccatttttaacactgagtaaaattccatttcgtgaatagatcacaagttgttcatctgttgatggatatttggattgtttctagtttgaggctattacaaatgaagctgatattaaagtttgtgcataagtctttgtgtatacatgtgctttcatttctgttgggtaaattaatttacttaatagtatgcttaaaatcttctaaaatattagtgttttttatctccatattctatcaatcacgaataaatgggtattaaaatcttgaactataattatggaatagtgtgttactccttgtagtattttttatttaggaattttaaggctctattaatagatgttcacataatttgaaccgttatgtcttccctataaattcctgttgtagtattattgtgttcctctttaactctcgtaattactctatcttgaagtctactttttctggtaatagtacagccatgccagcatttttatgtctgctgtttgaatgctatgtattcccccatttcctttcagtctttttgtgtctttgtatttgaagtgcgtttttggtagaaaacagtgtgtatcttgtagatagtgcatttttttttctcagtccagttctaccatttctgacagctaattggaatcttaaactcatttacatttactgtaattattaacatgactgagttaaagtctaccatcttgctctttgttttgtctcttcaatatttccttcatctgttacttggtgtattttgactaaattcaaaaaacttttgaaggatttttatatggcttaaagtatgcaacattcacttactgattctacttagagtcaatattgtaccagttaacatatcacattccatacttcatgattctctgaggtccctatttacttctcacttcccacatcacaaatgtaataaatttacaacagtataattcaaattaattccatcgcttgtgctattggcatgttttagctctaaatatgctgtgaaccctaaattacaatgttgttattttttcttcaaactggagattgattggcagacttatttgtaaagggtgagacagtaaatattcttggcttgagccatatggtcattgttgcaactactcacctctgtggctgtagcatgaaagcagctttagacaatacataaacaaatcaggaaaggtgtgttccaattaaacttcatttacaaaaaacagtttgctgacctcaggctgctatttgttgaccccatttatatagatgtttattagggaaattgaaagataaaagaaacttagtcttttatctttacccacttatttactatacctaatcctcttcatttatttttatagatcctggtcttcactgatagcctttcccttaagtataaagatcaccgtttagcatatttttgtactgcagtttcacagactaccaattctctggcttttttcagaatatatatatttatttgactctaatttttaaagtatattttcactagacataaaatataaattgacagtattttcaaaagatatttaaagatttaaagatgtcccactttcttctaagctgtattgtttctaatgagaaagtaattgtcatacatatcatcagaatatcatttttttttctggctgctttgaaaattttctctttatcattagttttccacaattggactatggtattcttacgtgtggttttcttgtatttttcttgccttgtgcaccatgatatgcttggatctgtgggtttgcttcgtaaatttgtggaaaatttcagccattttttctgccccattctcactctatttcagaacttcaagtgcacctgttttcaactattttatattgtgccccatgttcttaggtcccttctctttattcttcaatccctctattttttgatctatcaggttgtatcagctctttcaatttgttttcaattttaccagtcctcttgccttttccaatatactattaagcccacccatagaatttttctttcaattattgtgcagttttagttgttcaatttgcatctagttgttttttagggttttttgtatgctaaaatttcttactcatttgctcacaaaatctgcatttttctttaattatttgaacatattttcccataatactttgaaaatattcataatagctacctgaagctttttgctaaatccaacatctggcctaccttaaggttagtttttaataaactactattattctggaccaaaagtaacattttcctattttcttttcatgtcaggtaattttttattgtttaatgaacattatgaagaatatatgataaataactggactgtgctctctttcaccctgtaaagagtgccaagttttagtttagtagacagttcaattacctgctgtcccttttgaacctttgtttgccatttacgtttaatgtaaaaagtgatgaaatctgtggaaatccaaggatgttcctaaactcttctaacttggtgggactcaccgttaaaattccgcctccctctaaattttagcagagcttggtgttagtctttgttaaggagtacctagaataagtctttactctgacatggtttttgttcctctgatttaatccttttggagtctcatcaggatgtttagaatttaaggaggtataatctacctgatgagctgaaattctggcttcctttaagcattgctagaactctattatcaattttctactcacaaaaatcccatagagaagaaaatggtaaatcacctcatccttgtagagtctgatccttaggtaaggatccacactaactcctatgacccttcttctacagagttttttactatacagtattttgtcctgcagatagatgcttttgctgctttgagttttaatatatgtttcttaaacttagccagaaatccatgctcggcttggaatctaccttgctatgctcatatacagcaaattcccccaaatggagagctagaataatcatggggctcacttcatgggtttccctctcacaggaaatgcagccttgcactgtctgtttttattccttaaaattgtaacctcatgtagtttgtccaattttatggtcgtttgtagtagaaaggctggctccattagtattttccagataacttccaagattttagcaaagctacaacacaatattcaaaagattttaaggaagacatgagttgtataatgcatgtattttaaatacatggttaacaaatatggttaagtagatagtgttgcttaaattaaaaatcaaagaaaattagcacaaagaaaaaaacaaataatatgctataacacagataaactgagtcaaaaagtggacaaaaatctttaaaactctaaatgatgttttaatttaatctgaataaaaattaaggtatgagatctaaacttctaaatttcctttctcttcctatagcttcactcattgaataagtattcattagtagtgctctatatatgaggaattcctacagatattggaggggagattgtaggcagtgagctcaatatgatataactttattgcttgattttacagctgtaatgccaatttatatgataattattgaaacttggtgtattctcccttgtttactcacaaaacaatctattaatgtgcctgcaaaaaaaaaatgaccttttcaaaggtttctgtactttgaaatgaatgaatgcatttgcttgtgaactgatattgcacttgagttgtgttgccaatacagcagtaaatgaaaggctaacaagcaggaataagtgcttgttaagagaaatattaatggcctgaaatattcattcaataaatggactgatgtttgctcctatggaacatacattatgatgtggatgtagtcaacaaacagttacataatttctgggtttgacaatattctgaagacagtctctgagagatgacatatattaagacttgtagaaaaagaaagagctagtcataccaagaccagagaagaggattccaaaactagaattttctcttttacccctaagttcctccagccaccttacttacaccacaggcccagggaaaactgacagtacagtgaaacactgatttttcagtgtcaacaactccctaccatgactgacaggtcgtaggaaggatgccaggtccttccccttatatcctcataagacctgccccttatgtcatattggcattgactcaagtcttaatactgaatgattatgaataaaatattttaaacattacttgtttacaaaaaacagacttgattaggtttttactcattctttcttctttctcatattccattcttttccctcagatccatctctttcttgcttaattccaacaaacaagaattctttttaaaattatctttgtaagataaacttttagaataggaatattttcattgtgtcctcgcaattaattgtacatttatttgcatgcaaaattctttttcaattactttttctttaatattttgaagacataactccattatctctctgcatgtcaagttgcacaaagtttaatgtctatataattctaaatcctgtataaattatctgctttatctctataaataacttttcaaacatttttgtacttgatattttaaaattcatttaaatttatcagagcatgtaaattttccccccaacatattgttgctgtcactccatgagccacatcactcagaagtctagccaatatggtttggctgtgtccccacccaaatctcatcttgaattcccatgtgttgtgggagggatctggtgggaggtaactgaatcatgggggcaagtctttcccatgctctttccgtgagtctcatgagatcggatggttttaaaaaagaggagttcccctgcacaagctccctctctctctttgcctgctgccatccatgtaagacatgacttgctcctccttgccttccaccatgactgtgaggcttccccagctacggaactgtaagtccaatgaaacccttttcttttgtaaatttcttagtctcgagtgtgtctttattaggagtgtgaaaacagactaatacagtcgtcctttttactttctaatttaaaaaaaaaatctcagttattatttttttcatttaattttatttctgcatttggtcttttacttctttatgggtttcctgctaagcagatacttattattttgtccttcacacctcttaagactttacttacctttgtgtcctctactgggagagttcctctatgacatctttcaaactacttatgcctgccttgtgcctattctgcaatttagtctagtaatatagttatttatatcaactgttacatttttatacccattgtcataaatttcttttctgcaatgctcttttttcttcatcatgtttcttatatcctccctgctttctttgaggatgaaattttatgtatttaaaaatcttattttctgattattaatactcctacctaatgtggaatagattattccatttgtcttcttgctttcataattgttttgctcatgattttgcatattttattcctgtgagatccctaaatatcttgaccagtactgtctatgagagtaaggatgacctaggctcttgcttgtgttccttaggtaaagggaaggagtgcttcaggacggagagatctggttgcagtatcatttttaccattctctatcttctcttccctctactcttcagttttctccctccagttctctcagtttgaaatactctaggtccaggcactgctcttaccctaagttggcctgcctcttgggtgtggtctagcttgagggagtgtggatggagatgtgaggagaggaagaacagtagaaactctgagagccaaccaccctgttgccctcatttctatacactgtcccttccagctctgattctctctcaacgtttctcctaatatttcaagttagaattgctgcttttctgctccttggtaatgtcaggcaataagccacccagaataatatacagaggggaaaaagctcacctaaaatgcaaagctatctctcagacaagccacaaaatattgtcactggcctcattggttccagcctaatattcttaccacacttcttttccaaccaaagctcaattgtgcattgattacttactttatctctgacatcagtcatcctctccatctctgcctttttggaggggcattttcaatgttgtgttactcaggcagaaagtagcttacctatgggtatatctggaaatcttctcatcttatttttctatgatcatactgctttgtttttaaaacactttcaaactgattagcttatttgataatcctaaaattatgtgagccatgggaagcagatttatcatctcccattttacagatagaggaagcaaggccacaaagaattaaatggcttgcacagagctaatctgttagaagatgttaaaatcttccattcatgggagaactttctttacatactgaccaagaataaaacacagtcatacccacagtacatcatccagaagagttccatgtggactagaggagttcacgtaatttgctccatgctgtaatttgatactgtgatttcttttttattattttttaagatttttggggcatatgtgtagttttttacatggctatattgcataatgctgaggtttgggcttctagtgtacccatcatccaaatagcgagcattgaaatgcttaccaatgtgtaattgtttaaccctcacctccctttctcttctccaattttggaatccccagagtctattatttccatctttatgtccatgtgtatccattgtttaggtcccatttatagatgagaacactgagttttgattttctgtttctgagtgatttcacttagaataatggcttccagctccatccatgttgctacaaaggacatgatttcattaatttttatggctatatagtattcctcatatatataccacattttttaattaagtcacctattaattgatacttagttggattccatgactttgctattgtaaatagtgctgcaataaacataggagttgaggtgtcttttttatataattatttcttttcctttgggtagatactcagtagtgggatggcagggttgaatgctagtggcactttaaatagtagatttttgatagcaacattgctctgaatcttttattggagaaattaaatgattttataatgaagaaaatgagtaatgcaaataatttaaggagccatcaaactgctgtaaaaataatgaaaattttaattgaagtttttatttaagtatgatatgaaatataaattcctcattatatgtttactggagaaaaataactgtttaaaaaattatatgaatttaaattgaatattaaggtatatattttagtaataagtgatagcattaacttcattaagtgatacttacatttttattcctaatttttcagatttcgcatggattcccctatattttatctagattgattattcaaatattcctttatcatcactactaaaagagtcactgatatgtgtcaaaaagagtttgaactatgttattattggcttactggacctctgttagtttatctgtcaaaggagggtgataccatctcttctgcacatgtagtagggttgttggagatgataaggatatgtatggaatcacttcgtatattacagaaggctgtacatagaagtgatatcattttctgcttaaagttatttttcagtacagctgcaactcataagctggctaaaatactgggatccactagtccatctgttatcatcataaataaaattctaataaatttagcaaaattctggccttgagaaactttgatttgacattgaaatttcttgccttttagagttatcacaattttactggcaattatttttcattttcaaagtatgtttagactgctcttacttctgatagttattaatgatttttaacaatattatgttgcttgtttttagacattattaagaaagaagtatctagctgaatagcaataaataaataaataagtaaataaaaacattgccagagactaaaatatattttctatctggtcactgttaattcagtccaaatttaaaaaaaaaagataaaatactttattttgatgtggagtcaaatctgctttagtagttgtttcttcccatttattcttcaggaataagaaatgctatattcctttaacatcttgttttaggtgatattaaagtcctcagtcatttttaatttctttatatactgaacatggagaaactggtagttccaatatgtcaatatgaatattgtaatatgccaaaaggaaaatacaggatgtgaaatcctagctcaaatatttccaaactagaggtgagagtagcagttacaggcaaaattttgctttgtaaaaccctatttggcaggattaaggaaagggattaaactatgaaggatttatttagttaatatttcaatagatacagcagtttcattcttatgtaggctatgttcaaaaaggactcctagtggcaggaaatgctgtggcagaaagaccctaagatgactcccaatgattcctgtctcttgtttttcatatatttgtgtaattccttcagtgtcagggaaaaaccgtgacttctttctgattaacagaacctaaaaaatgttacagaatgtcacttctgtgatcgtattatgtacataagattccattttagcagactggagctagagattcttcttgtgggtttgaaataagtagtcacttttgagaagcccatgggacaaactattgcaggtagcttctaggacctgcaggcatattctagggtctcagggtagctccagcaaataaccagcaaataccagggcctctatcatacaacacaaagaaattaattcttcacataacttgaataagcttggaagggacttttccccagttgagcgtctagataagaacacagcccaaccaacagtctgactgcagccttgtgagacccagaacagaggatctagctaagccatgcttggaatcctgacacatagaaactgtgagacaataaatatgttatttaaagcttttgactttgtataatgtaattctttatgcagaaataataaccaacacagcaccatcaattttattatgtttagcattaaaatatcttgagtcaataattaaacctcatatcatctatcttttgaaattattctgagactaaatgtccgtggctctgaaaaagggatacaatagtaatggtgcatagtttacagagataaaaccatagttcaaggattttccttggcaatctcattttaatttcattgcagtattttcaataaaggaaacttaaatatataataaatgcaatttaatcttcttaaaataaaatctatacccacaacattaattgacggtgaagcaatacaataaagttattttcaatgaaatccaagcagaaaaaaaaagtgtctaaaattattgggaagtctcctcaaaaagaagaagcatgctttacttttggaggaaatgtggaattaatagctggagtttaagtagtcagggttataagatgtaccatttattgatggtggttgaggattaagatggaagaagcctgaattcccaaggactttgtggaacagaaccatcgtgttactttctgaaatgatacatcacttaacctgagtgaaataattttctagactgtttaaataatggttaagccatatttaaatcctggttatttggagtttatttacatgttcagagaaaagcatttacagcagtaatcattaatttgtgaatcataaaatattatcacagcctgcacctttctatttggctgaagaataatgattaacataaccctggtaaagtcatatacaaaagtcaccataactgtagcatagagatatacaaaaagctagtatttcagaataaagtaacatgtgaagaaaggcagagtcccacaaatgtgtgatgatttgggggaaggcagcatagtcaaatttgaattgaatttggaataactggtagaactgaaatagagattatgctatatattttattttaaatattaatgaatgctttgaagaattatgacaatgaagaatttgcatatcatcctataggcaatgaacagaatcaacctttctcacttaagataagctaggttttctaggaaaataaagcccaacaatatgaaaatttcagagatcagataaaaggaaactgcagtatcccagaagagaatataaggcttaagaagtgcaatagatataaaaccaaaattacttcaagatactatgcaaatgtaaaactggcaaagtttttcagagaaagtttttattgttctctttctgatgtttaatcttgtacctcacacttagtaagtagagagtaaatacttgttaaatacattcctgactgtaaaaaaaatcagttgagagtacatattggtggttttatactcaattataatttatggttatgcaataaaaaatctattatatatatacactgttaacttttgaaaaaaaaacaccacccctttagtatctttcatttaaaagaatcttaaaatgtctccattgataaaattcctaaatattttacaactctaagtatatataactgtgtacatgcactttctggaagttagaagggcattctacttttatctcctggattatatagggaacattgattaccattttattttcctcttattttctttgatctaaaaccatgtaataaatgcatatgcttagactattgcatttaagcaactagacaaaacaaaaaagctaaatataaaaactatgctttttttcacattattgtcttgcctgacttgtcaagaaatattagtctcccgatgcccataaacatttcagtaaaaacataatgtcagaaacaagtctgttaaagtaaagaaatatgaagaaagtgtagttagtgggaacataattagaatagcttagaactaacatcttgattgctaaatatttaggaatatcaattagaacaatttgaaagacatagataatttaaaactttataaataaatgctgcattttgctgcagattgcctgtatcttcacgttcaaaaaaagaataaaagtgcatcttcattaatctctggtgctgtcaaccgaatctaccagtagattctgtcatctggtttcctatataatcaagctgctggaaacatcttttctctgctatattgtgtaatgggcataacatttcaatgttgaagcatcccttggggttggtttaagccaatgtgtagcttaaacctacacagtctactgatgtaggtgacctgaaacctcgcaggttgattttcctcattgactgcttcttgcagttgtaagcttattccagttagccctttaggtggcaaaagcaaccccttctcacaactttgctgagttgtaagacacgtgcacccatgtctccagggtctagcttgcttagtgtgataaaactgaggacagttgacaaaactgttctattcatctcgtataatttttaacagcagggttctttgaaatagtgagttgtaaagtgtatttgttatctaagactgccacgacaaacagccacaaactgggtggcttaaacaaacaaacaaacaaaaactatcttctcacaagtctgaaggccaggagtctgaaaccaaggtcttggcaggaccctacttcctacttctgtagagactccaggggagaatatattccttggctcttccagcttcttgtggctccaggggttcttcagattgtggttgcattactgcacactcacattgcctcctcttctctctcaaaactccccctgcctctctcttataagaatacatgctattgcatttgaggcccacccagataattcaagataagttccttctctcaaaatccttaacttaattacatatgttgccatataagttaatatccacaggttccagggattagaacatagacttatctttttcagagggcactagctagcttcctaaaatatatatgatttattttcaacttaagccatccttttaccctctctgtattcacttttttctcatttaaaaattattttcagaaattttctttcactgaatcattaactcttttgttcatcctccatctatttaatcactctagatttactggttttcttttctagatcaagaaatgtgatgggacataatggggtataacatagaatgatattcagtcatgccatgaaaaaataagcccagatattttgaagtattgaagtatatgtttttccagagttaaatattgagacattttgaatctttgataaactgaaatgcatgctccagttaaatcctgtgctataatattacagaactattaaaatagaactatttatgtctacatattaatatataagtaatatagataatacttggaatttcaaatttacaaatgggcttattctaataaatcaatatgctaccttaacctttagaacttgtaaaaaatagcccatcatagaagatgaaaaatggcatctgggtttctactaaagctcatgaagctcacttaaacctcataaaactgctatgacttcaccattaaaatacgagtaaataaaatatatgcaaatgcaaagtattttttagtattatagttaattatctttaacatggataatatactacaagctaggctcatcacagtttccaaaatacctttgcttactttgttctttttcctagcaggaaactattttcacaccccttctgacatttaagtgaacacaacggtattctcttagccccttactctaacatacatcataaacatagaattttaaaagaagaaagaaaagaggaataatcttttaagatttcctgtgagctaatacaggtatagacgtcattgcattttagttcaattccgtacatttcggtgtataggtagatcaagtgtactttgggatgactatacaaaattcatggtaagtggaagagtaaaataattgaaaaaataaaatttaaaatgtttttggttgagtctcagaagtaaacagcattatcttgaaagatttgctttgtgcattaaaaatatatggatctttgtatacttctattccctgactctcttacgttagattcaaagtttcgagtcatgagaaattcataaggaatactaatcctgatatgttttagtaaatgaactaattggtgtttcaaagtttcatccagacatctgatatgctttcctagattagactagctaatattacatttcagaaagcaaaaatggcgaaaggcagttcataattagagagttccctcatgagttagaaattaccacttagaatttatgctattaataagttttaagtctggaacattttaatcatttttatgacttctttttagataacacataatgtccagtttcttttttttactaccatgaacatttcaactattacaactaactttacctatgacaaagaaaatgaggagtattttcttttaatgcattcctaatttgtcactcataaataatgtacagtatatagattataaaaataacgtaaataattacataagacataatacagagggaatgtttaaaacacaatgacataaagagtcaatacttctccctaatttactatctgtcagatacaactctactgctttttcttggaatatttgtaaacatatggccagtcaaagacaaaattgaaagtcaccatatattgccaggtagtaaataaatacatatataaataagcaaataaacaaaagaaaaaaaattctggtaataagaaaaccagagcaattatctattcacatgagatttgaatagaaaaaaaaaaatgtttgcaacttgatctaattaaagccagccaacactacagtatgtcttattattattgaaacactcaaaataactgatatggtttggctctgtgtcctcacctaaatctcatgtggaattgtaatccccacttctcaggggagggctctagtgggaggtaattggatcatgggggtggatttcccccttgctgttctcgtgatggtgagtcagttcccatgagatctgatagtttaaaagtgtgtgacacttcccccttcactctctctctctttgctgccaccatgtgaagtaggtccttgcttcccctttgccttttgccatgactgtaagtttcctgaggcttcccagtcatgcttcctgtttagcttgtagaactgagtcagttaaacctcttttcttcataaattacccagtctcaggtagttctttatagcactgtgagaattgactaatataataaccaatttcctcctcactaactctactagaattcagataaccttctatgtaattttgtaggcctgtgcattcttttaactattaaaataaatttgacttaaaaataaatttgtagaaactctaacttgaggagtcaagctgttctatgctccattgatttacaaatgttttcattcttatattgacataggtctaagatctcttggtctaataaaacaaaatgtataaaaagaaaatatctggaatcctacctgtaacaagaaagctgcatctcccagctccagcttcatttatgatgctacagttataaaccccatagttttcattggaaagactcttcacagcgtactctgtgtattcctgagagtcaaattgacccgtccgtaataatttattgcccaagcgccactcataggtcagcacccgtattggataggctctcagtactctgcaactcatagtgacacttcgatcctgtccttgccggatttccaagaatgctggttccactgcagggggatctgtagaaaagatatgtaaaaacagatgaaagatgtgacttgcaataagccaaaagctactcttattagaagaagccatttgcagtaacacatgcagcaatagaggaggagtgtaggaggtgaatgaagaacatatttaagcccagaaattttagcttgggttgggaaatgtgatttcctgagggtaggaagtaaatgagcctccttgctttacaaatgcatttgcaggtgaaactactagagctgactgatccttcgtacctctttcagcaaatatttttaaactttcctattaattctaatattatcaatatattccttttttgtttgtttggggtcctttgtctaaaagtggtaagaattctttttttattatgcaatgaaaagattcctttcttcatttacttcatggtctgatactgaaggcagctatttaaaaagctaatttacaaaactgtatgaaaaataattctacagtgctaagtaaataagaagtgaatgacactatgagagttgaccaggcaagtatgctacaaaaataatgctcagctgtgtcttccagaatgtataggagatggtcaggtgagtaagcagtaagagaaggcattccaggtagaggaatgggtacatacaaaggtacaaaatctgaagaggaagggatgttcagagaaatgcagatggattagcatagctgatgcacaaaagaagaccataagcgcttggggggaaataaagatgaaaagaaagagactctattcaaggaatgcattttcttggtattgaggaggtcttctaaaatttttaaataaaggatttatatgatcaaataatttttttctttggaaaaacactgtggtagacaggaaaagcataaaccacagagggaagagacaagttgcaaaaaaattaaatcactggtgaaagcctgaactaaggtgaggtcagtgggaccaaaaatgatgccttaggcaatgaagtggataacagtgtcagtcatgaagacagtgaggaaaaggagaggtagattggtgtgtgttgaatgtgtccatttcatgcacctgtcaattacatccagaagcagtgtttcttcatttccaaacatatgggtaatgttttattttctctttgcttttgattttttgcttaactgaattgtagtcagataaaatagtccacatgttttcaatcctctgaatttgttaacacttgctgtatgacacaatatataatagatttctgttctgggtgtgcccactaagaaggaatagtctgcacttttgaagtgtgattgatatgtatctattgggccaactctaatatcgaggagttgtccaaatcatctatatggttgtttattcatttattttttgcctacttattccagttgaattaattcataagagtatgttaaactcctctaaaaaaagttaaaagttttagatatctaatttaaaaaattctccttgtagttctgcctcctttttgctttacctgttttgaggttatgctattaagtatatatgaatttagaattgttttatgttgtccatgagttgaatattgaatatttatcactataatctcttttatctccagcaatgctatatatgtgtgtgtgtgtgtgtgtgtgtgtgtgtgtgtgtgtgtgtgtgtgtgtgtggatacatacatatatatatatagtctaacattatcatggctacattggcatttattatgttagtatttgcatgtgatatttttccatccttttaatcttatacttttaatatctttataagtatttttattcttatactttcagtatctttaaattttacaagcacctcttttaaacatcatgagcttatgctttattttttaggattttttttaagtctgtcaatctttttttaacccagagcacttagcactttattcattgacatttactgtaactacttattttgtacttttattttattacatttttgtattaaatttactgtaacattattttgtactatttgttttctgctactctttattgccttcttttagatggatggattacattatcattctgatctttttgccactactacttgaagatttatttactctgtttctactactccgattgtctcaaagcttgcaacatgcatacttaagttatccaaaaacatcaatcaatacccttattatactactgaagaacacaataatctaaggataatttgttccttttattctcattctaacgtgttactgtgtcatgaatttcaatcctctttttttaataaaaagtctgttgtacatagttgggcgtggtggctcacacctgtaatctcagcactttgggaggctgaggagggcggatcacgaggtcaggacttcgagaccagcctgggcaacatagtgaaaccccgtctctaccaaaaatacaaaaattagccgggcatgtggcgtgtggctgtagccccagctacttgggaggctgaggcaggggaatcgcttgaacccaggaggcagaggttgtggtgagccgagattgcaccgctgcactccagcctgggaaacagagctggactctgcctcaaaaaaaaaattatattgtacattatagtataatatggtatacctatagtattttttaaaatgtccagatatttgctagcttatttgcccttcattccttctttcattgtagactttccatctgtgatgactttccttgtgtctgaagttatcatttagatctatcatatctttagtgaactttttgatcatgattttctaaaaaatatattttagtttgtgggctgggaaaccaagagctcttaatgctatacccaaagactgaagttctttataggacaccatacacacgaaatagtgctatgttttcctaaggagatccaagacttagccactcgtaagcaggcaataatccatgattagtgatgtggggaagtaaataaaggtctcaaagtatatgtatgtctgtatgtatgtgtgtgtatacatttttatgttatatatatacacacacatatacatacatatgtgtatatatacacatatatgtacatgaaatataattttcattttatatgtatatgtgtatatgcacacatatgtagaatttgtgtacatattatacatatatagaattatacatatgtatacacatatacatatgtgtacatataagttaaaatacatatatattttaatattttatatatacacatgttttatatatacatatatgtatatatatttaatgttttatatatacatatatgtgtatgcgtatatatatatacacacacacacacacacacataaaacattaaaaggtattttccttgtaggttggcaggctttgttctttcagcgcatcattatataattccactgtcttcagatggccattgttggtgtaaagaggtcaactcaaagtctcacactttgacgtgaatgtcttttttttcctccagccactttcgaaatacctttgtcattgctgttctgcagtttcaatatacggttcctagtgatgagtttctttttacttatgggtttgaaatttgttgggcttcttagatctgttaagtttggtgtctttcatctgaggtaattttggaaaattctcatcattagctgtttaaataacacctctatttccttctttatagcctcattagatgatcctgttcattctgcttttgatgtcttttaaccccttttcaaattttgcacttgttggtttttctgtactgcattatgaataaattcgtctgagctaattcagttcttaattctttctccaatcctacttaatctgcaaaatatatattgtgtattaattccaataacgtatacttcatttattctttttctgtatagttattttgtatacctgcacaccacttttttgtatgtttccactacctgaaaaagtagttaagcttatcttccatttctttaaacaaagtaattgttttatactgcctgataattttttttttttttgagatggagtctcactctgtcacccaggctggagtgcagtggcgcaatctcagctcactgcaacctccacctctcaggttcacgccattctcctgcctcagcctcccgagtagctgggactacaggcacctgccaccacacctggctaattttttgtatttttagtagagacggggtttcaccatgttagccaagatggtctcgatctcctgacctcgtgatccacctgccttggcctcccaaagcactgggattacaggcgtgagccaccgcaccgggccactgcctgataatttcaattgaagttttgaggaagtttttctgttggttttctttcaaagtactgtcttcctgtgtgttcttgattaattttgatcaatttgattctatgctatttgttgccctttaaaaatatttataggatatgctgatgactaaaatgatggtttctttctccagagaaaatttgtgtccacgggcaactatagacatcactgtctaggatcacatttaagtgcatgacttgaggctgatttgaattatcaagtgacttgaatttgagttaaaaatccatataaaggtcaacttgtaactataatttcaagaatggataaccacatcatcccatcctgttcatttcaaagtcacacatttcctgcactcccttgggagtgggaatgtgtagattgggtttacttctgctttactcctaccctacagatataatcctttgagatccaacttcttgggagacagttctaccaacagatccctcccctagtgaatattctgggtttgaagttctgcaccccttgcccaaagatgccatcagaattgaagctcaaatttgtccatattcagcaaataccctcaaggcaaatgtaacttcattgtacttctttcattaaatttgacaaagtatttttcaaataaacattttaaatgtttttaatattaattttacaatattgtccagattttagttgtttacattggagagattttacataatattttgtctattacatgcctagaaacatgtatctgattgtcaagggaaaaaatggatcttaaactcagaagaaagggctgactgaaggttacagttattaagatagctcagagtgagtatagacaaaaataagtaaaatgccaaatatgaactttactcttgaatataatcacttatggggttagagaaaaataaaagcttttaaaggagaataatcataaacaatcagtgagatgtggggatctagagtgttgtgttacaaaaattaaaggagctgcatgttttagagaacaagagtggtcaaaagtaccaaatgctatcaaaaaacaagttaagactgaagatatgtaaaatatatattttttctttgacaagtttagtaccattaaggaatatagtgaagcattttttctgtgtattatatataatttgggtttggggtatgtgaattgatggttaaactgtagaaataatgagtgataactgttcaagaacactgtccatgattttaaaagataattatttatgatgattctaccttaaaatatattaggagcttatacatttgtcactatatccactaccactactattatttctcacatggactacaacaaattccctgcagtatacctgtaataggtcaatgtacttcttttgttctctcattcttctgagatttgtcaaatgcgtgtttaacagaaaaatcagctcatgttactttcctgttcgaaaaactttatggactcacccttgtttgctattcaggacttcaaggtcctgcaagttctggctctggccatattctcaactattcttgtcttgatgactatgtcccaaacacataagttttcttcttgtttctacatgacaagtcttttgtagactttagacctctaatttgttctttctgcctgagatgttctttcctttggtctttcaatagctggctcattctcatcattcagattttacctctttaggaagcccatctttgatgacaagttagtaaagtaacttctcccttggttaatttttatttatcattgcatatattttctgcatatgttcactctttgttcatatcttgtttatgtaagctccattacaaagggacctaaaattctccaatcattgttgcatcctatgtgtctattacagtatctgtcattataattggtgatatatcattattcattaaataaatgaatacttgagtggtgttaaaagagtaaagatgtacacattctcttcaaaattcctcccatcaagacctggagtttatgttcatttcattaagtctggatgggctctgtgattattttcactattagaacacagagcagaagtgatgctgtgccaatttctgggaccaggacacaagtgtctggcagttccacttcctatcttttgaagcacccactctggaagtgctgaaccccatgtaaaacttcaacctctcctctgcaaaaaccatgtgaagaggcccagagacaatatggagaaggagagggcagagtttagcttagacttccacttgtcccttccaaggttccagacacaagaaaccatcttggacattagagaccagatcagctatccactgttagaattactatgattagatataataaaatgtggttcttttaagctctgaagtattggagtagtttgttacatagcaagaaataactgaaacagatgccttctatccttcaaaagtcaagagtctgacactatgagtggagtcaaaaggacaaggaggcaaaacattaaggcatagtttaagggacagtctaagctggttcaggaaggaaagaattcagaaggaaactcataggggaagacagccaacagactgatttgctagaacaacttgaaaacttgaaaagcaaatacattgaggacaaaggtatccgggagccagaacgtttcagttaatgaacagcatattgttgcaatttaatagctcacaggtagagaagtttggaatgattacaaaatcaaagatatgaccgttggaatgtaatactgaagtggagattaatgatactacagtcaaatactaataagttaagtgaatacagtctttgctgtcaagttatatttgtatttgcctagcaaagttaacgtgtttgtagctattttttttcttcttacaaaaggagaaatttccttttaagtggaagaggttgtcagtgtaattcattatacctaatgggaaaatatccccaaatatatatttacttttttttttttttttttttttgagacagagtctcgctctgtcgtccaggctggagtgcagtggcacgatctcggctcactgcaagctccgcctcccgggttcacgccattctcctgcctcagcctcccgagcagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggcctatatttacttttttatagatgatttttgtgagaattctttgaaagtatccgacttaatgaattattaccagcaatgggggtttttctagactctctctatatatgaatgtcatttgcccacacctgaaagattcagcccattcaattttcaatggcctgtaaggaagaatgataatgttgggttaaaattcttcaaacatagtctattttcataaagtttaatagagtctgagttgcaaagcatccctaaattaaaggctatttaaaaggccttttatttaaaagactgcccacactactttgattccagggtggtttcttcaccgcaaaaaagctaaataatattaaaccaagcgcactcattatagtgcactcaagtctgtcaatggaaaatttctcctgatagatggttcattttaagcatactagctattaatagttggacatttcattctttggaatatccggtgagaaggataggcctttgcagttatgatgaaatgtatagtgtgaaaatttcgaatatgatgaaagaaatcttcaggtgttaaaaaaaagttagagctcactattgtgatagaatcagttttttatggcataaaatttattcagaatgtttttatgaagtattcaacatgaaggaaatgaaatatataggaatattatgagaaaaatctacttagcatattctgaaatgcttaaaagtaggatttcttaagaaaagtaggtgcctgtgttttgttcaattaaaatatatgactcttatattattatattatacaagttttttcacttatactaagatagttggttaaaaagtctatttatgaaactaccacactacatgtatactgaaggatgattataaaaataaagattatatttcttgacactgaatatttactaaatgctagatactgtgttaagatattcacacagattatctttttataacaataacccatttatagaagaaaaagaaaagacgaacagaaaaattaagcaagtcacccagctaaaaagtagcagactaaggaatcaaacaaggcaatctgatttcagaatgcatgctcttaaaaacagcctatgtcacattatttccaattgcagatactaccagtggttcatgaattagctctctccctaaaagaggacttcgaaaatcttgccttactggttatttaaagttatcaattaaaatagaggttgacctactcacaccatcatttaaaattcacagccttgcaaaggcaatgaagaaaagtcatgctttgtggaaagcatcaaagtattacaacaaaactactaatttaaagaaaaatgttacagaattttgaatcaaattcaaactgcagtttatatggcaatgtacttcatgtaaattaattttggtattacccatatattataatctatacaagtgtttgtagaatattaaatgtctgaaggtaaaagtgtaacctttcaaagtaattaaggattttagttgtaataaagtcattaagtaacaagtgcccaagattaatgattttagcattttctttttgtatctactggctcaagatgtccagcaaggtttctaaatacttagttctaatatttaaatccatatagagatatctaccttatttgggaagaataatgcatgaaaataccagattataggaaaatgtttatttgtgtgtatttcttaataaggggatgagagagtaagtagttcatgcatttttttgacagcatgaataaaattttgcatttatttcttgaaaaaaaatgacagtttcaatgagtaccagaactgtaagcaaagcaatttttttaattttaaaaacaataaaagatgtttaaataaataatagaaccttcaaatgaatattaaaaaatattaatataacctgtttttaaatatttaagggagtgtgagacaatggacgttaaatatgcatgggctgtcttcaatcacgtacagttgaaagaggagttgaaacagtcctgtctatttggaggacttcgtataagtacaatcttaattatttaaccattggaggagcactgagaaatatgtactcattagagtgatttcctctcgagccacatcttcccaagtcaaaagcatgcccaaccaaatacttgttgtctggttctttgttgggattaaagtcatttaaggaaaattgtgctcataattatttataaatgcaatatttataaaagaaaatctaggagttagagtattaggtcagggaattaaattcttccattgcccattaagaagagttgaattgctacaattaatatatgacaacctctctctccatgaacacatagaagtgttggcagggtggtgtgcctgaagacagcatggaagatctatacttcaccttcatcaatccttacccactgcatcttttctatttggctgttcctgagttgtattcactacagttgtccccccttatccatgcaagatacattccaagatccccagcaaatgacagaacttgcagatagtactgaacactatatttactgtttttttcttatacatgcatacatacctatgataaattttcatttattaattaagcacagtaagagatggacagcaataactaataataaaagaatgattataataatatacagtaataaaagtgatgtaaatatagtccctcctcttctctcttaaaatactataataaggaaagaagctgcagatgccgggaaagagtgagtgactgacccccagggcttcacaaccccaccaatgacttcaataatccgaagcatgagaaaaccgcttgactctctgggggcctccagactaacacagaaagctgcctagatattatgtagaggaattgctccagaactgtgacctgccctggggctaacaccatctctggtgcagctggccaaggtggagggcaggaggctgggcactttcacacaccctgaagacaaatctccctgatgctgatgctgcaggctattatgggaccaagacaaggggagatcacctgttccacaggtgcctgcctaagctgctcccactgacagtggttccaccctctccagagacaggcttacagtgcagcaggccaaaatccctgaaggtagatgcaaaaatcccaaaaaaatataaccacatagaattcagcagcacatcaacatagtactggatgtccgaggcagagcaattaggcaagaaaaagaaataaaaagcatctacattaaaaaaatgaagtcaaagtgtccctctttgctgatgacatgatcttacatctagaaaaatataaagacttcatttaaaaaattcctagatttgggccgggcacagtgactcacacctgtaatcccggcactttgggaagccaaggtgggtggatcacaaagtcaggagttcaagaccagcttggccaacatggtgaaaccccatctctactaaaaatacaaaaaaaaaattagttgggtatggtggtgtgtgcctgtagtcccagctacttgggaggctgagacaagagaattgcttaaacctgggaggcagaggttgcagtgagctgagatcgtgccactgcactccagcctaggaaacagagcaagactctgtctaaaaaaaaaaaaaaaacaaatcctagatttgataaataaattcagtaacgttgcaggatacaaaatcaaaacaaaaaaatcagtagtgtttctatataccaataatgaactagctgagaaaaaatcaagaaaacaatcccacttgcaatagctagaaaaaatataggaataaattgtccttggaatagtttgctgagaatgatggtttccagtttcatccatgtccctacaaaggacatgaactcattattttttatggctgcatggtattccatggtgtatatgtgccacattttcttaatccagtctatcattgttggacatttgggttggttccaagtctttgctattgtgactattgccgcaataaacatgcatgtgcatgtgtctttatagcagcatgatttatattcctttggctatatacccagtaatgggatggctgggtcaaatggtatttccagttctagatcccagaggaatcgccacactgacttccacaagggttgaactagtttacagtcccaccaacagtgtaaaagtgttcctatttctccacatcctctccagcacctgttgtttcttgactttttaatgatcaccatgctaactggtgtgagatgatatctcattgtggttttgatttgcatttctctgatggccagtgatgatgagcattgtttcatgtgtctgttggctgcataaatgtcttcttttgagaagtgtctgttcatatccttcacccacttgttgatggggttgtttgtttttttcttgtaaatttgtttgagttcattgtagattctggatattagccctttgtcagataagtagatcgcaaaaattttctcccattctgtaggttgcctgttcactctgatggtagggaattgaacaaggagaacacttggacacaggaaggggaacatcacacaccggggcccgttgtggggtagggggaagggggagggatagcattaggagatatacctaatgtaaatgatgagttaatgggtgcagcacaccaacatggcacatgtatacctatgttaaaaacctgcacgttgtgcacatgtaccttagaacttaaagtattccatatatatatatatatatatatatatatatatatatatatatatggaataaatttaacaaaggaagtaaaagatctctgcaagggcaactacagaactgatgaaataaattaaagaggacacaaacaattggaaagacattccattttcatgaataagaagaattgatgtcattaaaatgattctactgcccaaagcaatctatagattcaaagcagtccttacaaaaatgtcaatatcatttttcacagaattagaaaaaaacaatcctggaatttgtatgaaaccaaaaaagagccagaatagccaaagcaatcctaagcaaaaagaaagttaaaggcatcatattacctaacttcaaaatataatataatacaaggccatggtaacaataacagtatagcagtcgtataaaaacagacttagatcaatggaatggagtaatgagtccagacataaatccacatattttcagccaactgacaatttgtatagtgccaagaacatacaatggggaaaagatactatcttcaataaatggtgctgggaaaactgaatacccatatgcagaagaagaaaactggatgcctatctctacccatgtacaaacccaagatggaataaagacttatatgtaaaatttaaaactataaagccaactagaaaacaacataggggaaacactttaagacatcagtctaggcaaagagttaatggctaagacattgaaatcaccggctactataacaaaaatagacaaatgggactatattaaatttaaaagcatctgcacagcaagggaaacaacagaatgaactgacaacctgctgaatgggataaaatattttcaaactattaatctgacaaaggataatatctagaatatacaaagaacccaaataactcaataattttttaaaaatctcattaaaagtggcctaaagacataaatagatatttctcaaaagaagacataaaaaatggccaacaggtatctgaaaaactgctcaacatcactaatcattaggaaaatgcaaatcaaaaccacaattaccttaccaattaccttaccccagttagaatggctattactaaaaagacaaaaaacaaaacaaaacaaaaacacaaaaaaacagatactggtgaggatgcagagaaaagacaattcatacactgctagtgggcaagtaaattagtatacccactacagaaatcattatgacaattactcaaaaaaaataaaaatagaactatcacaatctaccaattccactggatatttatccaaaggaaaagaaatgtatatatcaaagggatacgtacctgaatttgcacatttatcacagcatgattcacaatagcaaagatatagaatcaacctatgtgtccaccaatggatgaatgggtaaagtagcatatgtacacaatggagtaatattcagcaattaaaatgaatgaaatcatgtcatgcagtagcatggatgaaactggaggacattatcttaagtgagataagacagtcacagaaagacaaataccacatattctctttcatatgtgagagattaaaaaattagatcttatggagatagagtatagatagatatcagaggcttggaaggtgtatgggtgggaggaggggataaagatatgttgattagtgggtacaaatatacagttagatagaagacataaaccccaatacttgatagcagattagagagagtatagttagcaacaatgtattatataataaaaatagctaaaagacaggtatatagttaaagaggtaaacagttaaaaaatagctaaaaatagctaaaagagctatgtatagaaatgataaatattcagggtaatggatagcccagataccctgacttgatcattccaccttctatgcatgtaacacatcctcacatgtacctcataaatatgtaaaatatattgttatcagtacaattgttttaaatcctgtagtatttttggaacactgttgactttgggttgttgaaacaatggaaagtaaaacctactgtataataaacctgtaaatgtaattaaaatgttttcttgtgttccatgagttcatctagtcaactatcaaacctgaggtggcaggggttatcatgggaacctcagaatctatagctggtaggttagaagtatggatggcaaacagggatttgtaactggcatttgaaatggggccaatctagtggggctgagtcctttaacttgtaggatgtatgctaactcaggatatttactgtgagaattaaactgaattgttgaatacccagttagtgctggagaattggagaattgatgtggaaaacacaccaggtatttggtgtcagaaagaacaaaagaactgccaatcaagtttttaaataaatccaatttattcagtagagaactatatggaaatcatctacttgagaaaagatattgagccatttgtaggatctgtctgaatgtatatagaagaaaaaaggattgagatggccaacattttttaggttaactcagtatataattgtgctagcacatttcatatacttattacttcatttaatatttataacaaatgtgtaaagtattatcactatctcctttttatagataaggaaattaaatctgagaagttacattttcaagcaacccacacattccagataacaggtttagatccaaatccaaatcacatgacatcaaagtccaaagctacacaactcctacaaactaacatagaaaaaaagctagatgaccttgggcttggtgatagctttttagatacaacaccaatggcataattattgaaagaagtaacttttaagcgggactctattgaaattattttttcattgttctgcaaagacacagtcaagaaaatgaaaagaaaaactacagactgggagaaaatatttgccaagacatactaataaatgattgttactgaaaacatacaaaaactctaaaaactcaataataagaaaataaatgacctgatttttaaaatgggccaaagaccttaacagacacctcaccaaagaagacagatggaaattatgtttatgaggagatgctgtgcatgatgtcatcaaggaaatgcaaattaaaacaataaaataccatgatacggctactagaatgcccaaaatctggaagactgacaccactaaatgctggcaaggatgtagagcaatgtgaattttcattcgttgctggtggaaatgcaaaatggcacagccactttggaaaatattttggcagtttcttacaaaagtatacatattcttaccatgtgatccagcaatcatagaccttagtatttactcaaaggagttgaaaacttatgtttacaaaaaacaaccaacatgacagtgcagttaagttcagctggtaatttttttgaggaagactttttcaataaaggaagtagtgcatcaacttacattttaatacaaacaacataatcctattgtgcagcttatacataaagcttgcagatcagcccctttgagaaacactgacctggactccatgccttaatcaaataattggtcaatgtttaacagacaatgcaggaaggtctgtatggaaggcaaaactgtcatgacaggacccagcctgctttgaaataaaaaaaatgaatggagatttagaatatatgcatttaaaaatgtaggtatcagtgaaacgtaggcagctttttctaaaaggcaaaagaatgtttcagctaaagacgtttcaggtacaatgaaacaaaccccaatctaatggcatccaaattgtaaagaacaaactaaaattacctctgtttgcagatgatagaaaaccatgcagaaaaccctgaagattccatgttaaatagctgttataacaaataaatgaaatcagaaaagtaaaaaagcaacaaaatcaacatactaaatcagttgcatttcttcctttttaaattattgttatttttttttttttggagatacagttttattcatgattacagctcactgcagcctctgactcctggacttaagtgatcctcctgcctcagcctcccaaaacgctggaatgacaggcataagccaccacacccagctaatcagctgcatttctatacactaacaataaacattttgaaaaagaaattacaaaaaaaatccatttataatagtatcaaaagtagtaaaatatgtaagaattcatttaaatacttaggagttaatttaaccaaggaattaaaggacatgtgcaatggaaactacagaacatttctgaaagaaacaagacataaataaatgaaaatacatcacatattcattaattggaagacctaatattgttaatacgtcaaaactacccaaagacgtatgcagattcaacgcaatccctatcaaaatcccaatggcattttttttggcagaaatagaaaaacccattctaaaattcatatgaatctcaagagaccctgaatagccacaacaaatcttgaaaaacaaaacaaagctggaagactcgcacttcttgatttcaaaagtcactacagagctccagcaatcaaaacagcgtggtactggcataaaaatagacatatagatcaatcaaacagaatggagaacccagaagtaccccttgcatatatggtaaaattattttgtacaaaagaggcaaggtcattcaatggggaatagatagtcttttcaacaaatggtgttgtgaaaactggatattcacatgcaaaagaattaagttagatcactatgtacagaaattaatttaaaatgggtcaaaggcctaaatgtaagattcaaaaatataaaactcttagaagaaaacatgggacaaaaacttcatgacatggaatttggcagtaattttttgggtatgacactaaaggcatggatgacaacagaaaacaaatggaattcgtattttttttcaagttgtgcattaaagtagcaacagagtaaaaatgtaacccacagaatgaaagaaaatatttgcaactcagatttatgataagcaattagtatggagaatggataaaaactcctaaaactcaacaaaaaagcaatagctcaattcaaaaatgggcaaagaacttgaacagatatttctccagtgatactcaaatggccaataagcacataaagatgctcaacatcactagtcattagaaaaatgctaattaaaactacaatgagatgccatttaatatccattagaagagctactactttttaaaaaaagaaaataacaaatgttggtgagaatgtagagaaattagaacccttaagcactgttggagggaatgcaaaatggtacagccactgtggaaaacagtatagttgtttctcacaattttaaaaaacgaattactacatgatccagggattctacttctaagtgtatatctaattgcaagcagagtctcaaagatatatttgtacagccaggttcatatcggcattattcacaacacctaaaagatgggatcaaagcaagtattcatcaacagatgaatggataagcaaaatgaggtctatgcatacaatagaatatcaatcagcttttaaggggaatgaaattctgacatatgctacaacatggatgaactttgaggacattatgctaggtgacataaactagtaacaaaaagacaaatactttatgatttcactcacatagagtacttagagaagttaaacttttagagacaaaaataaaatagtggttgccagaggctgggggaggagatatcttagtacgtttgagttactattaaaaaataccataaattgagtggcttataaatatttatttctcagagttctaaaggcagggaagttcaagatcaggaaaccagcagattcagtgtctgaggggggccagtttcctggttcagacataaggcttcttgctatgtcctcgcatgtggaaggagcaagacaacaatcttgaacctcttttatacaggcactaatccgattctttacagctctgacctcatgacctaaccacctcccaaaaggatcaaccttctaatacctaaccacgttggtggtttattttcagagaaaatggtgatttattttcagagaaaatggtggaataattttcagagaaaatggagagttattgtttaatatattgagagtttcagttctacaagatgaaaagtgttatgaagatggatgacagtgttggatacacaacattaggaatgtattaattccactaaaccatatgcttaaaaatatttgagatggcaaattttatattatgtgtattttaccacaataacaaaaatgaagtcagtggcttaaaacaaacaaaaaacaaaaacacagtggcttagaacaaaacaaaaaagaacaaaacagaacatcaatgaaccactgttacagaaattgaaccaacattactgtaaagtttaaaaaatagaactgaaaaaggacagagacatcattctttacctctagaacaaatgatactatttgatgtgacttcatacttgtgaatcaggaaataagaaaacagcttggttagagctgttttttctaacagttagttagacattcaggcagaaatttgcttttattttacattatctagcatgcataaaaaccaatctatgaataattctttgaaaatataaaaaggttgatcccaaaatgaagctatcatatccgttattggtacatataacgttattaatttgatattgaattgagtttgctgtcttcattgttttatttaatgactgtcaagatcgttcattcgttcagacacttcttcagttatttaacatactttttttctcatatttttctaaaagtaattcttctagaattgagtcttcaggaatataatctcacagatagaaaggaactgtgcttttcttactcatctgctctcaaattatatgcaccattattgaaactaatgagtagataattgcagattaattgtaattttaacaagttcatgccttggaatgtaaacataccattttatattattcaaacttcatcattctcatggaatttaagacagaagtcaaaaaagattgtttatccaaattatgttactaatgacatggagaccaaattctcaattctttattatttacagttttgctttataaaatagatatttacagttatgcttcataaaaaaatataccatattagagtacacatgactatatgacatatgtatcatcaagctccaagattaaaaattaactctagaaatttcatatcagaaaaaaagccgattttcaaatttcttctctttttttttaaaacactttcactagtcattctaggattcaaggccctcacttttttcttaaaggatgatatgaatgggaggggttgaaataagaagaggttaaatttctaatatttttttcctgtcacaaggactgacaaacattaatgcaagaaaaaaaataaaagatgaaaacagagacttcattttctagaataagtaaccctaactatattagtaagtaatcacaattagacaatctattttattattgtccacatttttacatccaaatatgaaatggtcatttgataatagccacaattaggcaaatattggcctcccagaaatgtagttaaaatgttgccgtttgcaccaggaagtctattataactaaccattttatatgctgatagttctaattaagtcagaattttacttaagaagacaaatagtttgacaaatgcaatataaattgatcatcttttataaaccagttacagatataatattgatcaataacatggtagtaaacttagtaggtataaaacttttcagaaataaagaattttttcacaacagcagaaattggggagataatgtagggggactcggtaaaaaaaatatccttgaaaatcttgctggagaaattgtgaaggctcatcttaggccaaaaaagtagataatgtgttgctttagtctcagtagtaagggactataaaaataaatttcatctccaaaaatgagagtgagtagaggttgttttctttccagtttttgcttatggcttaacagtttttttcagagtatctttatattgaacaagtatgtttctcattttatttttcttgaggattaaagacattcattatgttctaggtataatagtttcaacaaaacaacaaacaaaacaaaacaaagcaagaaaataaaactaaaatgattataattccagtagctgtaaaattgtgtcatatcaagcatagtgatcacattgtcttaatttactcttttgtctattataacaaagataaacattcagatgaaaaatatgttaggaaccattcatatttagaaaatgttttaatacatcactgtaattaggtttcaaaattggcttcttcatttattataatttaaggaagatatttaacatatatgctaatattgaagtgctgaattaaatgaagaaatgaaataaagaatatgggcattaatttagacagtaatgtgttttgctgctgatattaattaccaggcattatagtggatgctctcatgatatacttcaaaatagtcaacaactataaaaatatatattttcactatatttcacatacaggtactgagagaagaagcaatgcactttttaatgtgccataaattcctttatatcaaataactgtaaatatgaagtttcagcttttggagattattgttgttaacaggaaaaagactgttatcattgcctctgccaagtcatagttgctgcatttagacacattgagaaaatactatagaatccctattataaaaaatgctaaatctttcctgaatgactcagagaggcaagataatatttatatctccattcacattcagtattatggtaactacatttttcttagatactgagtttgcaaaaaggtcatttcatagactttcaatatatagatgaattgactgctcatgtaaacacaggttgctattcaacattgtaactatgtaaaaacataccttgttttattgtgctacactttattgtgtttcacagacaatgaattttttacaaattgaagatctgtgccaaccctgcattgagcaaatttattagtgccatttttccaacagcatagtactcactttgtgtctctgtgtgacattttggtcattcttaaaatatttccaactttttctttattattatatccaaaatagtaacctttttttcagtgatcttactattgttatttctattattgttttggaataccgggaactgcgcacatatgacaaacttaatatgtgttgtgtgtgttctgactgctctaccaaccagctgcttccccgtctctcatattctccttctccttaagccttcctcttccctgagacacaacagtgttgaaattaggccaattaacaaccctacaatggcctttaagtgttcacatgaaaggaagagttacacatctctcactttaaatcaaaagattaaaatgattaaacttactaaggaaatcatattgaaagctgagataagccaatagctaagccttttgctccaaatcgcccacttgtgaaagcaaagaaaaagttcatgaagaaaattaaaagtgctactccagggaacacaaaaatgataaaaaggcaaagcaactttattgctgatatggagaaaattttagcagtctgaatagatcaaaccagccacaatatgcccttaacccaaaccctaatttacagcagggtcctaactttctttaatggtatcaaggatgacagatgtgaggaagctgcagaagaaaagtttgaagctatcaaaggttgattgatggtgttaaaggtaagaagccatcatgataacttaaaagtgcaagatgaagcagcaagtgctgatgtagaagctgcagcaagttatccggaagatctaggtaaggttattgataaaggtggctacaccaaacaacagattttcaatgtagatgaaacagccttctattggaagaagatgccatttaaacctttcatagctaaagaggagaagtcaatgcatggcttcaaaccttcaaattacagattgattatactgttaggggctactgtagctggtttaagtgcattagtgtaagtgtaagtcaatgctcaattgccattccaaaatcctagggcccttaagaattatgctaaatcaacattatgaattatgctacaatctacatttgtgattaataggaggaggtcaaaatatcaacactaacaggagtttggaaaaagttgatcccaacactcatggaaaacttagagaggatcaagacttcagttgaggaaatcactgcagatgtgctggaaatagcaagataactaaaattagaagtggagcctgaagatgtgactgaactgctgcaatctcacagaataatttcagtggatgaagagttgttttttatggagaagcaaagatagtggtttcttgagatagaatctacttctagtgaagatgccgtgaacattgttgaaattaccacgaaggatttagaacattacataatgttcattgataaagcagtggcagggtttgagaggattgactccaattttgaaagaagttttactgtgggcaaaatgctatcaaacatcatgacatgctacagataaatctttcatgaaatgaaatgatgagttaatcaatgtggcaaacttcactgttgttttatcttaagaaattgccacagccttcagtaaccaccaccgcattgagtcagcagccataaacatcaaggcaagaccctccaccagcaaaaatactatgactcactaaaggttcagatgattgcaaacattttttaacaataaagtatttttagttcagctatgtacactttttagacataatgctattgcacacttaatagacaacaatataatgtaactataaatttaatattcactaggaaaccaaaaaattgtgtgacttgcctcatttcagaatttgctttattgcagtagtctggaactgaactcccaatatctttgaggaatacctgtgtttcaaattctgacttttgaccatctttgactttaaaaagcctttattatttgtctctggataacagcatatatttatgacaataaataaatatctattgagattgaagactcctttcaagagactttttaagagtctgggcctggcgcggtggctcatgcctgtaatcccagcactttgggaggccaaggggggggcggatcatgaggtcaggagttcgaggctagcctgaccaacatggtgaaaccccgtctctactaaaaatacaaaaactagctggctgtggtggtatgcgcctgtaatcccagctactcaggaggctgaggtaggagaatcacttgaacccagaaggcagaggttgcagtgagcagagatagcaccactgcactccagcctgggtgacagagggagactccatctccaagaaaaaaaaaagtctgtactaggatataaaatataaatttatgcttttattactactgtatgcaagtcagcatttcaggcattttgagaaataatacaaagtccctcttttcatagggcttatggctaagttaaagaagataaggcgtaaatatatgaacctttaaataatacaatagataagtttaatagtttaagaatgtcaagtggtaggtgtgaaaagagtgatatagagttccagtactgtaagttttcacaagaagagcgcatcactgtaagatgaagtgatccaggttatcatgacctgttttgtaaacaagcttttgatcacacagagagaaagaagtcgagaaaattgtgagaaggtagcattcacagtagagaggggctgggactaaaaatcagagcactgtacactttctgagtctgcatttttaatatacatgggtcttggttaactaaaagatatggactggccacagaggtgaatgattctacaaacaaaatcacagggtgacaaaccaaaagcatactgacagaagtgatggataggaggatatcatcagttcaacttagagcttcagaagttgagcaatatgtgatatgcatataatcggatttatgagtccaatcatacattcataagtatttgagcatcacctaaatattaaatactctttcagacatagtatttgagtgatgtcacatacaagtgttgtaacaagaacttttcaattttcctcagtgtttcagctatgtacacaagtgaccacaataaaagacaccatatcatacgagtactaacatgaaaagactagtatggtaaccgtataatttatcttccaaactgtgtaaaggaggtccataaattattaaaatagtattatactatgattaaaatggtgtaaaagtagtattattaaaatggtatatattaaaataaaaatatttatttacagatggacaaattagttttaatatattggtataaccaaaaattagttcctttaaaaaacaaatgctggctgggcatggtggctcatgcctgtaatcccagtactttgtggggctgaggcaggcagatcacgaggtcaggagatagagaccatcctggccaacatggtgaaaccccgtctccgctaaaaatataaaaattagctgggtgtggtggcacatgcttgtaattccagctacttgggaggctgagacaggagaatcacttgaacctgggaggtggaggttgcaatgagccgagatcacgccactgcactccagcctggtgacagagggagactccatcaaaaaaaaaaaaaaaaaaaaaaaaaaaaaaatcatgtcatctgcaaccagggacaatttgacttccccttttcctaattgaataccctttatttccttctcctgcctgattgccctggccagaacttccaacactatgttgaataggagtggtcagagagggcatccgtgtcttgtgccagttttcaaagggaatgcttctagtttttgcccattcagtatgatattggctgtgggtttgttgtagatagctcttattattttgagatacgtcccatcaatacctaatttattgagagtttttagcatgaagggttgttgaattttgtcaaaggccttttctgcatctattgagataatcatgtggtttttgtctttggttctgttaatatgctggattacgtttattgataaaaaaactgatgcaaaaatattttcaaagagtaaaatatagcccatatctatgcacactcctaaagaaatattctaaattacattgtattggttaaaggagcattacaaataaaataaacaaaactgtttttggcaaataatcatgtaccttattcagtggcttagctgaatctctctaatattctcattaatatttttctgataaatatattttctaatgtggtcatattatttttaatttttaaataaaattttctgaaattttcttcacagttatattttatgacttataaatttgaaattaacagaatcttcaattggcttttctctgtcaaccgaaatattctattaataaaataatgcctttaagtgtgcttccagcaaagcatcatcaaaaaaattcctaccaaaagttgagatatcccaagtgccactggagaattaaaaattaaatgacatacatttgagaacttgtttaatttgtttagtctccttgctctgtagggatgaatttcaatatcttcctggttgcagacctggttttcagtaatatcaaggtgctgaaagtgtcaaaatttaaattttttggcacttcacacattaaaagagaatagtttcagctgtgtggtaacttttcactaacatatttcttgtctttgccattcaaaacagatgggagacagtgagaattttgattaattctcttctccatctgacaaactgctaacctcctaatacttattgggactctcaataaaattagtttgaatatttatttaagtgcatagaattaatattataattaacatgaatagaatattacaagtatatttatatattaattataactaatctgattgatgttacaagtgcaaatatagtgctgtaagtatattagtaataaaacatagttatattacttgaataaagatacgtcaaatattttacatgattccactggatatctcagaactctagattccaacccccagggcatatgtaccagtctctacatctgcatcatcagtcttgcttctttacttatgttatcaaacacagaaaatcatatactcagtatttcattttcctggtattccaaatgagtatctggtgtaaatttctacttcctcaaactgcttcacttcctcttccttaataatgttcagtagaagtattcctatttgtcatacaaatacggaagcattcattttatttttacttgtgtgtgggcagaaagtattttctaattggaaatattatgagtgtttcaattatattttgtatattttatgtaattctatttttgattatattttatataatcaaagcacccatactatttccaattagaaaatagatgctttctgctcacaccatctctaactagaaaatcagtgcaattatatcaaaatcatgatagtggtttccagtggattcttgtatccagctgtccccattacatttctcaagaatacttaccttgtccatcaattccacagttataatcttacacaatggatttatagtactacagtttgtccttaactatttaactagatgtgttctggtaatcatatcaaagtactgatagatgaatagttagttggaattgccaatttgcaaaagaattaacaattacttccacgttctaattttctgttaagaaaaaatacaaaatttatacttaattttccactttgccctttcatatttaacacctagttttgctaacagtggcaaaacttaagcttggacctaataacagtcattctaaattatacttaatcctgaaatttctaagtaggcacttgctgaatttcccttaaaatacttttaactagtaattgttctttaaatatcagtacatttttttcatattcattttctcccttaaatcttcagaagagaattagacagcagtaaaagaagaatagagtagagctacagacatggaaagagaactctcctcccattgctcaagctgatagcttcagttactaggaccaaactactgaccttctgtgggattcaattcctagtttgcattttgtgaatcttagatttagatttctcctgtctttatcaatgagttcttataaagattaaatgaaataacgtgaaagtgactagaaagaagtgataaaaatataaaataataccttggcaagggataatctagtagtatcaattttgttttctactactaatttgtttcatctgtgtaaggaatccagcacaagtacttaagtatatgtaggagtctgttgaaaagaactgaaccgaacctagtggattacacatttatatgtaatcatacatgtaagtttttatgtcccatgggatgctgaattgctttatcaattttttggagaagagtaaattttgtgggggcatacttatttcttacctgagttactgctaccccaaatactgtgctgtcaaaaagatattacgtacttaaaaagaatccaaacaacagtagaaaaatctgctctcaaaattaagcaatagaatatggcacttatcctgacaactgagcaaacctttgcttgaatggtttactgtggagctgataaagtcgagcattagtgagttgcacattcaggacggtaacatctactgatcatgaaaataacacaaagcaaagtcaaagaacacttttacggaccttacataatttcaatgaacaggttaatcaagtgaaaagaatgttaagaatcacagacctcttcaacttttcttcctgcattaataatgccttattcaccttattgagagtcaccattagcgatttacaactgagtcattttttttctaggaaaaagacacaaaacctcaagacttctaaggtttcaaaggttgctgtaagaatgtgattcagcaagaggcaaacataaggagtgttatctttgcctaccaaaaaagtgccattgtagtttgttagccttgacagcctgaggaatcttgctaaaatatcaagttccaagggaaggtagtaactagtatactacagtgctcacagaccactgtttttttgcttatagtgttggcacttggcacagacacaacataacagatggcacaaatatatcaattgttctcaattcaagaacagtgtcacacgcagaactcaattatgcacatatggatacagaagccctttgtacaagaagttttatcagctacctctacatctgtgcctttattatttataccaacaaagcctcttcaggaattctttctgaggtaaagctactccctttaattataaagcaccagggtgatttgctcaacactaaagaccacatgaaatgggaaaacaatattgaaggctgacaacctgggcatctgccaacactgatcccagaatatcccaatcatattcccccaaaatactgatgtaagatctttctgattctcatgtacaggctgattaaattcataattaactctgctggattccagatagtctcaaacaggctattgatgaaatttccaaaagataaatgtcttaaggaaattagtttcaacagaaatcaactacccaaaagacacaactagctgcttagcatgctgtcttataaacacactggcaaattgtttgtcccaaagcatcaagagtaagctatattttattgcctaggactgatttaattattgaagtcagtagaactgagtaacttattctacactttttagcataacctgccaagtgtgtctgattttctatcagaaattacttagaaagcttggttaacaatgcttattgattttcatgaccattctgagagatggactttataactcatgaaggcaacttttcacatttattcaaagtggccctagctcaatttcatgtcattacagtgacactcacaactctgtaccagttttatgtaggtaggcatgtaggtatgcatgtgtgtatgtatgtgtctgcatattggtagtaataacagttcatgatagtgacactaaaacacgtaacatagaatgtgcatttacctccacttattttaataaatttattgacagaaaacttattttcaaatgacagttctctcaagtaaatgatgaacactaatatgcccacggtgactctttgggatcacactggtcaagcaaacagggctgggattttcatcactggtttgtttgtccatgtgatgaatgagtcctcttggttaatgctgaagcactgtcacaaaatattttgtgatttgccctgccagagcataactgagaattcgacacaaaaatgtctaatgtacagaatgttgttattcactatttattcatgatatccacaagagctactctttatcagaaaccacggagcagctttataggtattcctcctttatgcagagggcagaaggcctgtgttctgagtttttctgaagtcagatgcagccacgcgtcactcaccacattgaaatattgagaaggaatttaccttggtgatacgaaaatagaaaatcattttaaggagcaacactcctgtatctcaccgtttttgtttaattaagctcctaaatatgcataagactaacaaaaagttagaacaatgcctccctgatcttgaagggaagggaatgacagtgaaacttacaactatgtgaaaggcaactactatgttgcttctatgtgcaaagcaatttaacctggattaagttaattcaaaatataataatataaaactgttaagggcctcagaaggggacatcttccttactaataaactgctatatttagtagggtaagggaactatatatgccaaaaagtgttgggactgaatattctggggtgggggggggtgcgcgcgtgtgtgtatgttgtaatttgctgtagaagtatgttactattatgtaaagtacagagtatagtatgttatggtgaaaggaaaaatgagtaatataatattgaaattaatattattaaagtaaaatagtagtaaagagtggagaacatggcttcttaggatggtactagctagcagtgccatatatgaatgtatgagaagggttgtatttttttttcttctctctggtttattattgtgtcctcagattcaaaatgggagaatcatgctgattattccataaattatgaagaaggaaatagaaaactagagtcaaataaaaagaagcagagttactaagaatttatatttactttacagactggatagaaacaagaagggttgatggaaaaaatcaaataagagtagcataattttgattcgacaactgagacagctgttgccataaagtttaatttgaacataagcaacttaataaaaactgaaacaccagggaagcaaaggttagattctgacatgtttgctgataggaagctgctgacgtggggcatggtgacagctgtgtttcagttttcagaagatttagtgtagcggttggacaccagggtaggcatattatggtcaggaagaagctaatgagtggcagaaggactcacggaaaaccaaatcttaatgaagagaataaataagtgcagctttcatatgcatcagtgaggatgccctgtgtgagctggaaagagggatggatggagtagagctttaaggaatcttagggagatgtcatttatctatctcttctcaggtagaattgaaatttgtgttctataatgattctaccagcaggaatgagatgtatttcagaatagattctttgagaagagtaattttcaactgtttctccaccatgacgcttggaaaatagtagcatgcgcaacagaatcccatgtgttctcagactagagagaaggattttaaaagactgtgcaaagtacagtttctggactgctagagtaaactccatccttcattttaaagaaagcatatccatggcataagctcaaatttgcaataatctcttttcatttatatctacataaacaaaccaagtcacagattttagtactttacatgaacaaaaaattactcattacatgcactcataattctctgcttggttatcacttttctttgtatctgtccacacaactctgagttctaataccatttcaaacttccactttctgtgtctatgtagttttccccaattctgctagcagctcttagtggcttgctccatttatatgggctaggaatacttgcaagatagtggaaggaaaatggaactccccccacacatatcagaaaaggatagctgcactggaaaaaaaaaaggggggtatccttgtgaagacaataaaaaagacttgccttgggtaacatgatttctcatcagagtgaactccaggtacatttaaacacaaagtggaaagctcataatttttcatcttggcaggtgacaatatgtgactaatccatctttttcttcatggctagaattatacaatgctagtactatcataggaaagactaaatattacatcaactttaatcttctgttggcaatagctactcaataaagatccagtaaactactgagtaatttgccagtgggaaaggaaaatatgtagacaatatgagataatggattgcttctacttctaaaatgacttccatatagattgtgtttttttcagattgaactatatacaggcacttatatatattctacacaattagctatctaggcaggaccaaaccagatggcagaggagacagctggcagggaccaccaagtgaatcatgaatatttcataaaatcaaaaagaattctcagaatttgaaagaacaatagaggaggctagcacttcaacagcccatttagttgaactgaaatttctggtactagtatcccagcattcaatttatccatattatgaaattaaaataacagccccaatttttatgtatacaacaaagtatttgcttttgtcttttataggacaggctgtcactaaagaatactcttctatataatacaatgttcctaagagttcataggttcaaatccagactttatcacttgttagacatgtgaccttgaaatgtgttaacttcatttcccttaggtttcaatttcaatgaggataacagtgcttaactcttaggtttgtcttgaaaattaaatgagatatcatatatgaagcacttattatagtcccttactccctctcagctattacaaagtttctatggaatattagtcataagagactagtttactgtgagagtaggacttgtaaagctttgtttactatagaaattcaagtactcatttagtatttcttaaataaattactagatataaatcatgagcatttaatgaaaactaaaatcttcatagtaaaatttgtttaaaaattctgctacagtttctattctcctcttgaaaatccatgatattctttaacaagaaaaaaatgttctgagaagtattgcaaacatatacaggaaacaggtaaagaaacatgttaacatttgttacacattttcaaaaaattgttaaccactccttttatctccttttatttttgaggttctgctaatgtctagttacacattagaaaataggagtctttgaacattgtgtgatttattaaaaagcaagatcaaagattaaaaataatttatagtaaggctcctagatccagatagataataaaatacaaatttttcttggataatatgtcaaatgttactttgctggttatagcaatgtgcttactaatctgattaaacacaaaaaggtataaacatcaagcttctagttattgaataatcatatatggattagaacacacacacacccacacacacacacacacacacacacacacacacaccccgcgtaagacacagctagaaaatacagaagcaagagatcattgattgtttctttaaaggattatgggattacagtgcaagtatcagaacacacactctgaattaggctttatcctcaatgattttgtctggctaccatctggtccttcaatatgaaataagtagtggtaatatatttaacttgtcttattggggtcatatggccagacattttttattattatgaatgtacttccttttctgtcctttcatatttctatttaaagttctgtggaaatgtcacatagtttgacaggagcatcaagatacagaataataaaagtgaagacatcctctgccttagaaaggtcatttcctgaggattatttaaatcttttatagaatgtaaagaagatcttatagttttcagaaagaaaagaaatattatgctcatcttgggacttagaaaacaacttttatttttaagtactgacttgtccattctattatcaaagagaacacttattaaagagcaataccagctgtcactggataatttgccttaatagtctctagtatcatctttttgtcatttgtgtcttaagagtcaaagcagcaaagtttagtcatctatggcttggacatttaaattatttggaaattttatatctactaaatggtacacatgaaaacaatactttttatggaaaaagttaatgatgtctgtgagaacatttcccaacttacaacaatagttaatcagtttttctcctctcatactggaatgtttctaagggaaaaatatgaaattccttcattcactgaaactaaaacttggtcattttccctaatgtttgcaagagaaacaaaatagttaatacaactgtgttttataataaactcctaaaattaaaagttaatgttcaaatattttgtgccttcaatacactagctagatcacttggctagaacttagctagatcactatctgtaataacacagaattcaggataagactctcttggatcccatccaaaggttgaaatacaaaaagagacttgattataggttagcattttgtcatggactcagaaaattgcacagttgtatggtctcactaggaggagaataatggcttccaactcataatttcatgatttagtaataaaagctacgcctaacaatacactctttctgtcaaaagatcaaaactagcagatactttcaatagttgaggtacacaacacgacaataaaactgcttccactgacactgcttaagaaattctcaattaaaatctatccacaatatgaacataagcaaaagaaagaaacgagtgataataatctgtagtaaatctaatttggaattttaaatttggaggtggctaaattgttaaaatgtccacagtaaaattaaatctatatttttattcaaaagcaaaaataaaatgtagattaaaatctaccaatgttaccagaagacgttcaggactattcaccattcaagtgattagttaagttttgaacaatttttttttaaatctcagttttcttcttcccataaggggacaattattggcagctccatgtttgttacaatgaaatgcttcagaacaattaactagtaatttatatactgtaacagttggtagaaatcatttatgcttaaatttattatgcattagaatagtataatgtagtgacttttatttgtataatgtttttcactcaagaatagaatattctatcattcagatcatttgttggtactacttcatagtaatttgatagagaccggagttctccagtaatcatatacttatttgcactttgccaaaagctcctataaaatgagcacagctgtgtaaattgtttcactttgatatgcagagaaattaaattttgagctcagtgctacaaaatgaattgtgagcaaaaatagcatccatgtctcccctgatgattcctgaggcttgcatgaagttgattaatagcatagcaatatgcctcgactaaacctaatcgcttacatatcatttaatattgacaagtgaaaatgagtgatgtgaaaacattttcaaccaaaagtactgaaattgtatacttcattccccaataactataacttatacaatcttgagctttacttggctctttagttattcattgtaaatagttatccttaaaaaaaaaaattcttctcatacactaggaaagtaacctctgatgaaaaaatgttaacagattattagaaatataaatacattttattattctagcattatgatgatgcgaggtatgcttttaataaaatagcattgtttattaagcacattttatccattattcataattgaacagagattgcttgaaaacacctggaagcaatttgccttctctatcaacattttacttccagaaaggttatttacttcctaatttggtttcaaatttagtttggttctcaattgttcataattaataactatttataaatcctgaacatttacaccactgatgataaataatacttattatacattttacaaaattatcactttttttctatttttttgggggggacttttttttttctgacacagagtgttgctctgtggcccaggctggagtgcagtggtgtaatctcagttcactacaacctatgcctcccgagttcaagagattctcttgcatcagcctcccgagtatctgggattacaggtgcatgccaccacgcccagctaatttttgtattttcagtagagacgggtttcaccatgttggccaggctggtcttgaactcctggtctcaaccgatccgccaatctcggcctcccagagtgttcggattacaggcgtgagccactgcacctggcccctatgttgttcttatatactaggatccatactggctatctttttatttaatctttctgctttataaaactatgtagtataagattttgtcttgcccaaagaaaggtattgcctttgtattcagcttctgggaggtgtccatgttatacgtgatacaagtgtctttgcttaggttgggaactggtcacacccaacaatcttaggttgtagcacagacatgccagaagaaccatccatgtgatttagggaggaggctttgggtcagaccatatcagttgacctgagttcaaccacggggtaatcgatcaatcaatcatacctatataatggacctttaaagaaatatctgaacacagaggcttgaataagttttacttgttggcaatactctgcgcatattgtcacaaatcagtgctcggaaggtaatgcccatcctgcttccaccagaaaaaggatggaagcctcacactcggaaccctaccaagctctgccctatatgactcttcctttggctgattttagtctgtattcttccctacaataatctgtaactttaagtacagttgctttcaatgaattctgagtccttctaacaagttatcaaacctaacagtgaccttcaggactgcaattggtgtcaggagtgaagacagtctgcaaaggattgtgtcctcaagctttgcagctggactaactcctgggcagaagtgcttggatgacaaattaactaaaaggcaaacatgcacacatacaaacacacacacacacacacacacacacactcaaaacactcaaatacataaacacagaaactcagtccacacataaaaatgaacatcaacagaccaaaccgtagattaataaatatattttaataacttactgtcagtgccacgttacttcctctcatgcctcttgcactataaatggattttaatagtcaattcaagtgttgatgcaaaacagccttaaatataagagcaaaacacccttaagtataaagcttctaaaattgaaaatattaaatcattaattgtttgtcttgatgaaaaggtaataacatagggtagtggaaatgcaattaaatataattccttatactgtgttccttttttaaaacacaaaggatagctcctttaatcagttttctgaagacatcattttcagaccttgctcattactttatccacaagtatcattcttgtggatacacccatattggtcaataccaatattaaaataaaaaatttggaattctgaattctaagtttatcttgtttagtacagagtaaaatcatacatctaaaatttaatgagtaaaatagcatttctctgatcagagatggcgataaatattttatgaaaaggatttgaggcatcaaaaaacaatttaagtaaaacaaaacaaaaattatttctatttaccttaattccattttgttatactaaattactattactggctatcacatcaatgtccattagaaccaattagggagttttttgattttcagatcctaattcatgctatcccaaattgatagactgggcagaatcctgagtttctgcattttaacaagctcctagatagtactgttgcagaccaaagtttaagaactactgataatataaattaaaggttgaaagactggacctagcacactgctttgtgttaaataaatatggcagaatttaaattaattacattttaggaagttaatgaattacaatttctaaattaatttgtcatttttgacaggtaatcaatgtgtttaaactatttcataaccattgctttttttttgactatacattttgctgaatccattataagaaaataagtcttgccagttgttctgaatgttttaatgtttcatttgataatatttatatcaaagtattttcagcagaaacttcttcaatatacttttataaatatgaaaaatcagttcacacacttaaaataaggaaaagattagtataagaaaattatcaaatgtttgtaatacaataataaacatttatattcatttctttaatataaaattatttcttattcgtctaacaggataaaaatatttagaattaaagcaagttaaacaacaaatttcttaaattctgtatattatataatatattttgtgtaaaggtgacatgtttaattcagttggttgaaaaaaatgaagaccgcatttcattttttacatttaaaaaaaagcactggtctatatccagtggtctatatccatccagtgtctactcacttctaagcctgtggtcataaaaggaggaaaatggtaagtttatgttaagagttttgtaaagtccttaagcagcatcctgggagatatgagataagtgccactatttttataggttttaggaaaagctttttattgtctaagttttgccattgctttcaaagagcactaaatttctgctgataggaaattaaattcttacatacttgaattatctttctaaatctctactcaacattgttcgtatccaaaatgccaaggaaaaccagtgaaaggtagactgctgcaggagcaacagggttctgaggtgtcttggaaacccaccagacctaagccttctgggcctctttcctgagggaaccacaaccaagatgtggaatagtgcattggaaatccatggctactccagctatggaagagccagtggttgtgcagagtcctctggggctttggaacactgacgtcgtctcagaaaaaaaatcaagagcccaagcccagaacattgtactctgtaccagatctcagcgtctttttgccattcttgttggtgaaatattcaaaatttggaatgctgagatttctcaaatcaatactgtggagataattagatattgcagagaggactccagccaatattgttgatgaaatggatgacacaacagttgcatcaataggggctcaccagtgatttaatgcagacagtgtcagtggtaaccacactgtggttccttcaaaaacatatgggaaagtgatggccatctgagatcttttcagaacaaaaagagcctagtagcttttaacatcatgcccctcaaggatatgaatgagctttccacacatattctggaagtagccaatgcatatgatactgagcaaatctaacagcaagggagagcacctagcagcaacccaggaatgggtgaagtagggaactttggtgggaatagcttcatgccaggaaatagctttacagtggccaaaaactaggtgttggatttgattaaggtttgcccaaggtttgaaagattgagctttcaggatcttaagaaacagctccaacacatctgtagcctcaataaaggaagctgtgaatttttcttagaatacagggatacatttatcccactgtgaatgatgatcatttaaaatctatagacacaaataactagatttaattgggtattggagatattttccagcaggatctgttttcagaatccattggctacagctgtgtatatatttggccagttgacttctaagaagtaggtctcatgaaagtttcagttggcatccttatgaaattgcctagtcttctgtttttgcttcttgacttttttaagctcaaaggagattgatagagatgtatatactagggcagaatttcccgaagaaattacaaataagcttgttataacatcaggttagatggaagaaaagtgccaccaacagaggtaagcagtattacttaaataacatttgggggtttgttattcttaaaatgtttccttaaaatgagcagtactaaggcccgtggttaaagagctagctaagaaacccactaacccctgcctatttgtgtttcccactttggttatttagcattactgtcagaattgcattttctttcacttttttgttgttactgctgccaaaaatgcatttataggaacataaggttctggagaggtggcctcaaggggcagaggagaggaagaaatgtgactacattttgtaccaaataagtgcattcacatgcttaataaaactgttgtattgtaaaaaaatgcaaaagagaagataaaatgtttgttaaatttatgagtattactaatgaaattctattataatgggaaggaagtagagtgaacaagttttgtgtgtgactgatttcaaaatcatcaacaatcaaaacttctgtagacactttaagtttaaaggccaatggtgattttgttatttgaagacttttgaataatccttattgaatatcatcagaaaaaaaataagaaacaagagtcagacatttagacaaagaaatagatggaagagaaggaaaaaagagttatttttgaagagccctgaagaagaaaagggaaatgaagtgaaatatcatagggcttagaaaataatttatctagaccaggcatggtggctcacacctaaaattccagaactttgggaggccaaggcaggaggattgcttgatcccacgagtttgagactagcctgggcaacatggtgagatccagtctctataaaaacagatgaaaagaaaaaataataatttatctgtctatgaagagtgaggaaaccaagtcaactgtaagaagggtggagctaatgaagctatcttgagaaacctagggttatataaacatacgtattagaggaaagtttagaaatatattatctggacatgtttaataaagctaagtaggctaaataaaggttacataaacttctgtatttaattttaaaactccaatatcaagctcttttgcatttctgaatccagtatgagatccagaagttgaaagccaataagactgagtaacaaaatgagaaaagctcgtggaaagtctgatactcgtacaaaattctttttagtatagctattctttgcaaaataaaaataattaaaatcatttttcaaacctctcagagaattttaaagtttatgttgccaattgtgaatactaaatgaacactaattatccactacccatcattattaactaaatatgtgtatgattttatttatataatcttaattagtgggtcaacttttatcttattcaaggtacttacaaattggacaaggaatttgatgccttcatttctaaccttaatttcccttgctctgtttttcctatataatgttaagttgttcaactacaaattgttctatcataagaaatctcaggaacctacccttcccagtaggaaacaatccactgttcactaaattacttgtcaataaaatgataaagtgaaatagaaatgcagaatggaatacagtagatgaaaaatattatctctggcatacactggctattattatttttattcaccaatcaatagtgttgacttttttagtcaaatttaaaatacagcaccttaaaatacgatttaagtataaattgtggaatcagaaggcaaaaattctactgttgtcacagcaggtaaaaaaaaaagctgtaaagcaatgcagtccacctattttacaatataatgctaaaaaatgtaattaaggtaataaatttaaaaaaaaatctttttttccaattcttgagatcataagcactagcaaaaaagcagtatttgcagacactattgattggtttttaaattaaggtcaagtgtttggaaaggtattgcaaaactagattcatcattactagcccaaataggcacaaaattactagattctaaatgaagtgcaatatctcaaaaagaaaatatattttttgcactgtaattgaagagtagaaaaaattttcccctgatattcctctttgcaatttattgatagatgtatttgcagtgaggtaaacttactgtcataagtataactgaataaacatgaatccatcattatttaaatatttaaagtattgactaagaaagaagggggctgtaaggaaacaagggcagccatatcttccctcgtctgacagcttggaaaccaaaaagaaggcactcctccacccccttttctctggattatctttgtgggtatcaaacttcattctgaaattttgaatcatcctgactaatatttcaattgatgaagaaatagcctggaagggcacacatacctaacaaattaggacatgtaagatcatctgctctgtctaccttcacacatgtctaaggggttggctttcacaagaatgatacatgctcattagatgtaacacatagtatttaattatggtgaagtttgaagtgaatcacctggattgaaataccagcattgtcctttgatagctgcacacattttacaagtcatttaccctttacaacttttagttatcttgcctaaaaaaaactgcaattatatgtataaaaataaaaatattatagctaaaaagttacatgaatattagtggttgccatttatctgatacttactatatgccagatatatttaattctcacaacactgtgagttagacataattatatctatttaatacacaaggaatttaaagggtagaaagcctgacttcaaagcatgtaactgctctaaggataataatagctttcttgcttaggttccagacagctgtgagtatatatatatatttatatatatatatatacacacacatatatatgtatatatatatttatatatatatatttatatataaatatatatttatatatatacacatataaatatatatacatataaatatatatataaatatatatatgtataacaggttgcaagaactttgtaagttaaattgctaactgtgcattgttggctattatatcatgatatttaaatataagaggaagtttaactcccaaatttataagcaaatggcatagaatgattataaagttttaggatccaatataaaacaaaagtttttgagatcttttaggcctttgtaatccataagttcaaatattaggtatagggcagttaagtaaattgcctaaggttgcagcagacctgggaagagaactgaatagcttagattcataatcgtggtgttttagcatgcaaaggaagctacactttgaatatttgacttttcagagataatgttccttcaagtatcaacatagagaagaaaataataccatttaaaacctaagtaattctttgattattaaagtaagcatagtttgattctaaaactaagaaaactacatattatttcaatatgacacacaaagaaaataggttagcttatcaaagtattttaggtgagaaaaaaatactacatcatcagcccaagatgtggacagaacataaaatactcagacttcgaacactaaactaggggaggaaacagtggaactacagtcaggaagtcaattgcattatatcacagcaagtaaattgtctcttttaacctgtcaaatcaggaacaagatggaaaaaatttcaagccatttatgcagccaggttaggaatacaaaatataagcaaattttaaaaagaaaaggaatatgacgtacaaatatagacaagaaatccagctgaataaaaaaaaatcacaattgaaggaatggaagaaaattttacataagtgctctgtgaaataggatatcttaataagaaattgagttctgtaaaataggtgttcataaacgaggagttaaagcaacaaaacaggatgaaaagaaacactaagcactatgaaaacaattcgaggaccaaaacaaccaagaagataaattagaaacaaaagggaacaaaacttatgtggctgaaagttgttactaacatggtagaaagatttgatgtaaccaggatacatgcatataggaaaagaaagagacttttcaaataagaaaggaactaataaatggagaaatcaaacactattcaatacaaaaataaagtattcctgaggtagtgacctgaacaaatgaaactgcaaactacacaaaatgtaattttttttcttaaaataaagaatccacattaccccaagagaaaaacaaaatgatgtataatactcaacactggtacatatcctggttaggttactgaaatgcaaggttataagacatagttcttcagcaattcacacggacagaataaattgcctgggagaagtattggtagcagcagtggtggtatatacattctagacattttcacagcaataatcaatggagtggggagggagagggagagcacaggcaagagagatctccagccaaaatgttgctaagctatgaaagcaagaattaagattctcaactacatatttttaaaggcaaaatatattgtatctgttatctccaggttgtggagtgggggcaactgaattgaagatgctgggaatggagaggtgctgagtaaacaggactggtgggcactaaattaatgtaatgcaaatattagactaacactaaatttaaaaaataataattataaaacaatgtaaatttcataaaccttcccaatgtaaaactagtaacaaaacttacaaaaacaaggatagaaaatcagattgaataaagaataagaaggcttaaattcatgaatatggtctgaagtcctatatactgttaaaaatatataatggtttatgtgtcttaatttttctcataatttctttttttaagtttagagaaatggtttaggacaaaatatctgttgtgggaaataaatattcctgatggattaagaaattcaataacttatctcttacattaaaaatttttaggccaggcacagtggctcacgcctgtaatcccagcactttgggaggccaaggtgggtggatcacctgaggtcaggagttcaagaccagcctgaccaatatggcaaaaccctgtctctaataaacagaaaaaaaattagccaggcattgtggtgcatgtctgtaatcccagctacttgggaggctgaggtaggagaattgcttgaacccaggaggtggaggttgcagtgagtcgagattacaccgttgcactccagcctaggcaacagagcaagactctatctaaaaaaaaaaatttaatttatttatacttgaatttaacatatttgataaattaatgatatttttagataaatatatgcattttgtgtaagtctgtcttagctttgttgaggtataattgacaaaaaataaactacacatatgtaagtgtgtaatttgataattactgacatatactttgacaaacctgtgaagctatcaccacaattaagttagagaacatgtccatcaaccccaagtttcttcatgctccttggtaatccattcctttcaatccttcctcctcaccttgtccccagacaagaaatgatctactctctctcaccgtacattagtttgcattttctagaattaatgcaacttgaatcagaccatatgtacttttctaaaaaaagctggcttcttccatgaagaataactattttgagattcatatgtgttgttgcgtgtgtccatgattgaagtttgtttccttcatctatttgtggacatttgagttgttgccagcttttgactatcacaaccaaagatgctatgtacctttgtgtgtaagttgttaagtagacttatggcttcatttttcactggtaaatacctagatgtggattataataagtgaatgtttaattccaaaacaaaatgaaaaaaaaaacctaccacactgtttgccacaatggtttgtacccttttacattcttcaacagcagagcatgttaagttccatcgcctattcataccctccaggacttagtatggctagtctttttaatatcagccatcctaataagcgggtagtggtatctcactgtggtttgaattgcatttctctgatgagtaataatgttgagtactcattctggtgattatttgccatccatatatcttctctgatgaagtgtctatattgctcattttttttataattttctcatcactgagttttgaaaattctttacatattctaaatttgcaaatattttattccaaaccatggcttgtcttttcattcttttatcagtatctttcaaacagcagaagtttatggcatttattctgtagtgtctaatttattatttatttcttttgtggattgcattttgggtgctacatttaagaaattatgaaatcataaagcttatagaagaaaatatttgtgacctcagattaagcaaagatttcttagatacaatgcccaaaacagaatttataaaagaaatgataaattagactgtatcaaaattaaaaataaaacaacttctgttgaaagacacttagaagaatgaaaatacaagctacagactgtgagaaaacatttgcaaagtatacatttaatgaaagatatatattcagaatatgtaaaggtgtttcagaactgcataatgaaacaatggcttaaaaatagataaaatttgaattgacacttaaccaataaagatatatggataactaataattacacggaagatactcaacattattagtcatcagagaaatacaaattaatgataaattttgtgtcaacttttgtatatagatcaataggtggaccaaagttcactttttggtgtatggaaatccaactgttattgtataatttgtttaaaacactatcctttctcagctaaattgccttagcattttttgtaataaccatatatatccacatatatatgggtttatttatggatctctattctgttccattaatctaagtccatctattccaagaccacattctatttttgcaataagccatcagatagtgttagtcacccaactttgttgttcctttccaaattactctggccatagttgttcccttatatttccatctaaattttagaattaacttgtcaacttttgccacaccaaaatccaaaaacacaaagaaaacttctagaatttcaaatgagcttgttttgaaaatatagattcaattgaggagtattaaaaacaatattgaatatcacaatttgcgaataactcatatctctccatttatttaggtctttgttaatgtttttctctcagcagtattttatagcttttagtgtgcaggtctttcacatcttttcacagatttttccctgacaatcatacagcatcacattttaaatgtttttaaaatggtattctttcctaattctaaattctgtttattctttggtcatatatagaagataaacagaagatatggggtgaattacaattaatttttgtatattgatatcttattctgcaaccttgttgaactcatttattagctctagtatcttttgtagattccattgtattatttacatagatgataagatcatctgtgaataaagacagtttatttctttgcaatattgatgcgatttatgttttttccttgtcttattgtaatagctagaacctctagtaggttaatgaatagaaataataagggaagacatccttgccttttcctaacttagatgaaagcattcagtcttttatcatagaatatgatgttaactaggattttggtatttagttttatcaggcttagcaagttcccttctatgtctagttatctaagaggtttttgttgttgtttttgttctccaggaactgttgttggatttcaacaaattttgggggcacttattgaaagaagcatacggatttttttcttcagtttattaacatgatgaattatattgcttaactgttgagtgttaaaccaacttcatattctcagcataaactctgcatcatcataatgtattatcatttttatatattgcttgattcagttactaaagttttgtttagaattttcatgtccatgttcatgaaggattttggttggtagggatttttttacattcttgtatggttatttacttttttatatatctgaataatgttggcataattgaatgatttgggaagtactctctacactttggttttctgaaaaaatgtgtataatatgacctaattttgatattaaaattttatacagttatttttctatttttcatctccctatatgtatattgataccaatctaatgctattgatactaactgctgggtggtaagaattatgatgctttgtctatatttttatttgtatacttaaacattgattgtatgttttataagccacgtgtagtatttttaaaactatgcaaatctattgttaaaatttttttaaaaattaacaactgtattataatattctgcaattataaatggatgctgtcggcactttaagctgattgtcagaggattacacttttcagaatgttttctgagaaccactagtttatctggagtcctatgttgtggtcatcagtaaacatggttgttcctggaacataacagtaagttcaactatttcacctctgtttaccaatttgaaatgtatgattaggaattgttttcaaaaaaattttgttaataataattattttatttcaagtgttgagcatacattgcaaggactattatggtcagttaatctcaggtatctttcagctgtcaagatgcaattcattttgtctcatgttgttttcagaatcttgtggtattaatgtttacagtagctaaatttgaaataacgttgtctccatttcacaaaaacagatgtaaaagtggttcactacaacatatattaaaaatattataattataattatataattaaaattatatttataattatattatatgtatatgttttaattataattataattttaaaatatataaaatatcattaataacataaagagtgaacagaattccagtttgaatataaaatgtgaatttgtgagcacccagtcaactattatatcatatcagataacttaaataatataaatcaagtgtacaataagaaaaggaaaatgcctttaatcctccatattagggaagctgatgatgtctattatttagttctttctcagcattgacttgtttggagtaccagctgatgaggaaatggacattgaacttttattttctattattttttaagctataagaattccatttaaaatttgcttttttcctttaaaaggcaagatgcaaactgatctttaaacagagttcctgtgtcataaaataaccccctaggtctctcattttagctaggtagatgtaaaacagaaaagtatgcattattctcggagaatagtattaacagactattattgtcctggagcaggctggagacttagataaactttttgaaagctaatttaagcaatgttctttctcattgcaactcattacctccacaaatttatgtacataccaagaaactttaagaatatttcgttttaaaagttccaagttccaggtaactgataaactgtggtaacatccatggaggatacattgaggacttcatatggaatttgtatcatataagagtgataatctggtcttgtggtttaatctccacttctgggtcaagatttttagagaaatgatggactaatgaacagagatacctgatggtgaataatgttatgtattgaacaagcagagtaataaatatcaaatacaaatgcttaaggaaaaaaatccaaacattcagtcataaattgctgccctacaatttttcacattgattctacttaatgaattgaagtttgagatttcatgttgggtgtccaccatggcttgatatgtttgctgtagggtttcatgcatctggtaagtgaaggtaacaagaacgagtctgattgttggaaagtgctcaccatacacctactcataaaggctattttagtatacattaaaattttaccgtatctccttaggtgtgagatgaacacagataactaaatgaagacaccgtgaacatgaccttgctactttgagaagtaaggaataaaactttacgtagcctgtttagaatgtaacaatgattagagaaggtcaatttgtttttcctccaagattagaaaattaaagaagataggtaggaaaattaaatacagtgcaaaagtactgatacttttcaatgatcacccaatcatttctcttgtccctcaattatctgtttactgatataaatgtgtatcagattgttttgcctctcatgtaagcgatactcattttaatgccatgagttgtttcctttgctagaattatattaaatttgagtggaacaaattctaaaatactcaagtatattcatttccaattatgatctaagaaaataaaatgagcacagagtgtatcgtaatgataaaaattattttggaaagcatgcaatttccaaatgcatttgtttcatttgtgacctttatttgtttctacaattctacttttgagtttactaagcatcaaatggtaaccagtagtgaactactggataaccatgagtttgaatattccataatggataaatatatactgagtctcattctatatataaattatgtggaccaggggacctatgttttagaaatgtgtatgttagagaaacaaaaaacgtttcagaggtcctccgagtaaatatgaagaagggcaaagatactatgagaaaaacaaaagcataaagggtaaatacaatttcaaagctaaaggtggataaaacgattcctaacaggtagtgttggcagaacaagccaatgcctaatgttattgttctcctaattggctcatacaagcagctaaacaatatatctggcataaggcagtaagtctttgaaaccaaatattccctggaccaccttgctaaataagctgcaatttctaagactgatatcccttggtttctacagttaagaagcatgatatattttacatttctgcccagcaaagctattttagacagacttaaatatttaaatcctttatgggatttgacagaatgggatgaaatggcactgctctagaaattttggccccagttctgtcactaatcaggtgtgtgatttagttaagtcacttaaacttttaagctataacgtcattgtctataaaatatctgccctggaagtacagttaaaataatgtgcttggaggggtttttaaaaattaaaatgctttatacatataattaacaatcattctatcagatctcacactccagtatttttatttatttttgcaataatatttatgctatttaaaaataggtaaggtccttatttaaaaaattcattcaaatgtttatttctccctgagcacatcttagctgttcaatcattaaatcttactcagcaaattaagtgattatcctttctttctatttttaaaataagagcatggaagtacaagaaaatattcccattgcccaactcataaataaaataatgtgtatttgttcctagtgagtatcaccaggtttacgatatttaattaagcagtgcaatgtaatgtagcactcattcgatagataaataaaatggtacagtatagcactccaaatagtcctatagtttagttcacattttccacataaatcaagttggtactacaataagttttttgcttatatataaatttattctactctctggaataaacattaaagcaataatacatgatagaaatactcaaatacagtgattagatgttctaaaaaagttagccaatttaatatgctatagtttctcctaagataactattatgagaataaaacataaatgcagctgatttcaatttgacaactctttgcaaatcagattacctgaaacttttttacctcattacctaattatggaatcctgacatgctatctggcctagccctctggttcccaattattaaaatttaatcagtatccacttttctctaaccaagcacatttaagttctatcagcaatacaaactcaaaggggaaaaaggcagatctatagcaactaggatgtgagaattacttttttatggtcaatgtgacacaatgaatgaacactatgtatacaacactaaattgtcattctgtcttctcccagtgaggcagtgcatttaatttcctcaattggacatacttactgaatcagattagatgtaggtaagaattttgaacttttagtttctcagggaaagagggcagcagcaggaagagacagacaacactttagcattccgtaacttgatccctacacaccccttgcgtccgagctgtgccttttctatctttaattttcattctacaaatgatcagcctatctctgtcatccatatacatcatgctatttctagccctctgaatcttcatgcatgctggtttctctgtcccttacccccctttcccaacctattaagtctgatcatctttcaaaactcaatttagacaacaccttacggaagagttctgattactccttctactatgtaggattgaatcttcctccattaatgatcttgtaacatcaagtccctgtggcatctttgcctttactgactggcatggaaatgatccatgtatatttctgacttcctggacagttggaaattgtgtaaggatagaaattagatcataataatctttggatcctcagcacttagtccaattgctggcatgcaaatagtcaatagatgctttttgaactgatccaaagaaatcttagagataatctaagtgctagcttaaaggtaatcagataaggatttaagatcttaggaaaaaaatagatataaaaaaataacataaaattctaatttattaaagctgaatgtatacactctgacgtaaaatattagtggacttacctggttaacatatgggtaccttattcacctttctgacatattccaataaagtaatcatttttttctttaattatgcctattataaaactgattatttaaattcataactatatctttatttcccagttttgtctcctaccccactttaaatatttggtgggaacatttaggggagtcattaacacaatgcaaaacacataaattttgcattgtattgttgactcgcctaagtgtccccacaaaatgtcattaattttttgcattgcattaatgacatgggtaagtgtccccacctatgtaattaacacaatgtgaaatttaagtttttctagtcattgaatataaacaattgcatagaaatgtcttcatctaactcattcagtgctttgaatgtctagcttccttttgttaaccaactaaatactgtattaattaaacttggtacctcattataattaaataaatataagtcatggacagatggacatgaattaattagatcagatttattttccattaatatccatttgcagtaagagaatggcgttttattttgttaactcatacttcacattatgtttatgtacagagagtatttaaggttaatgattagaagtttactttggagaataaagaaagtagataactttttagcatcatagggaaaagtgaatttggagctgggcaaagataatcagaagaaaagtagaacaattgcaaacaaacatacaaacaaacacacaaaaactcactctactgtggaattagagctcggagaaaaaaaatgacttcccacatagcatgaaattagaactatgaccttggaataacattgttcttactacaattcatgaacattacataaatctgtggttggccgtaagaatgtacataccattcatcacattattttctatgtgaatgcatgttcttaaatttaaaatttaaataaatgccttataagtgaacttttataagataatctaatgaatctcttttctgctcatatgttgagaagcaaaagtaacaagttcagttgggtggttctgttgaacctataaattctacccatagaatgtttcatcaaaacatgtttcaaagcagtacactgggagttctagaaataaatttttcataaattccactaactgtatatgtagagtctattagtttcacactctagcatatattttttaatttatttaatgacatgttgacaaaaaatgacactgttaaatgcatatttgtaataggctgcttcttatatatacaggttattttttacagtttatttctgatactatataacaattaggacaatctacattaagagatccaaaggaaagtagagaatatcagcatgtagatagctctgatatcccccatggaaaacaataatatacttcataggtcatgtaaaagtagaaataatgaaatcgtatacattttttctcaggttctctctttgctgtttttcttaatttcagtcttcaccagcaaagaagaaacataatgtcaaagtgttcagttgagtatgtgctattgtcatcagcaccttcctgaattgtgtcatcgttagcttttaggcatttacatttttttacattaagattttgatgatttcctcaatctccatgtatgtcaggactatattaattaaaatagtgtatgatgacaagatcagagaaaaaaatgcaaaagtgaattaatttaaaaatcaaagattggtataaaggatagagattcactcatatgtctcctgaaaaatctcttctctataaactgaatatacttgtttgcataaaatgatttgacttgtctgtaaaatagtcagttgaatcaacctccatgatgcaaatggtaaatcagttcaaacatacacttcaggtgctgcattctcagagtgaacattttccactgatttattatatcatttagtaattttttattaatagttcattttcaaataccaatttagtgtcaactactgaactgtctataacagaaaatacaaagataaatcaatcaccactttagctttaacaaacttaataagcttagttcctaggttaggaaagtaacatagaaggcttaaataaacacaaaaccaaataaaaatacatgtacatttggagagtgacttaaagtttaaaccaaatagtgcatataaagcacttactatagtgtttagcataaagtgagtgttccacaaatactgttttcattgttactgatgttatgtttgttaacctgggtgtagaagcaggaggtcatatttcagtgggaagtttcagtacagatatcttgacagagttggcatgtacaagcatacctctgagatactgcagttcatttccagagcactgcaataagcaaatattgcagaagagcaagccacgaatttttttggtttccctgtgcatataaaaattacatttacactatactgcagtctatacagcattgagtctaaaaaaacaatgtacgtgccttaatttaaaaataccctaaggcaaaaaaatgctaatgatcatctaagccttcatcgagttgtactctttttgctgaagtgtcttgccttgatgttgatggttgctgactgatcaggatggtggttgttaaccaccaccggcctgtggcgatttcttaaaataagaaaacaatgaagtttgctgcatcaatgaactcatcttttcattcaggattctctgaagcatgtctggtgtttgatagcattttacccatggtagaacttccttcaaattggagtcaatcctttgaaaccctaccactgcttaatcaacgaagtttgtaatattgtaaatcttttgttgtcatttcaacaatgtttatagcatcttcattagcagtagattccatttcaagaaaccactttctttgcttatccacaagaagcaactcttcatccactgaagttctttcgtgagattgcagcaattcagtcacatcctcgggctctatcttctaattctagttctcttgctatttccagtatttctgtagttattttctccactggaatcttgaatccctcctccataagggttgaaatcaacttcttccaaacacctattaatgtttatattttgacctcctcttatgaattatgaatgttcttaatgacatctagaatggtgaattctttccaggtttttaatttattttgcccagattcatcagaagatccactacctatgatagttataaccttataaaatgtattacttaaataataagacttaaagtcaaaatcactcctggattcatgggctgcggaatggatgttgtgttattaggtatgaaaacattaatttccttgtatatatatatatatatatatctcctttttttttttgacagagtgttgctctttttgcccaggctggagtatggagtacaatggtatgatctcagctcactgcacctccgcctcctgggttcaagtcattgtcctgcctcagccacccaagtacctgggattacaggcctgcaccaccacgcctagctaattttgtgtttttagtatagatggggtttcaccatgttggccaggctggtcttgaactcctgacctcaggtgatctgcccaccttgtcctcccaaagtgttgagattacaggcttgagccactgcccccggccctccttgtatatctttatcagagttattgagtgaccaggtgcattgtcagtgagcagtaatattttgaacagtaagtctcatcagtgggcttaaaatattccataaactatgctgtaaatagatgtgctgccatccaagctttgttgttgcatttatgaagcacaggcagagtagatttagcatgattcttaaaggcccttggatttttgaaatggcaaatgagcattggcttcaacttaaatgcaccagctacattagcccctaacaagcgattcagcctatcctttgaagttttgaagccagtcattgatttctgtcctgctatgaaaatcctactgacattttctttcaatagaaggctgttttgtctacattgaaaatctgttgtttagggctagccaccttcactaatgattttagctaagtcttccagataacttgctgcagtttctacatcaggactcgctgcttcaccttgcactttttatgttatggagatggcttcttaccttaaacctcatgaaccaacatgtgttagcttcaaactgttcttctgcagtttcttcacctctctcagccttcatagaattgaagagaatttaggttcttgttctcaagtaagctttggtttaatgcaatgttgtggcaggtttgatcttctatccagaccactaaaaccttctccatatcagaaataaagcattttgctttcttatcatctggtgttcactggagtagcacttttagtttccttcaagaattttcctttgcatccacaacttggataactggtgcaaaaggcctagctttcaccctctcagcttttgacatgcattccacactaagcttaatcatttttagcttttgatttaacaagagagatgtaagactcttcctttcacttgaacacttagaagacattatagggttattaactggcctaattgtaatattgttgtgtctcagtgaatagggagacccaaggaggagaggaagaaagacatgagaacagccagtcagtaaagcagtcagaacacaatatttaacagttaagtttgctatcttttatgggtgtggttcatggcacctcaaaacaattaaaataataatgtctaagatcactgctcacagatcaccattacagatataataataataaaaaagtttgaaatattgcaagaattaccaaaatgtgacatggagacataaagtgagcacatgctgttaaaaaaaaaaaaaatggcaccatagacttgctggaaacgaaccttcaatttataaaaaacacagtatgtgaaaggtcaaagaagtaaaggacaataaaacaaaatattcctaactatcttcaggtaaaaaaaaaaaggaaggagaaatgtaaatcaaatagacatgaacaaaaaggtggcaatatgaaaacatggggaagtgaaaactgagctatctatggctgcaatggagagtaggtgtggaaaagtcatgactgggaaggcttgaggccaattaagttgtgccaataatccaaggctaaaggatttgcaattcattcataagaggatgagaatcacagaatcccaagaaaagagaatatccaaaaatgaagtcaggactcaagaaagggtaagcaagacccaaggagtgtctgaactaggactttggaagtgaaaacaagaatgtaacatatgcttccaaataagaagtctgagaaagatactgataaaattagagaggagaaaaaataaacccccaaaatgcagaattacagaaatctaaggagcccagatgtaaaaaacaaaaacaaagaatgaaataagaatttggagagttataatgatcaagcaaaaggtaaaccatttggaagtagttacccagactaaccattaaggtggcaccagtaaagcattactttactggtaatgcttgtctgtttatttggtagagacataactatgttattagaatacaggcaaaaatatatttaaaaattttaaaacttatttctttaattgtatttttttacaagtatctaggttgaaagagtctgcaagctgtcctgtggattccatctcttttagttgattcaattgccaactcagttacaatatttgcatggtttttaatggcttagccatttaaaaaatggtgagtaggtatgcattcttcataggattgctctgaagagtaacagtaagtccttcataacatgaggtccaaattacattaaatcattaatagcacttcaaatattttcccaaataatgtagtatcagttattatattacatccttaagtctgctaggtttttaagattaacaaagaaaactagctgagatcatttctttatcattcacaatttgttctttatgtttcactttgtatagtcaacataaagttataactttatatgaaaagtatttccaaatatacacttaaaaaataaatgcactgaaaaagctatgatcatatgaatttccgtgactcactctgaatatgcatatatgaggaaacagctcaaaaccatcattattactctactaatttgaaacctatgatgatgcaacttggacacagcttttggaactgtgaaaatgttttaccaaacaaattcataatgaatataactaacatgagtatgttttaaagcaaagtttattatttattgtaaatatatattcataatcaaaaaattaaatgaaattaatagtctaaactctgttttctttgttaatccacctcgtatagatccaagttaacaggaaattatggagcgtttatgcaactcacctgcaaaagcctctaaaacatttgctcaaaatatttttatatctcttattcgtagtcatttttattatttttttccatattctatcttattttctgttttgttgtgtttccagcttgcaaaatacttgcattttatgtgtaacctcctttcctatttaggaaaagtatatgatattgcatatctatttatgtctctatttctcttggtttccatttgtgtttatctagtctgattgacttttatcaaggtgctttatccttgaaattgacttttcaagcttatcaaaggaaaacattttcctgacttcatgctcctttgctgtccatagagacaggttttattttagatctagaaagggaagcattgctccataagggcctctgacccagagggtcaaaaagaattcatcaaggcccacattgaaaaaaaaaaaaaagaagaagaaaatttaaatctagttttatttttgtactgtctttagtgagagatataaaatattccactgaatgatatttaaactgagtaggaaatacatacaataagaaataaaatacattccaattctatattatgtccagctacaaagagatagagccataaaaagggaaatgagaagagtcgaggaacaaagtatgacacagtctgaggatttaaccaaccctgaaatcagagcaggaacatttatataaatatacgcaatcttcaacattcagggggaaaaaatacaagaaaatattcacatgatttcttaagaaaattgttttaaaattccacataaagctgaaaaatacagattaaaaaaaattgccctcatttattagacagataggccctatcttcctgctctagtgagtgaaaaatatatgttctcaaatttcagagatcccatataaatctatgctaccatcttgtgttctaaatattgcttctaatgatctaaaacacattgcaagaaatgaaactaacatgatgtcaaacccttaagaggagtccatgcaaaatgtctgtttgcttagatatttttattttatcactatgctgaattttagacttaatatttctggtatttattgctctctgttctttttcccagtgcattctgcctgttttatcttcgatagtccttcctacagacacaagagcactagtacatgcagaaacatatatactcacacactataaagagaagtaaaaagtgtactgttttaaagtccaaattgaccctatgttgtggaaatatcataatttttttttctggggtaattgactttttttttccccccgttcttttttttaaagaaacgcctttattagtccattagattgtgacaggagtctaaacaggagaacattaccaggaaaaaactaaattgctatacatgataagtaggatgtttatgagttgtgccttctgctagtggcttagcactaaggataaagagaagtaaagatctcactcagatgggaattaacaaaaggcttaccaaagaaaagttgcttctgcagaaaaaggctaatgatggctatctgggaacactgataattcattcagagtatctctttcttttacttcccctcctcttagcttctagaaatcttcaataatctgttctgcctcttggccttagattaaaactgctttgaaaaaattataaaaagattatgtctaataaatgaagtaatgtgaggggaaaattataattgctaaaggatgatagcaaagtagatactgagaacacaggaagaattcaaagcaagagattcacaggagacttggagtttccagaaattctcagaaatattaggaaggcaggccaagcaacttcccaaactgtaaggctcaagccattttactgaaaaaaaaaaaaaaaaaaaaaaaaaaaaagtctccattgagagaatcaaaacaaagtgggaaaatagggggaaatccttctacacattcacatctatacctattgatgctgttgaactcaaatgtaaaaacacacaccagacacatatggctgtcaggacaaaacataattagcgtacaccgtccgtcctctgtgttcacatggcacctctgaaacctaccttaaaagtctttgtctgcttctacattagattataatctttctagtatacagattacctttaattcttacttgaatttcccttcatctagcagagaaatttattgactgaattaacatttattgaatgaattaattgaagtaaatatttattgactgaattcctcacagctttcaaatttgaatactgattaaagtcaaaaaatatgaaaaatagtttcattaccttgaaaagaatgaagcattaaaaagtaaccatcactaagccaagaatgaaaacaatgccgatgtcttgagtataatgtaggaagaatcatcataattttgacaaaattaaaggaatacgtaagtacacaaaacaataataatgagatacagaggatacactataagcagatgttcttttgtaatctggctttttaaaaagtcagttcattgttatttttgttgttgctgttgttttattaggttggtgcaaaagtaattgtggtttttgacattaaaagtaatggccaaaaccgcaattactttctcaccaacctaataacaacgtgtaaagggatttggaacaatcaacatttcaagtcaaaatattatctacctggtgtaggccgggcgcggtagctcacgcctgtaatcccagcactttggaaggccgaggcgggcggatcacgaggtcaggagatcgagatcatcctgattaacacggtgaaaccgcgtctccactaaaaatacaaaaaaattagccgggcgtggtggcgggcgcctgtagtcccagctactcaggacgctgaggcaggagaatgacgtgaacccgggaggcggagcttgcagtgagccgagattgcaccactccagccggggcgacagagcgagagtccgtctcaaaaaaaaaaaaaaaaaattatctacctggtaaaggagataaaacactttaaaacctcagcatcatatttaaaaggatttgtgtagcattactattgctaaaaggaaaatagtatgcatttatatttgtattaggttcagcgtaattggatgaatgcagaaacttcactttcagtagggtcatacatacattttatagacatattgtgcacaactttacaggtccccactcaaaactaaagctgcgaattcaaggcacagacattttgggatcaagtgtcaacaaagagaatgtaaatgcggatcttcaatctttttccaactatgggaaccgctttatctaacaatgaaaacgcatcagtgttaaggaattctatggatgagctaattaaaataaaaaatatgaaattactggaatctacatttgagaattgtaagatcaagatcagatgtgattcttagtaaatactagaatacatttatttagtcatcaatgtcaaaactctataattatggtcaagctacaatttgggaccaaacatatttcataggatggtacccatcttaagtacaaaaatgaaaaaagatcgggaatgtcttatgtagaattctagagaaaaccaatctgattgtttaaaacaagtgacagatatgttccatcttcactcaaggagcaataggctcaaattacaatcccctaaaagtatgtatgaatgtatgtgtgtgtatggaaagagagaggaagagaggaaagagagagaaaaactgtctgaagctaagaatattcaaaagcagcctaagaaaataatcatattttcccaagactattgaaggaaacctaacacacctactgtggcactgtcacgtgacttattaaaagttactttgtgtgttgccaaagatcaaaatggtcatttcaattcaaatgtttttcaactccagacaaatgtatttgtgtgggctgaacaaattagtttttctcactcgaatgaactaatacatgtaaaacactggaagcaaacctttatgacagtgtactttcaggaagaaaaaaaaaaattagaagctttttaaaaaagacaataaaagaaaaagaaaataatttttaaattaggcatttgacaaaaaatggcttttgagagagaaatatgaatttccaggctactatatttttccattgctttgtaaaatttatcttctttacagataagctgcaaagaatatctacaaagaaacagacatgcagacaaaaataaaataatttaagtcaatttatcaagcattgtgatttttttctttgtatttgtgtaaaagtttggctacatcaagaagaaataatatagtagtatccttcataagttagcagatccacagtctttaaaactaaggaattgtaaaataacatatgtttagatgcatgatatatggatccagtagtgtacctagcaaccatcctcattctaaacagaagctaaccacaaaacaaccaaagggaaagattaaggtaaaattcacaagacatcatcctttataaactttcaaaattttaattcatcgggcactgaaattttgtcattatatatagcaagaattgcttttaataagattgcaaatgcactgcattttctctagatgcaacaaagccaagtatatataattatgtatgcctctagccttcaatctcttattttttattcttgtctttcattataacacatatctgaattattttaacacagataacttgttgcaatgcaattttgtcatccatgcatcctttaattcaagcatgcagtttctaggagatttctgaaacaattaatagagtatggtttctgttacatatgcattattatataaatcagaaaattttgttggtaataacttccatactcgaagattacttagagaccatcatactaagccctttatttgcatagaaaatttgatggtagaaacagacacaagtcacacaattaaaattggcactgctagaatttgaatccagagccagacttagaatcgatactccatatttatagttccttatcatgcccctattccagactgtaaccgtatttatagttatggttaaacctgttttgcattttattatttattattattttactgtcacctaggttgaattgcagtatcaaaaaactgtacgtgtagagttataacttcactgacaacactgtaactgaaaaatataatctaaatcatttgaaaataaaacaattgaatctaaaatatatttttttcgagacagggtttcactctatctcccagactggagtgcagtgacacaataacggctcactgcagccctgacctccacaggctcaggtaagtcttccacctcagcctcccaagtagctggaactgtaggtgtgcatcaccatgcctggctaatttttgtagttttttgcagagatggggtgtttcccgggcttgtctcgaacttctggactcaagcaatctgcccaccttggcctcccaaagtgctgggattacaggtatgagccaccacacccagcccaaataaataaacattgaaaatgaaataaatgaaaaacataaccatatttcaaataattcaccaatgtatgcacttactgatctaggcatttttacagtatgcaattatgtcatgaaggaaagagtttataatctcttatgagagagacagagaaaaaaagaaacaggaaaaatgtctccgtatattaggagttgaagactgaaattgctaagttcagaaaatttttaaaaaggtacagacttagaattttaaaaaattacacatggctggagacttcagggaatagcaggggggaaatgatattggagtaatgtcttgaagattgtaaagagtgggctcataaagattattttaaggatattcatgacatagggaatgaaatgacaaaaagcattgagttcaaatgtgcataagagaataaactgttcaccttgactggaacatgaaatatgatctcacaaagggtagggaatgctatttgccagtttaggataccaaactttgaatcacaggtgatgagtagccatagagaatttccaaatagaacaatgcttgcatttatgcctctgctgtggagtgtggttacccaagccaaaccaatcgcgtctctgtagttaatctctgggtgagagacaaaggggcaagctttttcaggtggactggaaatgagaaccactaagtgaagcaaatacagaaagaactgagttgatagttgagaagatggtaatgtttacattcctggaacccactacactttcctgcctataacagttagacaagaattttccatcaattgcaaccgaaagtattcccactcgtaaaaaaaaaaaaaaaaaaagaaaaagaaagaaagaaaaaagttcatctgacagcaatgcagcaatgttgccaagggaaagagatcaaaggttgtaaaaatagtaggaatctcttgcaggaggtaaaagggtctgacctttgaaaaagcgctggaatggaaaagcagggaagaattcagaggattttggaaaaaagaggcaaccttaaggagtactactaacattgtcaaacactggtctaaatgctttttaggcatcatctaatttaatcctcagaaaaatccatcataacaagatttcttttcatcatggcaaataagaaagtgaatatttagagaaattatgaatacatagcaaagctggaattcaaaccaggtctttaattcagaatacaatatcctaatttgaaatgtatgctagaaaaaggaaagacagaatgactttgctcttgataatagagaggagaggaatctttttggtgaaacagggaattcaagaggagaaaaaaataattaaaaggaattactatacttttaattttagtcacattagattttagaattcatacagaaactaagttattcatacagaaactaagttgacattttgcagtagctgaatatttcagatacaaatttggggaagatctgcttagcaatgacagtttgagtcattatattgccaagcaagagagtatagagtaaggaaacaataggatcaaaatctgatatacagagaagaagaataaatagcagccaaaacaagattgaaaagtaaaaacggaactagcatttacaatatcataaaagacaaagaagaaaaatgcattagcaggaatgagtgttcactcagtaaatatgtcctctgcatgaagataagacagacatagacagatagacaggtggatggatagatgagtagatagggatacatcactgcattcatacatagctctctaaatatctgcatcatctgcctctatatctatgtatatctgtgattgaatgattgattgtaacttagagcttcaagtgagcacttaaagtgaaaactttgtgtactgaaattacttacatcttttaactgagctataaagcactatattcatcattttatgttgtacacaaggcaattatgttgtgtttatgaacatatggcttcaaacactggataaactgttgaaactgatgggcacaaagaaacagaatactcaagaaacatctgatcgcttctgtcatttcatccatatatttcaaggcaaataacttataagaatgaatacttcctgtttcttaaatacatttcagtttcctgcttagctttgaatagtttcctcccttgattaatttagtgtaattatcttcttaaaaagaaatgctactcaagttaaataataatctttttctagaaaaacattttaaaactcgtatttcattgaatgagaaacaatatcaaagaaaacaatacacatattaaatttcaagaaaagtatttgacttctttctttaagaaaatagtttgaattaagaagaaagagtaatttccacctttaaaatgtcttaatggtatataatcaaggagattttattttaatgttataatgcatggtcagtttaagtcctgaggtgtccttttgaagaacctttatttttgcttattataatatttaaggcttcaaggaaatattcatttgccaggagaaaggaactcacaaggtagattgaaatgatttcatggaacagcatgaaatacagctactccctgccaaacccagacacaaagccaaaaggcctatgaaggaagaatacaggcacagcagttcacaaaagatgaatcaaaaggcaagttaaaaaacaaaaatatattggaaacatgctttcttaatatatgaaactataattattattatcaaatgcagaaaaatataagagtaaaagaattgctaagagtttagtttggcagatgaaaagagtaggtgcaattaaaggaataaacattttccctactgtacaagaatttgaccttcttttaaaattctagctctgatcccctgataacctgacaagggaagaatgtcaactataatcttaggtgacatttctacattaaattgcttctggatttgagaggaatgttaatacttaataggaagccatggctttgagcttagtgcagtggctcttgtaactggcatgtctcttcaaggaccctggaaattctgcctatagatttgttacaacagagattttggctcctgtggggctgaggattctgccagagttcccatccccaaattatgtagactttgtctccttgtctatgagtcatcatctaggcagcagttcttaacctggggtgattttgccagtcagggacatttggcaatgtctggagacagtttttattgtcatgacataggggagaaggacatattactggaatctaaagattacaagcctaagtagcctctaaacaccatacaataaacaagctagagcctccttctccaccacaaaaaaaaaaaaaattatattttgggcaagaaaactgtgttggaagactgccatatgtgtttgggacaattagcagtagccatggtctctactctctagatgccaggagcattcattttcctccactgattcaattaaaacatgtttttagacattttcaaagatctgcagggaataggagtggaagggcatgttggcaagctattgtttctgtcttatacccttgtgtatgaatttgataccaaatacgcctctagtagtcccgcaagtttaaaagcagtggaatctaagacccttggtagattattcaatacaggaatttactacaaagtaaagttattagtgtcacataatataacccaacgtaatatgatatatgcaaaaccaaaaaatgtgtggctagtactaaatattaaaatatgatattacatcaaacaattgataataaagatacaattgctaacaacatataagctaaaattctatatgaatactgcctgtaggtggattaaacactctagtaaatgtgtatctcttgctggagggagaggaagttatgtctttctctcaaatactgcctttgatttctcactttcagattggctttatcatgcattaattaaagtactcttttgacaatcaatttcttacattgttgcttaacttctgaagttctttgaatttatttttttctaatcaaagaccaaaaggcatgggtctttgattagaaaaaattaacttaaactctgtaagttaatttgatagcactttatatttcccttagcactaagcatattattgttggtatatttaaaataaattgataatatcacaggaatgttcatatgatatattattgttcacctttatgtgtgatttattataatcatttattattattacctttgtgttacaggggagatgatcatagtatgtgtgaaatgcccaaattctgtatttgggaagaaagaatttaggttttggaagaaagacaaattcctttttaactaagaaagattatgaaggcacagaacttttatagtcatacttatatatttatatatgtgtttatgttcatttttcttagaagaaactatatttgcataaagcaaaaaagggaggaaagaaaaaagcccccaggaacagaggcatgtaaactttttattgaaaatttaactcagtggggcgtagtggttcacaccttcaatcccagcacttgggaaagctgagatgggagggacgcttgaggccaggagtttgaatccaggctgggcaacatagcaagactctgtctcttaaaaaaaatgtaaaaattagcccagcatggtggctcacacctgtaatcccagctacttgggaggttgaggatcgcctgggccaaggagttgaggctatataagctatgattgtgctactgcagtccagcctgggcaacacagagaccctgtctcaaaaaatggaaaaaaaaaacctataaaataaatttaacttaatcacatatgtgaagggtttcaaggggagaaaatatccttacggccttatggtattatggaaatgatataatgatattatccagttgaattcatttttgcacagttggggtggacagaagtacctagctgacaatatcaataaaaatgagtcttgcctggcttaatttgtacctttaatcattctgttaaaactagctggtcactctcccacttctttgcatagatgctgaaaaataaaaattttaatacatacactttatctaaacattaaattatggttgtacttactttaaggtagcagcagagaagaaaccagaaaaataaactatgtgcttattttccttacatgagccacatacttgataaactgatcttcttttcagataatgtatagtcaattgctctatctgaagatattatatattatatatatatatatatgcaatgcactcagtccttaagagactgaaaatttctttctattttcttgaacaatttccttagatggttatttgccccttagttatatatcatgctgtgttctctggaagaatgaaaatatagagagcaaggaaaacgcccagaatgtcaggagcagttcaactaaagtatattcatcctagaaacattctggaaaataatgtttatttgtgggaagctcagttttcaaatattcaagagtaatgtaaatccatggaaagataaagtaagatatatgttgactggaaataataatcctagatcttattttgtacagagtttaaattggacattatcttataatacattgtttctatatacattgtttcttcttttttaagataagatcttaactacagagaagaggtagatgatggaatatgtaaaatagaaatatttatgtaaataagtggtaaaactaagattctatgagtcaaagaaaatcctccaagtcaaagctctcttcgaagtcattatccttatagtggcaatggatatatagtcttaatgcagtcatcaccaaaaacatctggaaaataactttgaacttaccattaatgtttctaatagagtctttggaataatctcaaaggtaagtcctcaaattttgagtataaatttatattatgtgaggaaaccaaaggctgttagaatcaagtcattttggcataagaaataaatccaattagaaaataacagttcagtgtaaatatatacaaccattagaattatttcccaaactatctatatagccaatattacaggatagttctgagaaaggcaatactgaaacaaaacctagtgattttgaaagaaatatatcatctaatgtgtgtcttcaaaatgaagttttactttgaagctctaaattgtcttctacatactaatgctagtgtccatggagctatcaataaagatctttcgtcatcaccaagaggcagtatagagggttgcgacttagctaggacttaaatggcaaaaagattggaagaattgttataaacagaagaggagcataaaagcctagccagagaggcaacattgaattatcatgcttatgggactgagaagagatggactgaattattacagaaaataagaaacagagctggacaagtaaagcttgttcaggctactgagctgaaagtcattattaccctcctaataaattaaaaattcattcattcatttataaaatttttggatagcctttttgcctggcctagatcctcttgtatttcctcttttatcaataattaccttgtctttgatatcagttttagataaatccctggtcacactgatatttccagaacaattttgcttttagaaaatcacaaaattgttatattacctcagtacactaattctatctcaacgctacagaatattacccagtaactcatctaacaatagtgaacatatgtattacagcactttccaatctatcattaattttattttgctttgtcaggttcatgatattatgcttttgttgaatattcatttagattaaaagtaactagcatactctcttcattagatttcttgagaaaaagcctcaaaaataaaaccctgatctctggctctctctccttcacctaatttggtcttgcttgggaaactgaaacaggtgaggaacatgggtttatcaatagccctgattattttctttcataatttttctttgtttggaaaatacaaattataaggggtatattaattagatttggaattaggtaaaaggcagttacttaacacaatctaacactaacatctgtctttggtttttagtatatattttataccgcttaacagaaatatcatgtcattagttgaaggtacaacaaatgtgcatctacatggtggagatttaacagcaaaagtgacattcaatgcaatatattctccagttaattttcaaggaagtatactttgaaatatactcacattactaaaagactttaatagcgctttgagatgaaactaaaggacagcttatattacaaataaaatgttatagtttatcaaattaaaattgtagcatataattttataagtgtaagtatacttatataatacagatataaaaacaatactttcttttaggaagacaataagcatatcctgtatcctgttttgtttttgtttttctttttttttgagatgagtattgctctgtcactcatgcttgagtgcagtggcaaaatctcgggtcactgcaacctctacctcctgggttcaagcaattctcctgactcagccttccgagtagctgggactacaggtgcacaccaccacagccagctaatttttgtatttttaatagagttggggtttcaccatgttggccagaatggtctcaatctcttgacctcgtgatccacccacctcagcctcccagagcgctgggattacaggtgtgagccaccccccgcccacatatcctggtttcttatttaacatatatatttggaaatccaatggaacttttatataattaatattcaaacaatcaggtactttgtttagaaagttgttttagttgttcaggcgcagtgactcacacctgtcaaatcccagcactttgggaggctgaggttggtggatcacctgaggtcaggagttcgagactagcctgaccaaaatggagaaaccccatctctactaaaaatacaaaattagctgggcatggtggcacatgcctgtaatcccagctacttgggaggctgaagtaagagaattgcttgaaccagggaggcggaagttgtggtgagctgggatcacgccactgcaccccagcctgggcaacaagaatgaaactccatctcagaaaaaaaaagagaaaaaagaaagttgtttcagttttgttcagtaagctctatacatactatgatttttaaatactatgaataaattaatatatgtaatatctttattttcaattatgctattctaatgctgcttcaaataaaaatgagccaaatattcaaaaaaattgtattatcattccaaaaaatgggaataaattaaacaatggacaaaattttttaatgttattaaaacattacattgtactttgcagttttacccagaaaaaccttttaagtttaattttaaaatacttttgtttcaaaacacttatattttcaacttcatactctggtccataatctgtgtggtaactggcaattgtagaagttaaaagtcataaagaaaaagccttttgttttctaaaaattagcaatgtgaacaagaattaatcaaactatttcattgtagtgactatgttactcttaacaggatatagaatggtctaaaatatctctaggcttctgtccctcattatgtacaaattttaacaagaggcattaattagtgagagtaagtaattcaaaaagtttgtataaacattataattttgtaagttatattgcttccttttaaacataacattagctaagaataaacctcatttggatatttagaactataagtggatggttccattatttacattatttagaaatatatatatatatatatacacacacacacacactatttccttttagggatggacgccctacactcattgatgtcctacatacaattcattctgtgctcctttagtttttttgagtggttattgtttaattggacgcaagtaaaactaagcaagtaaaaatatcttgaaaatactggattttttctatcttatttattattgccacctcttttacattcttttatgtcttaaaagatgaaattatacataaatatgtgtgtgcttgcgtgtaaaataggcagttccagaatttgtcaatgtaataaacatcttatggaagaaatctgtatgcagcaaatcctcagctatccctgatacttaagtaataaaaaaacagctgatatggtttggatctgtgtccctgcccaaatgtcatattgaaatgtaatcctcagtgttggaagtgatgcctggtggtaggtgattggatcttggtgtgggatttctcatgaatgggttaagcaccattcccccttggcactgccattgcgataggatagtgtgagttctcatgagacgtattcatttaaaaatgtgtagcacctcccaggttgccctcttgcccctgctctggccatgtgatgtgcaagctcccacttcaccttctgccatgattgtaagcttccagaagcctctccagaagcagatatcagcatcatgcttcctatacagcctgcaaaactgtaagccaattaaacttcttttctttataaattacccagtctcaggtatttctttatagcagtgcaacaatagactaacaaaccaggcatgcatttttttgtgtgtttacacaacaaatttactgaacagctatcatgtaaaatatattatgctgggaatacaaaatatataaagcatagcttgttatctgcaatgatggacttaattgctaaggatgatacaaaatatatatagagaggtatacatatgtatatccacatatgaatgatataacttagtttttaatagtccatattaatatttcttacatgtagcacaggtatccaagttaagcaaaaaataaattattttcaaattaaaaaaaaatcaggatgaacatggtggctcgtacctgtagtctcaacagtttgggaggccgaggcaggaagattgcttgaagtcaggtgtttgggacaagcctgagcaacatagcatgacccggtctctacacaaaattaaaaaattagccaggtatggaggtgcacacttgtagtcccagctactcaggaagctgaggtggaagcattggttgagcccgattttactgaacaaagctgcagtaagctatgatcgtgccactgtagttcagcccgggcaacagagtgaaaccctgtctcttaaaaaaatcactataaaagttagactgtttttcaatttaaaaacattatctgaattcctgtactattagttttgcaagaataagccttagataggcatgtaggcaagatctgctggcagagattacatgcctggaaaatgaacctttgatgtactcaggaatattctggagttgttaccagttatttgtacctgaaaaatagtgacatataaccaagttcttcagaagatttggaaatatatggaagggaggtccttgaaagccatgataacatgatcctcacctagagctggcaagactgcctgcatccagttgccttcctgggcaggccagggaagttttcctctgagaggaaatgcagttggattataacccctgctctgggaagtcaccttgggatgcagacaaattgtatcatttttacctacattaaaataactaaactttgcctgtgtctatcggtattttttactcaattatgttcatccctgtcacactagagacaactgtgccactgtttattgtcattcctattatagagttgaattttaaaatcttatgctgaatttattttctagcggactaattaagaagcaggagaaaggaaaaaataggaaatttagttaatcaatagaattctggagttaagaatattctatggagaacagagattctgatttcttgaaactttaatttgaagttcgctaaagccatttgggttctgtaggttttactagtatcagcttctgcagaaaggagtgagcagagtgaaaactgattgcactaatagctgcaggaacactgaagctttgtgcataactcgaagcagctcagaattctgtgtttaccaacaagattgaagtgttccaaattacatcaaattcctttgtggtcacttaagggtatctcattttttagaaaatgggaagcagtttcactctctttcttttctttttttctgaaacctgttttcacatgatcctcatacccatgaacagactgtcatgagtatagaggccagtgagaaaaaggcaatattaaactgctgaatgaaacctgacatctaaaacctgccttatttggagaaaaaactcataatcgattagaaatcagccaggttatttggcatttgtttgcaaatatcagtttgcgtgtttataagacaaatagcatatctggaatctgaggttctatagaagaggggcagggaatggttaagcagcacccagaaccttgtctctcaccccacactcacatatctcatgcataaatacatttgtctcatactttaattattctctcaaatatgaaatagttcattcattctgccaacaactttaagtctaatataaaaatagacattcttggactaaattctattttcaatttcctgagttacaaaagagtcagacaaaaatgacatcgtttattgaagtgcatggtttcacctaattcatctgtttaatgaaaacttgatattgtatatttaacaaatagtatgtcaattaaaatttgcagtagcactatcagaggttgagtagattgtgtttagttttcttctttttcagcagtgtctttaccattgggcagcccagttaccagggcattctgtaaaaaccaaacaatagtaacactggtacattttattgaccattaagtgtgtggatttaggtatttttaatgataaaatcaaatgtaaagtccataatatctacatttttaattagaactataaccgtgatttcagtaaaaatataaaaatagtttaaaatgtatcttattcaattctcagagtaaaacaattacccgctaagattaaatcaggcaaaaattcagcacctaagactttcctgaattatcactatattactagataattacgtaattcactgttacaacttcaggtatgcaaatataacatttcaatgattagatctccataatttaagcaaagagatgcttgaaataggtagataatttgggaaaaggacatgcaattgcctgaagtaaaaacatggactgtgaaaacaaacatgtattacaacctgaattagcaattacttccagtctccactttgcttattgcacatggacagtttctcaccatcaaccagataacaccatcataattatcatacacacacacacacacacacacacacacacacacacacactaaaacaactctttctattagtgtgtataagctcatgcaaaaagcacatttagggtagattatagtttaaattgtgtatcattaatgtagaatgtagaaatagttcattcaatccaatgtagaaatgtagaaatagttcattcaatctagttacaaaaatcacctcatattaatagtagaataatggtaacacttcttcccttgtccccatatggaaatgcataaaagggaatttacttacactgaacgatgagctgcaccaaggcttcccttggtttcacgttaaatccattgtattggctggtctgacatctgtacattcctgacatttccctagatacattcacaatcctcagtgttccatcataactctccatttgcattgatccatcaggcattgcaacttctttatccgctctagaccaaaggatgattggtttaggtttgccagttacttgacattgcagttctattgtgtctccttctctggtgaccaatggtgatttttcctgtggaacagtcagattgggtggaacttgaaatgggaaaaagaaaatttttcaaggttagtataaactggtaaagcatattcagatacagaaaatcataaggaaacaatttctgctggctgaagaaatgtgacaattcggatgatcaaaaaccttgggaataaatggaatatactctcactgaaaatcattcttaattgttttcactgtatattttaaaatgaggacttcaaacattagcaaaataaataaggcattcaattgaaaaatggttaatataagaataatcttctcaatgacctgtaataattagccattaactggggctttaacatttgcatttcatagaagagtagcattcagctgtgtagactcagtagtcacaataagtgcaagtagtcagaaagggaaaaagagaaacctctgatctaaaatcaaaagttttgactagtttaaaacttgccaaattgctaagatttaggatttgttttttgcctagtgggagtgaaatcaagcaatttgaaaatccattctattctccatttttggacttttaattttttgtgatatttgaatttattattatttcacttcataatattttgatgtcattgtaaatagtttgccataatattgccaatatttctacaaaattaattttaattaaatcttcaaaatatatttcaacgaatataaaaattataattttggtcttgcgcggtggctcacgcctgtaatcccagcactttgggataatgaggcaggaggatcacgaggtcaggagatcgagaccatcctggctaacacggtgaaaccccgtctctactaaaaatacaaaaaaattagcccagcatggtggagggcgcctgtagtcccagctgctggggtggctgaggcaggagaatggtgtgaacccgggaggcggagcttgcagtgagttgagattgcaccactgcactccagcctgggcgacagagccagactctgtctccaaaaaaaaaaaaaaaaaaaaaaagaattataatttttctcgagtaaagttaatttctgatttacagagaatatttatgagaagttagattgattttactgtaacttactttattgtgctgaaatatatttatgttagaatttagtgaaaaccattaagtgatatgagggaaatactatacaacgatctttcttacaaacatcactagttccactggaagattcttatttcctacacaattgtatatgaattcaaatgcatttgtgcagtagaacatctatcaaaaaagcacaagctaaatagaatgctataaatacgaataaccagaaacatgaataattctatccttccgataaatgttatatgttccctttggaagtagtactgcacatgaatgaaaagtgaaaggttttactcttccttctagtttgattatggcccactgcccaggtacaaaaccaaacataattatgtttaaaattatttttcaactaattttgaaatgttgttttcctcattatagagacaaataaattcaagttcaaagtgatatgacaattatcttcctattcaaatatcttcaattcactttttcatttaattccttcacttattgtttaaaacactaattacataatgcataacgtcttagaatttaaacaatatgaactattcaccaccaccattttgaagtagatatatacatcctagaaattgacattaacaaaatatatgtttaaaacggctccattttataaacccaaatgggtaatttgttctggtatacataaacaattaaataattttggcaaagtatttgttctttttgaagtgaatgatgtaattaaaatctaagcagcatgctcagacaatgggattggaatggaactgtgacacttattcaccctccatgggaaagggtgcagaataacctcagcatttaacatttattatccccctactatgtgacaggcacaattaaggattttatgctttcatttaaacccccttgataatcttaaggaccaaatatttaatattaaaataaacaattaagaacattgagaataacagataataaatacttcaatttgaacagaatacaaacaaaaactaacttatagcaggtagctaatgtaaagatatgaatactgaagcaggttcaataaacaatggtatctggaattaataacttttgagcgttagcaatagactcctctcttcctgctcatgacaaattggacaaaatccctgcctgtcacttggtcactgtttcaaatatgaaagagtagagatgaatgtgagggagtatacagtaagtattttgcaaattatcttttctttcttttatcctcttattgatttctttagtcatttattattgctatcacagtggataaggccaacatctatatttcttaaataaatacctcaatcatctatatctgaatatgtttcacatgtcaaaactgcttataagatataccaacctcaaaataaatatccaaatttagataaatctgtgtaaaataaataaaaaatgtataactttaaagactaatggagggttattacttgaaatatacaatccatatctgttccaaaaacaagctacctgaccttggccaaccaaaacaccgtctgtattaattttaccttttgttgatgttgttgttttgagatggagtctcgctctgttgcccaggctggggtgcagtggtgcaatctctgctcagtgcaacctctgcctcccgggttcaagtgattgttctgcctcagcctcctgagtagctgggattacaggtgtgcaccaccacacccagctaattttttcatatttttagtagagtcagggtttcaccatgttgaccaggctggtctcaaactcccgatcttaggtgatctaccctcctcggcctcccaaagtgctgagattacaagcgtgagccaccgtgctcagccttaccatttttgaaactaagaatttgtactttattagcctcaacgttattgatgttctgattacaagaatgaatagtaaaaagttaaaaagagaagtggtgtcaaaagatagtatttatttcctaacttaataaaatggatatttaaacaacttattacattagaccgttcaaatcacaatagattattgactataatttttttaaatgttatcatgctaaatatttcaaatatcccttttaaaatttgtttatgtttttcatgtatttagataaactttcctccctgctgaattaaagttacagaaatataaacctcaattttaatctcaataacataaaaattgatttttagataaattagcccaggttttacaaaatagcaaaatctagctaaaagattatttaatatctgtctcttcctaggctagatgcggtggctcatgcctataattccagtactttgggcggccgaggagggcagatcacaaagtcaggagatcaagaccatcctggtcaacacggtaaaccccatctctactaaaaatacaaaaaaaaaaaattagtcgggcgtggcagtgggcgcctggagtcctagctactctggaggcttaggggctcaggcaggagaattgtttgaactcaggaggtggaggctgcagtgagccaagatcataccactgcactccagcctgggcaacggagtgagactccatctcaaaaaaaaaaaaaaatagattttaaatctagaagtcagggttaacctttccctacaactctcctggccaaaaagactgtataatttctcaaacctgttatatgtttttctatctttctgtccccactaaattttctatctctaagaattactcaactctcttaattgttcttataattttttctgttgagagatctcatttgttctcatagacttctgttttacgtgttgataataacaaattataactttattccaatggctcataattgcagcctatctttatattccaaaagtctttcaagcctaagcaccattttatttcttgacttggttaatagttaatttcaacagattccatctattaattgaaaaccatacagtattatttgtttcaccatttcctcttgtccaccacttcaaaacagccatcaaatcttgttatttctttatttaaaactatgtctcatatctgcctgtttcttttcatggccataggcagttttctcagtagaagtcatcattttatcttcttgtgacagcatcctaagtggtctctctgtcactagcctcattcttccaggcttcctgctgccctaagctttatcatcataaacagttttgttcatgtcagtatgaagactacaaacctcaatgagagtgcttgtcacaacactggtttaatttaaaaaacaacaacctgaaaacagcttaatggagttgttaaataaatcataaaacagttgaacaatagaatatgacacagtctttttaaatgatgatgtaatagacctatatttattgataagacatttatattaagtgggaaaagcatgttagcaagtagtataaatagctataatgactattattcagtgtgtaaaacatgttactgttcagtataaacagttgtatctaatttttatatattaaataactacatattagctctcttggctctctctcacacacacacacacaagtaactatgcaagataaggaatatgttaacttgcttcactatagcaaccatcttactatccatatgtatcccataatatcatgttgtaatcctcaaatatatacaataaaatttattttaaaaaaattttcaatgaatgttaacagggagcttcttgaagggtaggctatacatgctctgtctttacattgttaccatctagcataccatctctcacatagagaaacacagtacaaaattttacacctaatatatacattaaatagcaaggtaattgggcactaattcagggaagaggagacttacatggggaaaagtctagaggaaaagaaatcctagaaagaactataccagaacactaacagcggttctctctagagtgtgggattactgataaattttattttctttatttccctcttttttttactgattaaacaatatatatagtgcataataacatattacagggcccaagaagcccagaaatttttaaaatgttaattcaatctatttcccaaaactcattcaatgaaaacttcacattttataacacaaatgtatcactctggaaatgatgttctgaaaacatagactgagaaatgctcttccaaaatcactaactcctgttaacactcctttactgaagtttcaccaactagttaacctctgagcccttgaatgagcagttcttttccatggtcagagtgtctggctcttgctgtcttctagcaccctctgtctgccccatgtgttgaaactcagttcaaatgttattccctttgtaaatccaggctgacctggttacttactcttcctgactacacactacgttgtatgttttacccatttaacctgtccttgtgactttgtcctgtattttcttctatgtttatatccctgaccaggcagctccttaagggcacagagccttaatctgtctctaaagtctagtgtcttgctttcctgtttggcacagataagaaagttgtgaaacaattgagaaagaaagaaaggcagagcagaagaagatggtaggaacataggaaaataaaaagctatcaaaataatagataatagagataaacataatcaatatgaatcatgtatattttggaacaaatgtgataaataataatgaaatatagtaattctacaattagtagctcctacaagtagcataatcttatgcaaaatatattgttagaatatacttctgatgcagatcttgagatgtgtgggtgtgtgaaaaagttaaggaagtcaagaaaagactcttccagttctcttttttctttcatttaaatatttgaatagataagttatgaattattttttaaaaaaacagaggaaagaggcaatttgaagacatgaaatttaattttatcatttggtttttaggtcttaaatcaaattatttaaaaaaattgtctcataatgaaaacgtatcaaatttagcataaatatttgaaatgtctataccatgtaagatccccatttatgcaatgtacttgctagaaaaagtcactcctaataaaaatgcagatacattctctaacatatagtatatatgttacagtatatatgtgtatatagtctatacacagcccttgatatttttttgcctgaaatactactgcaggagatgttataatcagagaaactggaaaaacatgatatgacaccaaagtttctcattccaaacgtaaataaatagacaaatgatttgaacacattgcttttctgtcaacttttccactgatcacagactgtaaaatgaagcaaatatagaaaaagaaaatattttcatttcttcattgggaaggcagctgagaaaattttatctttattctttacttagaaaatggcttaaaagaatgcagaagtttagttcatttgaactatgtggaaaaatatcatgctgtctgaaacaaagacatctgaatgtgcttttaatggaattattggtttaaaaatatgactgtagtgcactttaatagtagatattgaaacaaaagctatatttctttcaatataagaatcataagaagctcagtaataaataatataattttcttccaaaagacaatcagactcatatttccaagaatcttaaaataagcatggcactaattcaattacacctgaattttggagggaagtactttataaaagatatgtatgttctcgagtagaatgtatagtctatatttaacatataaataaataaaacttcagagatactatgtttatgaaagttacccttagagaacagaattcaataattctcatcctgaccagatataaacaaatgtaaaaaagtaggactaaagtaagtagtaaatttgtagatgcaaataatccaaatgaaccaaatctatgttttttttttttttttgtgtgtgtgtgtgtgtgtatgcacacgcatgcaggtgcgtgtcttcaaaacaagagatgggttaaaaaaattgctgtagatttgatgagtttcatctttggtgatctgattgagactccaaggtaagcaacatcttcatttcagagcacagttttaaaggaaagatattctatcacacttgagtgctgtttcagtgtttgtgtcagcagtcctccatctcttctttgctagcacatttacagattggcttcataagcatgagacatgcacatggatatactcggattttgaagttttgagaagtcacaaagtagttttacatagaagcaaagaactaaataatttgcgtttgcaacaactgtcaatggcacatcactaatgatagctcacaacaggataagtaagataagcctctggttaagtgaaattgtcagtatgcttgttgtaactccactcatttctctttcattcaagaaagtacattcagtgtaagtgagaataatgtcatgactctaatctgtattttaaaacctccatacattaatatttgaaatattataattatcatatacctcacagatgatgtgaacacaccactaagatttagaagaattgccttaaaatacaaaatttataagaacaccaattgtcagtggccactggaaaatattcatataatgatacaaggcaaatttgagaatttcattctattcaaaaataattccattccaagtctgaataataccttttaaactaatatgcttgacccatttccagtatgattataaccgcgtgtcaatttttaaaatacagtaatgtgtgcttgagagatgttcaggatgacaaaaaaaatccaacatgctagacattcctcatttattaatggacctgctgatatttgcttccttttagagatcatgataggcaacacacggtttgatggaaggtggctaaactacagctcatttcttattaaaggaataaaggttgctattggatacttactagaaacaattcttagtatataaaaatatgaagttaacatgttgagttatataatatgcagcacctaaatttttttgtgtgtggtggtggtttgaaaatatgcagaacttccctgagccataggttgatataataatattatattgttacatgtccttctgggttgtccttccccttttaaatgaattactaagatctgattgactaatgtctcttcttcatctaaaaaatattatttaccatttctcaattactatttcttaaaaatcatgtcactatattatttcaatatctacagtagtttcccatttaccagaacagaaggtctaaatcccactgcttgttttccatcttatttgtcaaaccttaataagccacagtgtttctgtggaaagctctctattcaattgaggctggtcttttcaactgcttaacatacttgacttattcccattgcctcaccttccttcctttcttctcttcaggaatgagtttgacctcccaaccaatgattgttacattctttaaggtccaatttaagtttcttgttctatttactcttttctgatttctgcatcttttattcatcttccatgtctctgaattagagcatgcccaatttattctgtacatgtcatgacgaaatgtgcacttacatatgtaacgaaaatgtcctgatgtaagcatcagggtttttctatttcttcagtagctcccacatcatgtaacattttaaaggtttttttttttcaaggtgcttaataagttcttgattgattgatagagcacaaatcaaggttactaagcaaccaaagtaagaaaaccattgattaataatcagctcttgattatccaaggcttaattataaagcatataaatttcaagatcatttttcatatatgaactcttttattttttaattttaaacatccaccaaaaaacaatagatttttataatgttagtacatctactagactttgatttggatacagtaatgatgcaaggaggtagaaataatacactaaaatattggaagcacttggtaatattgagtaatttgtccactccatgactttcctcaatcagcagtaaaggaaaggctagttggccctatgatagaatgtccatgtggatctatattctaagacttgtattacttgcagtcctgtgtgtaaatgtttcctatgtgaaacaagcatttataaatatgtcttcacaccagatagtatgcctaccgtttttgtccataatatgaataagcataatacatctcttatcacactctgtaaataaaaactgccttttttcacactgacacacacttttaagtacctcacacatagtaaatcagaaaatgctaactaaacaggattgacaatgtttacaaatctagcaattgaacaggaagaaagcccacattaaaaacaaacatgaggttaaaataccacagcatgtgcatttggaagttctaaggggaaatgtccacgcatacacacacatacataatgactatttttgaaagaaatggggaaatcttattagaacggcattgttcattacttgaaacatatggggagaaataggttcctggagggtagcaactctaaaaggtttggtattggagatggggagcatgcagtgccattcaatcaggaaaacaggtttggcaggcaacagttgtggctgttccaacttccctcacccagcaggtgttgctatggcataagaatagtctctgagggattcaatagaatacaaagtgtaagatgaaagaacaaaatagaaaatcattctctgcatggcattcatattttccctgctactcaagctacaagaccagttgcaaataaacacaggttctattcttgctgcctcatgaacagataagtgaatgggacttcagctaaggttgctaaggtacgatttggctaagatttcaagtatcttgaattgttatgattttcatataatttggttttctaacttgagcatataataaaatattttttagaataattaaaataaatctcttaagagaatgtcctaaactctttggaaaaaaaataaaagcaaatagttctttctttttttaacctccatgacttgtatgtttctcacatactaaaatacataaataaataataaacactaattaagtatataaagtctcacatgtggaaaactttttttttctgaaacaactaagtaaacaggagcaagatatttcagcttgttaaagaattatgtcaaaattgtagtaagcaacaaatatgtattagattgagaatgttggagggaatagggactctacaaaagaaacactggatttgctataacaagaaagggggggcaggcgcagtgattcacgcctgtaattccagcactttggaaggccaaggtgggtggatcacctgaggtcaggagtttgagaccagcctggccaacatgcagtaaccttgtctctactaaaaatacaaaaattagccgggcgtggtggcgggcgcctgtaatcacagctacttgggaggctgaggcaggagaatcatttgaacctgggaggcagatgttgcaatgagccgagattgtgccactgcactccagcctgggcaacagggtgagactcggtctcaaaaaaaaagggggaacatcacacaccggggactgttgtggggtgtggggaggggggagggatagcattaggtgatatacctaatgctaaatgacgagttaatgggtgcagcacaccaacatggcacatgtatacatatgtaacaaacctgcacattgtgcacatgtaccctaaaacttaaagtatgataataataataataaagtaaataaaagaaagggggtatgataagatgcaaaacatcaagtaaagggctgagatattcatttactaagaaatggctaggtcattcgatgaagaactagtcaacctataaccatttctgagaactagaaaccaattcctcaaattaactttcttaatcaagttttagttcatgtttgttattttttaaaataatgcagagttgttctcactcataggtgggaattaaacaatgacaatacttggacacaggtaggggaacatcacataccagggcctgtcatggggttgggggagaggggagggaaaacatcagggatatacctaatgtaaatgatgagttaatgggtgcagcacaccaacatggcacatgtgtacatatgtaacaaacctgcatgttgtgcacatgtaccctagaacttaaagtataataaaaataaataaataaataaataaatataaataaaataatgcagagtaaatctggaaaactgtatttatgtataagcagttgataaagaattttaaccttaaaagttgaatactgcactccaaacagtttattatacaaactactaataataggcaggaggatcctatagctaaaaagccaactacgattcccaaattcctacagttcttatattccataatatatttgcatccttgcctacttgctcttagaaatggtgccatgatttatccaaatacacttatatacatttacacaaatgcgttatcctttaaattaatagcaactactctgggagtaacaaaagcagagccacatatgttacaatttgtacccaatgttagagataataccaatttattttaatatacatttttgattcccttcaatagacaaatatgcctaggactaggggcaagactgataaatttggctattcattatcttcaagaattacactatatattgtgaaaacatatatttatatttcacaagacctacacttcacaagaagtaaggcttcttgtagctgatggttgctaattattatttccaaattaaaggatttttttaataaccatggagagtttggaagacttgtaaatttacaagattagaaatttgacctgggctcaggttgtaatccacatactagctgtgtaaccttggcaaagggatttcttaattttagttttcttatctgcaaattaagctgatgaaaataagaatttaatgagtaatgaaaaaatggcacaatgctcatgaaagtgtcctctaaacactttgaattttgtaatatatttgtaaagagcaaggcttatgtctggctgcctagattcagttcctagctctatcacctactagctgggtatacttgggaaagtaggcaagtctgcacctttcagtttacgtaaagtgagcataatcgtacctacttcacattttttaacactcataacctcttaagccaaggtatggcatatagtaaacactccatatattaatatgttagttattactatgttttcttatcactgtacgttgtgtatcaataaccatactttattattatgcatacatttctatatagattttgttttattcatacttatgatgtctcgagtactgaggataggtacttacacggtcaaacaaaggtttatataattcaaatatataaatatatttatacctatataaataaattttattgctgttgtctgttgtccaggagacacatatgcattttacatgaggatactatttgaagaaaatgacattttagaaaagacaggaataaaccttttctaatctgaatagtcagaggcattcccccaaagccatccaaggaaagaagattgcatttgtctcccattagacataataatttgatctatatgtttggttactataacaaaatggcacataatacagatatctcagctctcattctatttctatgaaataacgagttttggacatccctatatacatctactcctcccttacaaggataacaaaatgtcagtgctgtccatttttacaaaggtcagggtgttgccatgaaaaccagggactagtaagttataaggaactgtctgatcatgttaattatgttattgctttctggtggataaaggaattctaaattaaaaggaagataagccataaattatacatcaaaggcattttataaaagcattgaaaaagaaagatgctttaaagtaattcacaatttattttaccttctggagcaactgttgctcacagtggtaaaatcctcaacgcagaatggccagaaaaaatcaaaattttattacttctgcaataaaaaggccatttgtctccttgtagaacccatgtgacattgttagctctcttataaatgatcaccctggacaatgcctgttttacaaattccctaattacaccactgattgtataccactgaatatgccttatcctgtagaaatagacactactgccaccttaataaacattttgacataaaacgaagctggctctctcatcttttgtcaagagcaaaatgaaacaaccagtgaacacaatgttccatcaacagatcagggtcacatgttctttagagcaaatgaggtttaattaacagatccgttaatagataactaattaaaaaaggagtgtcttcttatagctgcatgaaggccttattaacaaatattctactgaagcatgattgcattctacaaaccattctgctagtctgtagaagtatacagaagtttacaataaacatatggacctaattttaaaaccacataaaaacttatataatgtgattgattggaatgatagataactcattctggactaatacgtgtgaagagtttaatacaattttttaaatatggttttacattgcattttattcccaagaaaggacatttctgtttaaatgtcaactatatctattttgtttacaagtattatttagaaagccatggtaaaagtggactacttacgtttcatttacagtggactgtcattcatgccaaatgcattttagacatcgacatttaaactgcttgtcattttattatttctacttcacatacttaaattaccagcatacagatacaattcttccttgatattcacaggacatggagatggaggtgggggaaggtattggttccagaccacatcagataccaaaatctgtaggttttcaagtcccttatataaaatggcatagtatttgcatataacctatctcatcttcccacacatgttaaaaaatctctagattagttataatatctaatacaatgtaaatgctatttaatagtagtactatattagtttttatttgtataatttttattgttgtatttttaattgttttttcttctgaatatttttttataatttcgacttttattttagactcaaggggtacatatgcagttttgttacatgagtatattccatgatgctgatctctggggtaggaatgatcctgtcacacagtgagcacagttcaagattgattgaattcatggatgtagaaaccctatatatagagggctgactgtatttcctttcatattctgcatagaatgttttcaaaagtgcagtggcagtcttctcttttcacatatttttggtctagtcattattgctgacagaacacctataaaatttgggaaattctgatttctttacccatcatatacttggagaggattccactgttctcaactctttccctcccctgcaaatcattgctctgcaaccttttctaaagcttttggccctgatcctcagcatcctcttgggctaaatttcacccaacaggacttgccaggctccaattccttagtcaaataggtcagaaggcagatacaatgtgatttgaggtttctaaaatggattccctcatcaaaaatacatttctcagagtgtatctctggagcctaaaatctcattacttgagcccattccactgaaagactgtgtgttctgtgtaaagaaccaaggttcttcagccagaattcacctatgttcaacactgtatgtcactacttagtaactgtggtgtcaataaaagtcaggcctacgctttctacagcttaagcttctcatacgtaaaatgaatataatcacaaaatctgcttaaatggtgtcctgaggcgtcagtgaaataccaactgtaaagtgtttaacctagcaatgagaatgtaagaagcattccaaacaccttagattttctgtctacttgtaacttactttgaaatacttcagcatatggcaacactttgtatcttaaatttggtgttgacatgggtgttcacaaaactgcatgcttacaatttatgcatttttctgtgtttctgttatacactgaaataagagttgaaaaaataattcaccataaacaatgtgaccttcatttgtgtgctgtaaattttattgtatatactagtgatgctgttaatataatgctactcatgtgtatccactccagttgcagttagatagcaatttagaaacccaaaccatgggtccactgttttcaggcagctaggagaaggcaagtatcatcttgatctgaactaaagaaattttaatgtagcatgatgttgaatatggtcttccatggtgaaataaatactattaaagatacttgcattggtgagaataagtaagatctctcccaacttttgggagcgggatatgggactggcaaggagactctaacatcctaacactttttggagtggcatccttggaatatggctctgataatcttgtgccccatgatcaacagaataagtcatcacatgatccaactagaatgttacctgaatcacttctagaatattgcaacacctgtcaacaatgaccatttcttgcaaggcctttgtcaaagggatatgactgaatatttgaaatgcctgagataataaagggaaatattcatttaatctaagattttaaggcatgctgcaagctttcatactggatttgaaatctgagatttcaaggtcaagtcaggtggaagtgaacacagtatatatgcttctggggtctatttccttctctataaaatgaaaggcattaggtcatcaataagccctcagtattttaaatccgtgctaataattaagacatgtaggttatcttttaaaattgttttatgaaacaaatatgtggagacctgtcccagtaatcttttattttctttttaaattaagaatagatatttagaacacaccacatgttccataaaggcaccatcaaaacccaaattcaagtttttctaaatttttctcatcccttttccaaacctcactgatatctaacaatgttgaatgaaaaataatcaaaagattatgaaaattaggttcttttaaaactgaaaagatatttattggcaagcagatttgaggggagaagttctttgcactaatcatagttctagctatttggaacccttgaaagaaagagctttaagacattccaactgtaaaatgaaacttaaacacaccacatacaaattaaatcactttaataactgttctctctgttgctaagaggtctagagttctagagctttcactaccacatagaagaaaatggtgatgaaactgttagcctgtggatccaatcatcataaatactgctatttaattttctttttgccaattgtgaatggtaggttagtagtgtcatctgtgaccataaaaatctgaagtgtgatcataactacattagtagtgaacataccatttcctatacctctatcttctcctctaataaaaaacttcaggattggtcttggtattatagccttaaaataatatgctgtaatgtacattccattgttaactataaatctggtggaagcatttattctttatcagcgaatggagatatctgtcacaagtgtttctttaactctaatacatcattactcactgttatcattttaaatgcaaattttgaagctaaaaattattttcagccctcattggattggagaattttatatccagtcgtttaaaattcaaatagtttctatgttcccattgcttgcattagaaaagaaagaagggcacaggaagtatatattgggtatactctctcatttctctttgatctgctcttgctttcctatcacctgagaatttgaaaaagtatttaatattatcaaatgaagaaagtcccaaacacatgggacagtaattagacaaaagctaattaagcactgttaaataataagttgtaaagtcaaacctttgttctgatatttggggaaaatattggagtattttcagttgataattggagggaaattataaatccaatgttctttccatagtaatacagattcaattttatgtgaaaaattctaatagaaaaacatgtttaatgtttactgaacaattacaggaaataatagaatactctccatttttatatttatgtccctcaaaatataactagtaaaatattgatataacttatgcttctcaaaacaacttgcaactaacgatgttttaaataatccctttcactcctttaaatggtcttcttgaaaagaggattcatataattgtcaccttctatgagtgtctataatgctacctgtggcttgtttaagaagatgccgcataatctgaggatggatgttcttcataccaaaatactctatttaaactctgatgacctcttatcttgaccttcccattttcccctctcctttcctctcttcctcttaatcctctgtctcattctgtcggtctctgtcacactccctcactctttccatattcaatcctttcacttaaatgaaaataagagctcacttccattatcaaaatttatgcatcaatattatggtttctgggacaaatacaatcattcacatttattttcatgccggtgaagaagtactgaaggctgtgaagatgctctaaatacaaaaagctttccactgcatggatattctttttttctactcaaattagagagcttattttccttgatttccattgatcagtcattctcatttgcttcacagtttcttctttttttatcatctccttggacagtaatagctttgcttcttattctcttcttgggtgagcccatctgtttcaaattaatacaattacttgtgaagtctatgttttagttctgaccttttcctgatcatcagaactgattttctaattgctcaccagaaacatgaggatgtttcaccatcccttcagctacaactaatctcaaaccattttgttctctcaaaccttctcacaaacatacatcctttatgtgacattactgtattctaaatgaccgaggcataacagtttgggatcatagaagcaaaacaacatacttaaaaggaatggaagaactcatctaagccaacagctttcaactatgagtagcaaatactcctagtgtgtatgtgtatatatatatatatatatatatatatatatatatatatatatatatatatatacacacacacacacacatatatatatacacacacacatatatgtctgagaatcagaatcctttgtccaaatataatcttacacagaagtcctatgtatacaagagaaacatattttactctgattgaagttgaaaagggaagaaatgagtaaaattctctgctggttatttcgcttctctctgcagttcagtagcacttgcaaatattccaaattgccattaaaacactatttggaaatcagttctccagctgatcccataattctatagatgaaaagttttgaggcccagtcagaccaaggtcataaagctactaggaggtaaatttgggcctggactctgcactacattagtctgcctgatatcaatcaggctttttcttaaattgacttaagaacattggtcattgacttaactgcccttttatgagagagattgtgagtactacccagcaccttatctgattcctatctatctgtccaactgaataaatggtacccttcacacacaatctgcagaatgttttcttacgctccctttcattcattctatttcctcaaactttgccttgtaaatattccaaacctgtggtggagagataagaaatctaacatgcaaagaggttaactgacttctcagatgttgttcctgagtgagtctcaaagctcttattattattattattatactttaagttttagggtacatgtgcacaatgtgcaggtttgttacatatgtacatgtgccatgttggtgtgctgcacccattaactcatcatttagcattaggtatatctcctaatgctatccctccccccaccccacaacagtccccggtgtgtgatgtttcccttcctgtgtccatgtgttctcattgttcaattcccacctatgagtgagaacatgaggtgtttggttttttgtccttgcgatagtttgctgagaatgatgtacaaggctacagtaaccaaaacagcatggtactggtaccaaaacagagatatagaccaatggaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagagctaaaaccataaaaaccctagaagaaaaactaggctaagctttctgtatcttttttttcttatctagccactattcataaaatattgcttgtccccgttgtccaatttttttttcttttctttttttttttttttttccaacagatctcactctgtcacccaggcaatttttatcttaatgaaagtgttttgcctctctctgttacattatctccaaatgattcactgactattctgtcacaatgcaaaggtagtctcactgtttgggaaacaggaaaagctgtcattgtcagattgattgttaagccttaagaatgtcttttgaaattctcttttatttctccaccatcatttctctaattgtctcttttctgaactctgcagattcaccaactgaattggctcccaaagcacaaatcagatcatattgcctccctgataaatactttggtcattcttgattgtgtgaatgtgagctaataagatctaatgagattcatttcctcctaagatctagtgccttattcttaatccagctcagatgctacctgctgctctatggaactcttgctgactagattcaataacattattctgtgtgctcccctataacttctatagtttattaaagcaaatgctagattatatctgttaataagattttacctcaatcttataaaatgtattaatgtttgtatagacaagtaacggttacatgtgagtttaatttgctagtaagcccatgaggtttagctttgtaattattttatttctgaattaataggatatcaaaagtgtaggtttgaggtcaatgcattacagcctgtgggcaaaatatggctaccacctgtttttgtaaataaagtattattggaacacagctgtgcccatttatttattgcctatggcagcttgcccattatcatagcagagtggaatagttgtgatggaaaccatatggcctgaaaagctgaaaatatttactatccagccctttacgaaatgtttgccagtctctgatgtccatcattaattcagaggtcatggattttacttcacaattttggattcaaggaaagaaattaatatttctctgttcagtacctcagatgctaattacataacttttgattgcagggtagcttcctctgatcaaagctctgtcagggtattttatgtgatagtcttatgacttctacttacataaaataacctattccttactatagccattctataaaacttcagttttaatcagcagaatttcatgagtttctattcctccttaattggagaaaggacaaggaagcaaatctaattaattggacttagtcattttttctgttgccctcctgtttgttaactattcttctttcttgtgtactgtagtcctgtgttatcaacaactttcattttgcagatgtgaatacttgtacagacactggttaactaaaataattatagtaactagatgggtggcagcaaactaaaattttgaacagattttctcaattggtcaccactaggcacctatgcctatgcttcagcttcttgtttaaacttcaaaatttggatccactttctgcctataaaatgtccatgtactctaacaaggtagaaaaaagatcatcaaaatctgtattgagtcttctgctatatttgtccaccagatgtctcatcatgggaattccacagatcagcagtttcactgtttaggttttcgaggcatgatgcagatgcttctgagtttactataaacctacaagtttgtcaagtcatgcaaagaaataagtgcaagctaatgagcatccaaggactctaccatggaataatactggaagaagcaatgagatattttgcaacaatgcctttgaaaattaagtctactgctgtataacgattatatttttgcaaatgagtgacaatcaagtgacaataattaagaatttaactttcatcaaaattttaggctaaaattcacatgcatttttcagcaagtatgtgaagtttttttattttgtaaaattgaattatagcgtatagtatatttaattatagcatatagtatatttaattttttaattgaaacatttataacaattttaacttacctgcagtctagccagataaaatatagcttcagtaataaaaaactataaagttgtaataaaccaatataatttgcttatattcatatcaatgaatatcagccctacagtaaaaacaataattatcactttaatattcttgagactttcttcatcctctatactctgccaaatatatcctccttccactgtcactagcgcaatgctacttttgtcaagttttaactcaaatgtcatttctctgtaaaagtttcttatacccacatgaacaaaaaattcacaatttctacagaagtccgatcaagctttaagcacagtatgcaaccactatatattgcctagtttctacgtaatctgtcttgatgatttagattgtaagctccttaagggcaaggcctatttgtactatcaccatataacacagagtgtatatgtagcaataacacaggaaagaaatctaaaggaaacactaattttaaattaaaaaaaaaatactcccaatgaaacaatttgcatgtttaaagatgaaagtaagacaacctataatcacatatatcatagtttttatcaatcaaattcaaactccaaaacacatgaggcctctcttttcttctttccttttctttccctcctctcccctcccctcccctcctttcccctcccctcccctcctttcccctcccttcttctctcctctccaatctgccttgccttgccttaccttgccctgccctaccttgccctgccctgccctgccttgccttgccttgccttgcttttttgagacagagtcttggtctgtcaaccaggttgaagtgaagtggtaccatgatagctcactgcagcctcaaacttctggcctaaagggatcctcctgagtcagcctcccagattgctgggattacagtgtgagccaccatgcctggccctaaactgtcttctaaaatcagatcattgtcttttgagaatatgaataattctgtaaattaggatttacttccctgaaatattttgtatttcaattttaaaagtcatcaaaaacatatgttgaaatgtggctctgtcatttaagaaaaatgattttctgtctcaggtaaaaatgccttgtggtatctcagcctctacttaaaaaatatcattatatgactcttaaaacacagtaacactcaaattgaatgatgaagaattaaagagagaggaaaaagaaacaacagagtaacaattgagattcgatgtaagattttatatgaaaaacaaaaagctcagaaattttcaaaatgttttaaaatgtcaccctaaaatgccttatatttaacataaagaaatgcttagcccacaagtcagctactgaccatttggtcaatgctcaatttcttataatagaaatactagcaaaaccaagaatctaacacatcaccacatatatatttatgtcttacattgttgcttccttttctttgactcactcatcccatttgtgtgaatttcctcagtatcctccagggttcataaaattgatataatccaagatttccttgtatgctatagcttattcattttcactgttcaaactatatcctagaatacacctattttcatattaaagcactttagtcttcaatagtattgggataaatatcattttaatgatgtcagttgaatcatacaatctcagatttatagaactttatactgcattctagtattccactctattgtaagcaaattggaacatcaaaggtcagttttggcttgaagacagaatatgtaatcatcttcagtaactcattctttaggttaggcatcatcttctgtaggccttctatcacaataaaatctcctaggccatctagcctcaagagcctgccatccgtgtagccacacttagaacagccccaaatttgctttaatgctttgatgttgccatagtgagtttattaatttttgaacaaggggcatgcatttttattttcactggacaccacaaattgaggagctgctcctgtctttgggagtgataaaacattaagtcactataaatttgtctatcaaataactttaagtcagtagggaattacaataagggcagtaagaggcacagcaaatgtctatattatagagacaatgggaggggagaaaacctaaaatgaaaggtgtatgcataaattagtcattttgttagttaataattatctgtttagtaccttctatgtgccatgtattgtttcggctattgagattatagcaatgagtgatgcagacaaagtctcagactttgtagagcttccattctatggagaaaccacatctatctgtagttaagtgggtactttccaggggtagtgttttggaagaagtcaatatatttcttttatctccaatagtgttaccttgggtagccaggcaaattaatgatagttaggaaaatttaatgattacaaccaatctcttattactaatcttgaattttctttaaaggattggtggaaatttcacaaatcaatgttggtcatctttactattttgtcatatataacacatagtttcaaacaggcaatataactagtatgtttaaaaataaatgttagggctcgttttgtgagccctgtatataatgctgctttcttgtctccattctgtgctccatcttttgtctaagtttaatggtatataaactgtgctcccatcaaaggagttcttttagataaaagcattgattctttggatctgagctttgtgtcactggttctgtaaaggaaacaaacaaaaaaaacccagccaaaccaaaccaaacaaagaaatggttttgattaagtctagaacatttatgggaaactatccctcagaaaatgaggacaaattatcctggatctacaaaatttgctcttactctcttacaggaaatattatattggaatgtcatacagtacagtgtacagtgtcacctagcacactgaggtgaagaatcaatggatatttgttgattgaatgaatacataaacaagtgataactgactgtgtgtatcaacagttttccctcagatatcctaaaataatccatctcttagcgctagcaccaacgtttaaatatgttagaatttttttaaaaatgtttttattgtctctagcttttttttaagctagaaaagaaataatgtccaaacacaagtacttttcatcaccctaatttccttttgttttagtgatagatgataaaaattgaatatcttctaggaacaaagcacaattgtgcaaagttagcacatttttgttagcctgaatcataaacttctattcttaaggagtaaaatcaatccagtgttcactgcaatttggaaccatgagaaggcacaaaattataggtgaatacttcaaagtacaagatacaaaacgctgcctgatcatgtgtctactacatttgtctctatgttttcaacacatattatttatctttcatgatgtaagaatcttccattaaaattcaatttggtaacaagctggcaaaacaaatacagctactttgaaactctggatgtgtgctgattgtgcctcatagaatcacagggctttaaagcatctgaatgaaccctcctccaccaaatccctgtaattttccttgtcaacagatgtacatttaatcaagaaaaaactaataacatgttttcgtttttaactttaaaagaaagaatttcactccaatatattttcgtacttaactattttcattatgaacagattttaccatatgattctgcaaaaaaatcacatctgactacaactttaacatatcaatttttgttagtgtagggtacatttcttacatattttgcatttgaacactcttaaattatctctcagtattttcttcttagcactatatagttatgctttgtttaaaatttctgaaaattgtcttaactctagacatttgttgtttaattttattaatataattttagactcttcagagtattttgatgaaatactagtattatttaacttataagcctatatctatcttagtcaatgctattaattttatttggataatttctgtaaaatcttatgtaaatctaaatcaaaactgataaaacagtgtttcagaacctagtattcattgagcattcagaacattataattttgtttttaggaaacttaaaagggaaaaaatatttttaactaaaacctacttgatctgttaaacttcaatcattctaaatgtgaacatcttttacatcataaatatatgcctcttacctgtgctgctggatatattaacatcgatactgatatcagatattcctcctcccttcagagatgctacacatgtgtacgtcccaaaatccgtgaattttaaatcaatgatgtccaagtttgttgttcccggagagacatcaggatcagtctgtgtaatgaccatccgctcagaacttcttaatggacgaccatttttaaaccaactaaatgttagctcctcagaaggaacagcttctacttggcaagatattttcacctcacggccaatctggatgttgtcatctttgtgataaggatctggtgtgatccaaaatcgtcctttttttaatgctacaacataaaaattccataaggagttagtgttactttcataactttaaggattcattaactgtagataatcatctctgagctgaaataaagtaaaaccaaataaagtgtacatatatttcttttttatatccaagttgtgtgtacatcaaaaaacctcatgcaggtacccagaaataatctaaaaaaatctaagtcaattaaagactgtgaacactgatttttataaatttggtaagattttccagtgatatcaaaagtaatgccttaagtctatgtgcaattatacttaaatattgacattgaattttgaacaaatgacagattctatgtagtcatagcatattaaaattaaaagtaagaatatggatctcatttaacctaatactttccctatgtcactacttagttattgtataattttccaaacaactcaaatattacacaaaggacataagaacattctcctaaggttgtatctatatgttgatcaacactagttcggtaatatttgagtccattcacattcatgaaacattttcatatattgaaataatctgaactgaaaaagaaaacctggggcaaaaagcatgttcaaaacatttactatgaacttttctattctaccatacatagatgtttccagttaaaactgtttgttggctctctaatgcggatgaccaaaagaacctctccacagacagcttagaaaacaggtttgtatgctaacagaaatgttttccaggtctaaaggcagtgctgttttcacaagaggtcagtagtaatgactaccaaaaggctgccaagggagcatctatagactttctactaagggcctgaactttgaatgataccacaatactcaatatggaaaagctttctctcttttgtgacagtgattctcttatacacagatttttcttttttttttttttcatcatcttccccatttccctctcctttaaaatgactatccctacatgacaaaatgtggcatacacagtgaaacacaattatcaggataaaatattggtcatccacttttaacattaagcctaaatatgtaatgatattgtcaaaaatgccatgaatttagaggacctacagacactagaaggctgctaacagcattctggatagcccctccttagtttaaccatatttttgtcagttagtccaataaaaaccagtaagcactataaaaatctatagaatcatgcagaatgaactagagataaatatacttttaagtcttaaaaacttttctaagttttaaaactctttagcctcaaatattttcatctgctttcttgttggcatctcaataggaagatatacatagatatcaaaaacaatgtttgtgtctttctttttcatttaagatatatttgaagggctcctcctcaagactagccactaggctgggttctgactacaggacatgaacaaaatagacataaccatggccctcatgtactgcagcctgcatattcatagattagaggccaacttattcacacaacatttatgatacttatgtctagaaaaaccacagacatatatagcgatgaaatattttatatgcctgaagaagtttcaatctcagaggacagcctccctgaattactgtttagaaaatgcactaagttttaatcttaatgaaaacatgagaagacaaatacttaaatcacattctcatactgtcatttgttacatttttccataataaaatgcaacttatgaatcttatttacccctaaccatatctttatcagtaagttactctagggtgaaattaggatacattttggtattctgttacctagaatcatatattcatattttcacaggcactgacctatgactttacattgtatttgggaagggaaatgtgatgaaatgtccatatctggctgccatatttggtatataataattgtgctcatacaatgccaatgtaattgaagttttacagtacaaagcaaatcatatgagtataaaatatattttctgttaaaaacagatgtaaaatttaatgtcaagagcatttacttttattagcaccataacagttaaatgagagtttcccttcatttgctaagaattttctttatcctgtttttaaagagaaattttaagattacaattttgaaagttttattattgcatataataatttattaataaccatatgactaatatcagggttcatatgggatatcttttagaatagttttcattacaaagatatatgttggttgcatatgtaaacacacacaaaactgagatgtttaagtggttgtcatttatttaccatgcagctattgttttccacttctgtgctctgcatagtgacatattaaagtgatattgagagaactgcaatcttaccagccaaattagatttaaaatactaaacaactcaaaaaatactgataaaaatatgaaatcagtatctgtattatgttatagaatatttattcataaaaacaactttaaaacccaaagaaaaaatattagagattataaacccataatcaattaatacataagattatatgtaatatacaattagacaaattaataaaaagcaatataatcaagcatgcttttaagagtgaactcatagcgaaaaacattggtgaatcttagttatcagataattctatgatttggcctaagtcaattgtactagtcttctgaatgacacagaatctaaagggaaaaagagaaacaagtctgctaagtgagctcaagttaaggaacatcagaataagtaacagattatttaatagagagtcatttctgtttatgttgtccctctaacaaaataacataactggttttgcatacaaaaaagaaatgttcagataaaaggtgtgtgtgcgtgtactcatatatagtaacagaggacagagaaattttgttttcttacttagctcagaaaactaagagcatagctctgtaaactaggtctgggtacattgagaatttgcaacctaattccagtttttcatgtctacgtggtccaagatgggcaatctaatttttatggatcaagtgcatcatttatgaaaatagaaggtgatagagttaggctcccttagagacacattgtgagaaatagcttattaacaattgtgcctgagttttgaaaatataaagtgtttgatgtagttaatcaactgggcagcaggttccttcgtttataattaaacgctctctttttccgtgaacaatttatagtagctcatgtaatgttaatttaaagtcatttcctgctaccagttaagattttaaactcttaaaatcaatctgtaattagtactggagtataacagaggtccaatagacttattgagactctatagaactaaacaaattctatggaaaaaggatagcagaaatccctttccccaaatgcaatttctcagtctgaatattgaaaatcccctaacaccagcctgagagaacattagatttggcttaatgtatcataaatcgtgatagatgaaccttaaaaggtacttgtttagtctggcagtgcatgtaaaagattggcatcaagctgaacctctgttctggataatcagtttggaaacattgcaatgtaactatagcctcccttttttaatattgtgaattgaatacaggcttggcctatattcactttttaacagtatacttgcaaggacattctaattgcacttactgaaatccctcttcttcaggctacacagatgtgctgtgtaaatggagtgaaacccaagtattgaaacagaggctactcactgcaaaaatttgggtagggtttgttgctcaccttccctagaaataagagtccatgcctgtgaatgtgaatgtcaatggttcaatggaagactcctgttatgtaaaactagattacatcttgagcataggcttgaaagagggaacattgccttcagagaagtctaggcttgtggtttccacaaagaggaggctgtgagattgtatcttgattgtagttttagatttaaaattataacgtacattgttttgttggtcaaatgttccatgaagtatgcaatacatagtaattcaataataaactaaaatttattgacagaacaaaaaaagacaacagtcttatactttaatgtgaaaagcatctctttggagataataaatatgaggtgtcagctttttagcttctgttaagtatctatttcagaagaatgtaagatacagagtgaccactgatcaccatttcaggttgataaattgctgaaaagactctctaaatcgattatgttttataatcaggttgtaggattctggacaacctaaaggactgacaaaaccttgttgagatctggatatagaaaccattaatagtgcaatcagataaataaaaatcaatttcctatttattctttgctgaagagaataaaaatatctatgtgtgaaagatgaagtattttcctgacccactgaatgccaattaaataagcagttggaaataggttacatcagcaaagcaacttaaaagatagtaaacgatagtatgtataatctgtcctactataactaggaacctatctttctcctcaatagggctgtgaacacctggggttggagtgggtacaccttactcttcttcattgcccccaaatcctgaatatggtgcattgttaaagttggtacttaatactctttattgaatttaattataattgacatttcaaagcattaactttacaaatgccaattgtttccattcagtatggtaagttcctgttaattttgattttgtgttgcagtcttgtgttctgagatgcatctggggaaatagaataggaaaaagaacagatttgatgtcctcaaggattcagtgattttgttgtgggaacagaataacacttgatgaacaaacagcatcaacatgggaatatatgtgaggaagagaattctgtacacaacacaagaaacctcattctagcacatccactgactagttagctatgtgtatgggacatcggctatcagacaactctctttgtaaaggaggatttcatccaaaagggcttgtttatatgcttcagataataatcatttctgagcaaatatggataattactcaactgataatcagttgataatctgaagatggaagaaggaaaaaaaaaactgacatctacgcacatttacattgtctgaaatagtatttgctaaaacctgtttcagaaaatggttaatgaggttacattaaaacaaagtgtaggccaggtgtagtggctcatgcctgcactttgggaggctgagacgggcagagaacctgaggtcaggatttcaaaaccagtctgtccaacacagtgaaaccccatctctactaaaaatacaaaaaattagctaggcgtggtggcaggcgcctgtaatcccagctacttgggaggcttaggcaggagaaactcttgaacccgggaaccggaggttgcagtgagccaagatcaggccactgcactccagcctggacaacaagagcaaaactccaccacaaacaaagaaacaaacaaccaaccaaagtgtaacaaataaagtttgaaaattgactatatgaaaaaaagttcgtatttctcccaaacttttcagagctttgaacatgctaacatgcaaattgtcacattactggagaggctgattgcatctaccaagggggaacatctctgaggactagcatcccagagaataaagtttgggaaacaatgacctaagaaaatctgccagtcgaagagaatcattgaaaagactgtaaaattagattccattcttaatattgtaggcatttcccttatgagcatcacgaaataatcagcaaggtgtgactctctagtgaaaataatatttattatttaaaaagctaaagggcttgggaatgatcttaattttttaagttaataagtaatggtacattgaagttataaaaatatatttcagattcatctaataaactcacctacactaagagccgcgtgcctctttctttccaaccaacaatttagaaaacaaaattaacttaccagtttgttcctgtctctgaaatgtacattttgcaatatgcaaacagcattaaagaggagttaaatgcatcagcttttgtacaactctaagcactgatatgaacaagacttaatctttctcatttgcttgaagaaataataatttgagttaatttatttatatcttatgttattataaaaagtatatgcagtgttagtcttaaaagtattaaagattctggaaaatggatatgagcagggaggtcttttaaatttttttctctgatatgctattaagtattcttatactcacttctctgtatctaacaactccatttgccaatctagtctgaatggaagttcattaataatgcaagaacaaaaatacgttacacccttcctgaaagtggtttaacatagcacccctgataatctaaatgtagagtcagacgatgaaatgaagttggggttctatttaattgtaaagtatcaaggctctatttattttgtgaatttactcaaagctaattagtacagttaatcatttgaattgtttaagcatagtatggttgaattataaatgtctcttgaatatcctttctcaatagaacatcagcaggtaagcattttgggtaagaattagagaaagaaaggacgttttaggcaggcacaatgtactctttttggggtaaattcttcttaagaagggggaaaaagtgaactaaaataataacataattattatcattattattttgccattcctaccattttaatcctattttaagtaagaaaaaaaaaatatatatatatatattgctgataaattaccaaaatgtctttatcggtgtcataaatgaaaacatttacatgtggctaccatgtaaatggtatctgaattagcatgataccttagcaccagttatttgaatagaagattattactttgctggccctataatgttaaaaattagtgggtattttgagctcaccttttctatcaaatttaataatactttttcactatgagaaatgagaatgtgttcaggtatattatactttttattagttgctaaagacctaggactagaaacagctatcagatgagtggcagtttagaaagattggtacaaaatataattcatttgaaatccttttgaaaatagtacatccttaatatttatgaaattgatcatgtagttgtgaaaattagatgagataatgagactaacttaatctaaaatctttcgttacctttcttgagcttttttgttttctgtctcgtaagcggtgccctttccctttccaaagtgattctgccccttctgccaacctctctcacagtatcctgaggtcctacatccagttggccacttcttttgaaatatcagtatttcctcttccatactgtattctctcagactgaaacttgtttaggtcacttctaaacttaaaacacttctcttaaccccaataatccctcaaaccatttgtggcatattgcttgataaaatggtgaaataccagttgcactcactcactaggatactttatgtgctgggtttcactgatgctactctggcagtgagggctcaaagattagtaatgatctcctaatcaattaatccaatattttctagttcccattcatgtttgtattatttacactttccacttcgtgtcactttacattattggctcttctttcttgaacatctcttttatactggcctctataactggtaggatataacgtttaagaaaataaattcatggactgttctcattcacatcacaattgtcatgacagtctccctggttcatttgagttctatcatttgaacagttcatttgagttctatctatcacttgaacagttctaacattcgaaaataaattagtggactgttctcattcacatcacaattgtcatgacattgtcccagttctatcattcaaacagcagttgtaaagtcaggtttgttgagaaaggtaggatttttctaaatcattttgccgtaattagaagccatggagttttcccttgatgttctctttccttttgctgcccatgttagaacatgagatagttgtctgtttgttttgtttcttgagatgtagaatattgcaaccagatccatgcatatttcaatttaaaagaaaaatgtgttaaaatcatttaaatatatgttttcattttaacactacagaccaaataaaataacttagatatactgaatgactaaatgagaaatatctttaattactaacaatttatgtaaattatcttaattgccttatctggtaagaagatgaagagtgaatactattgacctggcgcatctaaccattccccctattttaactaaactttagatagatttatttctttttctttttttgggtggggtggggttatccatcccttcaagcatttatcctttgtgttacaatccaattatatgctttgttatttttaaatgtacaattaaataatcataattgactatagtcaccctgttgtgctatcaaatactaggtcatattcgtcctttataactattttttataccaactaaccatgcccaccttcctcccccaatcccacccctgttccggtaatcatccttctattctgttacatagatttattttttactataggcccctggtcctcattttcatacagcatttacacgacaaaacttgaaaatttagagaaattgtaaattcttcctctgctccatcgagttgtaaataatctgaaactcaaaaatgtctttctcaagtatgtgggagccatccctttgaaatataatagtcatctttgaagttcctgagacattgcccctatctcccattctctgtagagggtaagagcctagagcctaactctgaaatgtgaaaagagacaaacagcaaagacagatgttttaatcacattgaccaacctctcccataaagtcttccagtactttttttttattattttatttatttatttatttttacatagtctcgttctgtcacccaggctggagtgcagtggtgtgatcttggctcactgcaacctctgcctcctgggttcaagcaattctcccacctcagcttcccaagtagctgagactacaggcatgtgccatcaagcctagctaatttttgtatttttttggtagagactgggtttcaccatgttggccaggctggtctcaaactcctgacctcaggtgatccgcctgcctcggccttccgaagtgctgggattacaggtgtgaaccaccgcacccagcctattccagtacttcctattagttcacccagcatttaaaaatcctcctgcttttattacatctgagttgagttaaatctctctccccacatgggaatggttttaaatattccttgccatttttaacaagcatccaatgtaatttttctttcacaacattaaatttagtcatgtgcattattaaaatagatgaaaataggatcagtctagggaattcgttgctacaaaatttcaaatgtcaaagaaatacttatggttacaacacacacacaccccagtatgttgctcaaagatggaatgtcatgtaagtacgagagtatttgagagttaaagaggttaatttaatccctttataaagctatcttctccaatgtggtaagctctgtttaatctttaatgccctgcaggtatagagtttctgataataaaccacaaaacaaagatccggatgtgttggttaattaaaagatggcagggtgctgaggtgtgaagagactcaaaactaaataaatttaatatgctataatatgttatatgtattataaatagaaatgtataatctttcctttttgaaaaagtataccctacctttccttaggtgtgtttaaagtatatttttaaaatacatactatagtgtctgtgggttttttttttctctttttaatgagaaaattctatcaaacaagcaaataagtcaaaatgctggtggtatagacatacttttccatcctgtacaattgtttgttgagccatttaattggctttactctttacaggaagaaaggcaaagagggaaatactaatttcacaattcacagtatctgggacgtaaaaatactccaattcctcaaataaacaacaaacaaaaattactattcctgtttcagagatctgaatcaaatgtattttctgcacctgcataaaggagacatgaaacaagcagcatttttacccacttctttatagtgatcataacaataaaattcacaatcctagttgtcaatctatacctcaaggtgagctaactactgtaactttatacaggaaccaaaggagtctgtcaccatcgtatagttgttcaggctcaatttaaggaaaaattcaaagacattgtctgggtaaatattaaacaagagtgaatacaagtttatattctacgaaaatgacccaggaagtttgttggttgttgttgtttgggggggggggggtttgcaggtattatatgttgcaggtacatgaaaatgtattcattaatagttaactgataagaaataagagtcacacgttctaagaaaggagaaaagccaaactaggacctagactctgtagtgaggtagatagaagaatacatgtggatagagacattatagaaagcttatattgtacctatacacagtgaaaatacaattttttaagtgcaaaatctgtgagcacctcaagaaaatattttgcgttcaattgtttgcatttcttagagacttgttggatataagtcagtctaatgttaagacacatctaagagaaacaatgactattatgttggaggagttgatctaaattcattcttaaggaaaatgagttgatgataagaccagtaattcactgaagttatttctactttttgaaagtgaaactatgatagtgatagtttaaagtattggttctccaagtatgaaccctagtccaatatcagcagcatcacctgagaatttgttagaaaggcaagttattggatgacaccccaggcccaatcctcaggttttggtatagagtccagccatctgcattttaacaacccctctgagtgattctgatatactctcgggtttgagagcctctgttattgaaaaagtttatgctgccatcctttagaaatacagggctcgaacagagaaggcaggtcatcagctcacccagaaggattattgagatattaaggcacaaactaaaaagtgccatagcatatctttttactttgcaggatcttcaaaagcctgttaatcctaattataacatttgaaatgttatttaaacgtaactcccataagtatcaataacaaaagagtctaacctgatctcacatagattaacatggaactacttcctttccacatggccaaagcttgagaaaagtttcacaaaaacacttattatttccagatctcttcagaagatgataaaaatgttgagggctcaatattaagcaccttaaagtcaaccttctttacctacgaatttctaacactgagtattaagaatgtaaccaactatcatgagggaatatctaaatacctgatatggtcataatttaagggtaagcgattaatagcctattaagtttttggtgagtggcaatggtttctgggagagtcaatatagaaaacagtgaagagcaagtattctgaggtcagactgcctggttctaatatgatttcatcatttattggcagtgtaatgttgtacggttagctctatagagcctcaatctcccaaatctgtaaaatggtagtaattatgaagcatacaattgatccatgaaactctgagtatgctagttccaacacagaatatccaaacactagatgtgagctgctttttattccgtatttctgagcactcacagcatgtctatcactattctttctgccaaaggtgcacagatgaagagcctagtgatggggaaaagtatagaaaccaaaaatttgataaagacaaagactgacagtattttattataagacaactcattattgtgaaagggtaagagaagacttcatgtatttggtggtgcctgagaattcggggataaaaggaaggcagacagttaaagatgctgaaaggtcattccagagagtggcagcttcatgggtactggaataggaattcgtactgtgccaacttttggttttagcttagctttcaatcactctagacaatcctctcacgttccttcaaaatgtgtttctctataatttcaaacattcgctttcatttcccacctgtctctgaggatgccgggttgatctttctaaagctgacctcttaaattgtgctcctgaactcagctccagctttgcattgaatatcactcacacatcatcaattttctcttaaaatttttcctcacagtaaagtctttcccatgtatttatgaacatgatcataattaaattagcatgatcataattaaataattaatgattaattaatttaattaatcattaattaaaacaaagcaacaacaactaatataatacagaaagtctttcctcaacttctttatcttctgaagctatttcttatttactctctttttatttctcactctcaagatagtaatatataaatcactcacttttaacctctcaatagttttgattctcaccagtaacagaacttttttttttttttgaacgtggagtctcgctctgtcacccaggctggagtgcagtgcggtggcgcgatctcggctcactgcaagctccgacttcacgccattctcctgcctcagcctcccgagtagctgggactatacaggcacccgccaccacgcccggctaattttttctatttttagttgagacggggtttcaccgtgttagccaggatggtctcgatctcctgacctcgtgatccgcccgcttcgccctcccagagtgctgggattacaggcgtgagccaccgcgcccagcccagaacttttaacaattgccagggagaatatgttctgaggagcagcagctcagtccaaactcctgctgcatttgctgtatacaacctattctgaccttttgtttatagctcccagaccaattatacttccatttcctttgtcctgaatctgggcacctcttgtctcctctccgtctacactatcacttcttcacagcttgcttttacatccatagtctgtatctcagcacaggtcccactttagtaaaaccctctgttctcaactctctgagatacagttgcttatttcccattgtccgctcgatttttatgtgatgcagcacttcaatcaatgttcctcaattaaatttcttatatcactactttaaggtatgtctgatcttttttttccttctcactctttcatttatgacacattctccacataatcaaacctttccccgcatttcctttactcttttcagtctcccagaatgtgcccttactgttggatttgccttgtatgacatcttgtccatgctctctgtccacattggattcagtcactgaagcccagatctaatgtcatcttttttgtaatgctttccccaattcatgtaatgagtctgaagaattgccactattctttgtctataagaaaactctcttccagatattttgtattctctggactctcaagcttcctgaaaacagaggtacttcatattgctgtcttcctgagcaccctcacttccacaaagtaagttgtcacagcacttaggttggtgacatggaagatacaacacctgtaaagcttttcatccagaggggacatatctgaagctattaccaagtagtcatcagattgattgttgtcacctaatcattaacctgaacaaatttgttccattttgtcaattatcagacaactgacaaaatttgaataatgggctatcaatgaaatcgtattttgtcaagataaaatttccatattttaataactatactgtggttatacaggaaatgctcactgaagtgttttgtgtaaagaggcactatatcaccaagctactctcaaaggactcataaaacatttatacacatttatataaagaatgataaagtaaatagaaaaactcaactaatagcaaagctgggtaaaggctatatatgagagttctttgtactattcttgatatttaaaaaattttttcttaagaagttgagaaattaatattaaaaaatcagctggtttattgttatttatatccacagacacaaaatctgtaccctccagtgataacagtggactatgcatttttacatttctagattatcctcctcctattaaactattctcctcgaattaagctaaacatttatgaccctttgaaaactatcaccaatataaaaattagtatcgaatactcacaaaaaaacccaaagaataactaacaaataaaactagtgaagaaaactgacttttactcaataaaatatttgtcaaggaaataaattaatccttcttatacaaatgggtacgattagtgatggtgcctgataaatactatatgctttttgtaaactactactcaaaatctcatagaaacttgtacaatattttttaagtttaattataacagatgaactgtctttccaaaaaacatgcagaggaaaaaaaacttaatactctttaacattaactttctagatattttgaaaaaaacaaaaatataaaatgtggagccatccaatatataccatatgtaatatttttcattaatattcataatttcttgcggttaaaaatcaaaatgacacatttttcttaacatatgactctctgaaagctcagttaggccaaatgaagatgtataaatggggctgctgaaagtacaatgccatgttccatcacattttatcaggttacgatgtatttcaatatatgtgtatgagtgtgtgttatgtatgagtgtgtgttatgtgtgtgtgtgtgtgtgtgtgtgtgtattacccaaccaataagcattattttttaaaaacatctttaattactctgactctcctttttcacttcctattttatctacatatttgaaatcgtactatatgaaccatgcacctttatttggaagtccacatgaaacttgggaacaaaccaatgagaatcttataaagctattattcagaagattatatcagaattaattttcttgaatccacccccttgacttaggcaatggtgcaatacattagcttcatatgttttatttcatcattattattcatggaaacaaaatagagtcataattgaaatttatgtgacctggaaaatatttccttatgtgaaaatcctgcacatttctactcacccattttttaataagataatcatttctcatttaatagggctttgcagcaaagttaaaacttgtctggctggcaactcatcatgaacttaaaacaagttttttttttagtatcattgaaaacagcactctaagaccacaactttaaacattaagcattttcaggcaccagcatcatgaatttacactactgaacagcacagttaggcgctggattccttttgattataacagaaacactatcttttcccctttcactaaatggctacaggcaggcatgcattttttactttgtgtcagttgcttttcgttttggtcattttctttgcttgtaactatcagctcttattccttacaatcatcatagggttagtgtgaaagctttattcctttcctaatttgctacgctgcctcttttgtgaaagatgtacatgaactttatcatatgcagttgttctctcccttttcatagctgtattactgttattttttgttttcttttgttgttttcctgttcttagttgtgttcttctgggctcagcatgatcgctgtatatgtgtgatgttattttgcattttctacataatgggacttaacccaagttagaagctgaaactaatttacttatacctagccatgttctaagaacattttaccaggtgttcatatttattgttaacacagtgcatctgcagaaaaaaaaaagaagcaatgataatatccagttaggaaaataagacaaagccagaactgacattgatgaaaaaaaaagtgcaataaattctatatattttacaatggtaagtcatatattacacagtaaacattacggcaaccaaaatgataaggaaaacatggtcaattataaaacggacagttcttgcagattaaaaaaaagttgtacaagagaagtacaacttctcttttatggttctcagaaaaatggtataagatagagtgatgaataatatctttgaaaactctcttacaacaaacaagaaacaattttgggggactatttatttaaaaactgcttagtgtaggcttaaaacatcaggccaagagaaatcagcaaaaggaattctaatacgtgagggatgaggaaatatgatataatatgataggatatgtcaattcagggacagattttactgtattgaagccagttcttaacaaaaggtaaacatcagaccacaatgtctgaattacatcccttagtgattccaggtatgatattttagagtagagactggggatctagatttttaaggtctactaaagattctgattcatccttcagaatgagatctactgacctagaatagttgaaaatatagtacatgctctcctccatatatatcaatatcctgaattaaggctttgaaagatatttgtagcaataactgagtttatactccctgacaagtaactccgaaagacagttaagtacagaaccatatgcttcaacagtcaagccgagacagcctcccataaaaaacatggagctagaatctctcacaaactcattagaatgtcaacatatcaaagaaaatatccatatcaaatttttgaaatataaatccaatttagacattaggacagcacaactcaccaacctatgtacctgttttttccttctcaaatttgggggaaaattattaagaaaaaactgagataacttcattcacacatttttcactagagaaataaaataatctttcaaaaataaacttttggaaagaaaatgttgactactaagcacagcaaatatataacatctccatttctactttctctacctataactattactgaaaaatgatcctaacagtccttcctatccaggcttgataacacctataatttattcaggacatagttctctaggaagctactaatatttgaccagcacttgccatgctgaagagacctctctgggcttattcctcctatctaactgaaattttgtatcctttgaccaacatctccccagtactccccatgcccccagtctctcgtaaccaccattctactttctacttttatcaatacaactttttttagattccacatgtaagtgagatgaaaaaaaaaaaaggaaacaaggatggaaggaagaaaggaagagagggccaaagtgaggaaaactctctgaacatcaacagttacttactcttcacttgacataaaaattccttaataaaataccctttgtaatttacagattacttgggtgatatttttagtcatccaaagaaggcataaattagggcaatttattatgtggataatttctcattaatagattgagagatccacaactactcactgctcaaaacaatggagccatacatttaattttgtccttgattctaacatttttgttgcaaaattgagcaaaacccaagcattgatgaaatgtcattacttcaaccttttagatatcagaaaaattcagcatggaattatatttttgttaagtattcccttgttcttaacactatttggggtacaagctagaatgaaataatattgggatgcaggcaaatcaaatatgaaaaatacagataatttctgatagcattatttaaaatttggcaaaaattttagtgataagaatagccaaattatccctttgcactcagttttactttagaaagacatttattgcatccaaatgtcagtagttatgtggtaataagtagttttaggctgtgttgacaaaatatgaatgttgtcaaatatactgtgttatttgtttcagccgattttctactaattttttttttttttttttttttgagacagagtctcgctctgtcgcccaggctggagtgcagtggcgcaatctcggctccctgcaagctccgccttccaggttcacgccattctcctgcctcagcctcccgagtagctgggactacaggcgcccgccaccacgcccggctaattttttgtgtatttagtagagacggggtttcaccgtgttagtcaggatggtctcgatctcctgacctcgtgatccgcccgcctcggcctcccaaagtgctgggattacaggcgtgagccaccgtgcccggccttttctcctaatttctatttgcagtccacctgaaattcagtaaaatagaatgaggaaagtataggcaggtgaaagttaacatttgtctaattcaatttaacagatactgaatgccaattacataattcaggcattagtgggatatagtcctgtcattacagacagggtagaagaaatgattctaaaatcaattcagacatgctagagactaagagtagtaaaaataagtttatatttcacttacatttaattcaattatttctggaggaaatttataacaatttataacgcaagatcaagctaattttcttccatggagactttggaaaggttttacttcagtgagaaaatataattttgtcaattaaaaatatttttctagaaaacaaatcttgagatatatatgagttagttttaaattattttgttattaataaatattaagaacatggccacttaatatgcaacaatctctctgttgctcagtgatgctttgtgcatcctccctcacattctcttatcttttcttcaagaatctgttcttactatcctcaaaaccatacctgagcctactggtcacagtcagcaaaagctatggccttttacttcactaaaacagcattaagtataaatgcccaaagtgaattccataccacgtcaaagcgcatttatagttccacctctttctagccttttccattgtgtttcataatgatccattctttgtcccattgctattgtacctgggcctgcatctatcatcctccggcactctgctcatttcctttcttcaattttcaatctccatcttgctgctgattacttaactcaagcttttgcaagtgctcaagtctctgttatattaaaaaccattatttcacatatcctacttttacttttattcatggtcaacttcttcaaatcatccaactccagagtctttatttcttaaatactagttacttccacgatctgccaaaatgtgccttcttactcgtgtctctatgttacagtataccagcagcattattttcatgtttcagtcttcatctaccttaactcattctggtattttacattgttgacaacaccttcatttttaaaatttcctttaaaaaatatttaaaatagtattactttctggttctcattttactcataaacaactctttctcaattaaaaaaaaagttgtagctcttaaatgtatacatttttcaaaagttcatttccagatcatttataccatgttatctttagtctacagatgatgaaacggaaacacgaacaacttaatgataagatgtctctaagtatcaaaagtatcaagattataaaaatcaaatattttccaattaagtaatattttaaatataatttcacaaaactatttttgtaaaacaatatactacccacttataatgcaacttctaaacatataacatctgtgcctttagtttttttctccaaggtcaggaaaattaggcagagaatttagacacatgtgcttttagaaaaacaaaacaaaaacactagagtttattcatctagaaaatactattatgagcttacttttggaaatgacatgtttcctaaataaaattgctgtattacatacaaccatatatcatatgttaactggtaagtatgaatggttcctaaattatcaccggaaaaagacatatccattaccatattatttttagtatgcagtgactgcaattcagacatatccaattagggaagaaagaattgtgaatttattgctcaatttaaattttgtcatcattttctgatggaaccatttgccaattattgtttcagtgctgttgatcattacattgtaaaattatgctactgttatcacctttactatgtaaatacatcagattaaagtcttttcatattttgttacattttttgctcctcaaaattaggagatagcaaaagctcctttaactatagatgtttaagggagtatcaaatttatgctggaaaaattaaccaacttaagctactcagttatgttttattttactcacttatgaaatttgagttttctgtgttctatcatcattgttcttcaaatactcatacaaagttagtctgtctcactacaaatatattcagttcaaagtacactgaattgcatttccatttctgacttttctggggtcactggcagctgatcaacactcccatagagaaaaaagaaaaaccaatgagatttttttaagtcctttttgaaagtatcagatatcagttcaggcaacctgaacttgagagatcaaattccagggaaggaaaaaaaaaaaaaaatgagcttcacatactatagctatttttctttcaagtcattgtctatttcaggtatacagctgtaggctgaaaatccaaggaaaaatctgcagtgaatggtccagagtactcgactggaaacactgaaaggttatgtcctaggaatggggcaaatagcagacaaatacagcattaacaagccagtcttcaatatgctcagccactgattggaatgaaacagtaagactgtactttatctattataagataaagtaatataaaaaagaaaagaaaaatatttctgaagcaagataacctaatcctgagccggtttttcatacaaaataaatggcagtcagtaaaaaataagacttgtcaagagagaagacaaagaaaaatatagcaaagccaacagaccacagatgatcaaaacaggtgttctcagataaaaacagtaaaatagctatgatagaaatacttaagaacataggatacaaagctgggaaaagctaaatgaaaagatgaaaaattttgccagataattggaacctataaaactaaatcaaatgtaaagtttacaatgaaaaaaaattaaataagtgaaatgaagaattcaataaatatgtctactagtagattagaaacaacagaatacaagactggtgaacaagaagatggaacaataagcaatttgtagactgaagcacagatggagaagaacaaggaggaaaaattaggacagagcacaaaatacgtaaagctcagtgaaaggtctaacataagaaaaattaaattaatgaaagagacaggaaaaagaatgagaaaaagtaaatatctgcagaaatactggcccaagattttctaaaacttatgtaactgtaatccacatattcaagaagctcataacaatccaagcacaataaacacacaaaaaatccacatctaagcacttactataaaatgtctaaagataacaaagaaactcttagaaatacagctagggcctaggggggtggggtggaaggtggaaagctatataaaaacatacacttaaaaatactataaataaatcaaaatgtaaacctgaaatatgcaattatacttagtgaaaggaatagggaaaagtacactactctatattctaggaagaagaagttcttcatgttaaagtaacccacaagaagtcaagacaaagaaaacagaaataagaaacagagaattggaaacagaaggtaagttgcagaaaagctctaatatttcaataattatattcagtgtaaattatctaaatacaccaattgaaacaaggattggcaaagtggatttaaaaaacaggactcacctatatattatctataagaaattcatttcaaatataatgatataggtaggttaaaagtaaaaggacaaaatatatatatcatgcaaacaaccatcaaaagtaagcagggtggctagataatgtagactttagggcaaagaaaattgccagattcagagagggacatatacaatgacaaaaggtccaaccactaaaaagtcacagcaattgtaaatctgtatatacccttccccctccaaaaaaaagcagaaaatatgtgaagcaaaaacagatagaactgaaaggaaaaatagacaaatccacaattatacttggagactttgatattcccccctttaaatagatggaaaaactacataaccaatcaacaaagatattatagaactcaactaatagtatcaaatcaacatttatcgagcattatcccaacaacagaagaatgcttactcttctcaagttcccatggaacataggatagaccatatgctgcttaaaaacaaacctgaacatattttttaaaccacaattgttctctaactgcaatagaattaaaagagaaataagtgacagagagattataggaaatctccaaattcttggaaactgaacaacactcttctaaataatctatgggtcaaagaagtaccaagggaaattaaaaaacaaacacactgaactgaatgaaaacagaagatatcaaaatttgtaagacagttaaagaagtgctgagagggaaatttgcactgctaaatgcctacagtaaaaaagaagaaaagtctcaagtaaattatctaattcccacttcaagaagctaaaaaacagcaaaaattaaaaaaaaaaaaaaaactgacatgctgagtaataaagtaaaaataaaagtaattcagtgttatggactgaatgcatgtgttttcccaacatttcttttgttgtaaccctacttacccaccctaacccatttgtgatagtatcaggacgtggagcttttcagaaggaattaggattagacaaagttatcagagtggagacctcatgagtgggattacacccatataagagttacagagagagctggctttccctctctgctctattccatgtgaggatatgaaacgtttgcagtgtgcaggccagaagtgtgtcctcactagaatccaaccatgccaacacactgatcttggacttccaggatctagaactgtgagacatcaccatttgttgtttagaaacacccagtctatggtatttttgttacaggaacacgtgctaactaagacattcagaatctaaattctgatcaaaatgaaattaagctacagccaataacaaaaatataattagaaaacccatgtgtttgaaacttcagaaataaagttctaaataatccttgggtcaaagaaaaaaaaatcacagtgaaaataagaaagtatttcaaactgaataataataaacattacatatcaaaagtcttgcgatacagttaatagtatacctaaaggaacatttacagtcttaaaagcctacatgaggaaaaacagaaaataataaaatcagtaatcaaatcactgctttaaaaattagaaaaataattagcatttgaaatataatggtatagaaggaaggaataatcaaggacagaaatcattataatagaaaacacatgtacaacaatcaagaaaacctagaattcaaatgttggctctttaaagtaactaaggaatttgaataacctctagtaaaactaatggagaaaaactgaatgatattgacacagatgatcaatatcacagtctagtctcactatagattacaacagtggttggttggaaccacttcattcttgctcatgacagcagattatatgcatttctttccaactacaaaacttggatattggccatcatctgattatgcatgctatgaaaattggtaaatactataaatcaagtcttttttttttttttccagagagctggtttaccagcacatcctggacccccttcccccaaaattaaaaaagataattacaggaattacaacaactttatattaataaacttgacaactgaactggcatattcagattcctagaaaaacaaaactaagatgtaaaaatgtttattcctaaatatttgactagtcttatatttattataaaaagtaaatctaaaattgccagtcattgcacaaagcaatctgtaagcccagatggcttctcctgagttatttaaaacaattaaagagaaagtaacactgattttacataaactttaagatagcagaaaagaatatatctcaatgcttttaaattaattaccttattttgaatactgaaatataatttacatacattgaaatgttcatgtcttaaatgtatagtttaatcaattttaactaccgtgattatggactttcaatgtgtaaggttttttttttttgttttttgttttttgttttttttttaagcagtcactaattcttggttcatcttaacagattgttttggctaagatggatttgaattactgggttgatgatttccattctcatacagttttcagaaaagtatatttgttgagccaacaaagtaaaaagaagaagagaagattctttgaaaactaaaattaagaaattatcctatagaatctagaaaaggaacaattaaagaattatatttgattacatctatttagaaatcattggaagcatttagaatgagcactgacattggaggaatttgaacagaattcaaagagacagaaaaacacggcaaacagaaaatttgtcaggttgctaattcaattaaaaattgtatgtaaaaccacatgcaattcaaaattgcaaaaataagttttaagcattatttttaaatcatagaatagaatgtacccattacttattttttgaaaaggttctattattaaagatagaagttaaacatagatttttttttactttaaataattatcaatagtttctaatacttcataaataagaaaatgaagtaagttcaaaaaactagttaatatcaccatcctgggcagcaaatgaaagagacattttatttctgaatatgtagatactctcatttttcaaagcccagctaattggcaccatcctctgaggaattttttctatctccctaatcagaattaattgtttcttcatctgagatttgaacaacacattgcctatgcttcagttgtgatgttagtttattcttttgcatgccatatggagagagttgccctgatatctttgtgcataagtgtatgaactctatggcctcagggacttttcccttatagcaactgacacagatatagcatagagcagaaatttttaaaatacctattaaagcatcacttgcatttattttcctggtttaatatcctgatgtaaataaccaatacataattttttagagtagaacttcatcaggaaattagtgttcttcaataattatatgttaatacatgtgaatccataaagacatgtgacctcctgcatttgtaatgggcatggatcacggagcattttgctcttatagaattatagatggttggctgggtgcggtggctcacacctgtaatcccagcactttgggaggcctaggcaggtggatcacctgagatcaggtgttcgagaccagcctggctaacatggtgaaaccccacctctacaaaaaaacacaaaaaattagccaggcatggtggcgggtgcctgtaatcccagctactctgaaggttgaggcatgagaattgcttaaacacaagaggcagactccacatcaaaaaaaaaaaaaaaaaaaaaaagaattatagatggttagatggttagagcaaatctatcttaaagtttatgtactgcagtttcttagtatcacagagaagtaaccaaaggcctatttacatatctatgatgtcagagctagtttaaggcaaaaccagaaccagatcacagatatcttgtcctacaccttcctgcctatagatcatttagtccaaactaaatctggtaagccagtgaatctgggaattaagtacctgccacaacaaaggaaaaaatgctgaattatgcgttttcatattagtattcattgtcttggcactgttttacaactgtagggtatcaaaaaaaaaaaaaaaaaactaccaagagtctcaaagaaactaatgaaagaattttagaaatgttaatatttgaataaaatccctcttttctggacactaaccagtgccgacttttagagcactactatcatttttaaaagaaaattgaaagattttctcttggctagagtaaatatgacgagagactccatttactaagtaggaaaatttaaatgttttaataaaagaaccatgtttaactaagctgcctatcattacataaaattaggagatttttcaatatctagacaaaattttttatttgaaattatatttataattcttcataaattattttaatgaacaaggataagttagttttatttacaaaaggaaactcagctacctaaattcacatgagaactactgaatgataatttttagattttatatggccttgactaatttttaaaagataataatgcatttttgagctacaaagtaatataataacattctctctggtgttttggggaggtgtaattactacagaatattaaattgggaaaagagaaataagcacttaatctgcatgaataattgggacacctgcacacagcagacagttctgcttttggggaatgtgaaggcattggttttctacaattttagccatcatcattatagttttaataatgaaagattatgtaacaaagctattgatgagtaaaaattaaatttgatgaatctaaatgcttgggaagaactacactggcccagtaactggaaattcaccactaatttatattcagaaatgcatatgggctatatttgatcaaatcattctgggaaattgccaattaattctgattggcattctgattaatagcttaagatatatacctttcaacaaaaacagtgagtgcccagttgtaagtatacattgtattttcttgcttatgctgaatgttttagttatggggatattttgtatctttgtctttagtgattcccactgatatcttccagtaactacaaattctttaaaagttttgtacagtcatttgtaagaaagccagtgacagtcagttctatcaagtccttcaaaatataatgatatttagaaaatcataaactgtaaacactatgttagttagaacttgacattaagtaagattatgtccaccattactggaggaaaaatactgattaacaaaaacagaatttccttcaattaaaagaggctgtatatttgggaaagaaaacaatgttactaagaaaaatgtctgaagactgagtattgttgagatttttttttcctgagtataaaaagaagggattccgaatctggaaagaatccctagtacatctttggcaatgcaagaatagaggaaatagaaaaggactattatcagttcaaatatttgggagaaaattaaatatttgtaaaaatttggctaaaatttgaatcgctccttggctaagaaaatggccctggaaacttattgtgtggtctttgaatcccagctctattatttaaataaagcttgcttttgggaagttacttaatgctctctcttctgttttaggtttcttttttgtttgtttgtttgtagatgtagtctcactctgtctcccaggctggagtgcagtagggtgatctcagctcactgcagcctccacctcctgggttcaagcaattctcctgcctcagccccctgagtagttgggattataggtgcgagctgccacaccaggctaatttctgcagtttttagtagagacagggtttccccatgttggccaggatggtcttatgtttttgtattttttttattatactttaagttctaaggtacatgtgcacaacctgcaggtttgttacatatgtatagcacatatataccatggaatactatgcagccataaaaaaggatgagttcatgtcctttgtagggacatggaggaagcaggatggtcttaatctcctgatcttgtgatccacctgcctcagcctcccaaagtgctgggattacaggcatgaagcactgtgcccggccttctgttttacttctgaaaaaaaaagggaataataattttttacctgataactgtattgagatggttaaaaagttaatgcatatagcattactggtagcctggtacacaataagtgctcaatcagtgttagttattactattctctaaacatactggtacactcaaatgttaagaacttttaatcataaaactttggaattataagtctttttgtaataagcataaagataatttagaaatattagcagtgctaatatttggcatgtttcagtcaaataagttcagaacaaattatttaatattaaaattcatatttaaagactacagtcctttcatgttgataaactagaattagttaaatcatcactttttggaagagagttataatgttcctggaggttacagcatatttctgtgcagttatgaaagtgaaattcatgcctcattgaatacatattgacttcttccacaaaggttaactctatttcaatattgacatacttctttacttctttatattaggactcttagatcctatccacaaaaaaaaaatgctgaaataattctaaaattaataaagagcacatttcattgattctaaaatcatttacagtgtcattttgcagaggccatgggttcaaaaatggaaaaagtaaaggcctaaatgggtatcaaggcgtcatgggagcatgatgtgaagaatatagtttatgaggtatactgcatactacagtggctttaaaatgtgtctgttccataacagggtagagatatttgacccttccagggagtgggccagattgtgtcactgcactgaagaatggaatacaataatgatactgtagttcttcagaagctacattagaaaaacccatgcagttcttggaacacttggcctggcagtcttatagaagtctggctaccttgaagctgccatgagaagaaatcatgtaaagagacaagaatgagagagagacaaagagaagagacagacagccctgaggagtccagctgtaggagcttcttagtccaggcactagttatttgaataaagaagcattgaagattactgcagacctagccaccctctagctgcaattatatgggataccctgaattttttagctgagcctctcaactcccagatttgtgaacaaaacaaatgattattattgttataagctactcttttgggatggtttgttacatagcaatgaataatcagaacaatgtgacctttcagacaagttggtcacatcacacaaattatttaatgattgagtatggacatggaattttctaattttgcttaacatcatttaatacttacttaggttatcaaagagtcatatccagaaaagaaatctaatatgagctgatgaacttaaaaaagagattctctcactaaacacatgtttattgagcatctactatatgctgggtaatattctaggctccaagactacatcactaaataagacaataaacagacaaattctttacccctatagtcctattaaaaagcagacaataagtaaggaaatatggataaaataattccaggtagtgatgtgataagaagcaataaatcatggtatggaaattagagatatgctatcttaagataggggaatcagagaaggtgtttactagagggtagtatttgaaaactaacattcaaagcagaaagaccaatgcgtctaaagtagagcaagtaaaaatgggagtcatatgaaatgatgatgaggaattttaattccattttgggtgagatgaaaagccatgggaggaatctgatcaggataatgagatttttttttgttatttctgagtgcacagtaagaattttccagccttcaagccattgggtataggcatgtgtctgagttctagtcaatagactgactggaactaatgtatatctgcccataaaaatctcccatgtatgcccattcaagctccgtcccatttcccgatgacagggatggaggcaacatccatagtaaccttagcagccacaaattgaagatggcagagacatgatcagccctgatacctgaatgaccacatggaacaacctccccaccacacacacacaagtacactcagcagcattatcaactagtaaatactctgtactctttcatgaacaaaatctgaagttcttttgagtaattacatgtatgggtatatttattaacttagcccaggctactttatctaatatagcaggtgaatttctaaaagaggggctacagtggaaagaataacaatagaaagactattttaatcaaccaggagtgatacatcgatgatttggacatgtgtggtagcagtgaacatggaaagataggatctgattaaaagtatattttgaagatagaaccagaaggactggctgataaatcaccttcaagaatgcagtaagaaaatttgaaaattcctctaatccttctacatttttgtaaaactagatgatagaattttcctggctcacttttacctgaaaatagaacacacagaattccatagtaagtgcaaaacagacctctttcttatgcagaatttttggagaaagtggaagaaatctcaagccatgattcttagacttcatagacaattaaaggtaaaagaagagtaagaaaccaaatttaattagaaggatatctttagagaaaactgtgagatgcaacttcttccaaacccaaggtggagaaaggagaacctgtctgtttcatctcaatcatactgaggagctttccatgggacctgtcagctttgaaatattttccctccaatgttgcctgactcatatctgaagaaactaaaacctgtgtggcaagagaacagaggtagtacactgaaatttatgtgctctcatagtctattggtaagcatttccaacagacagatgtgagtctcacagggaagggacatgaccatgtcttgggctctgtttagttggctgcttagaggaaaaagggagaagccgtcagcagaaaaggggtaggggtatagcacaagatgttcaggaaatgtggcatattcatggactcagggaaacgcccatcactggacacctctctttgatctacatagatgtatatatcgtctaggtagagaaactttctaagggtccattaacatgtcaccaaggaattggggaagctttatatagagaagatcttcatagctcactctgagctacggtggtcagaacctatctatcaggctggggttgggttaagtggagaggtaggtggagaggtaacagacaaaaaagccacctgtgctccatctccctttcttacttcagctctccagccaaagtggacccaagctggggaggggagaaatttttgcattaaatcaggtttagagttattactattttggaccatgcatccaaaacactgaactaaatgtgggtttgtgattttgaatatactacagaacattcaaagaggccactatacactaaaatacagtaatgtcttggtattttgaaccatacatgttcaacacagtgatttaattcatgagagaagagagatgtaggcatttctaaatagaacgaatcatgaaaacagagacctttacatggaagtgacatatctaacaggagtttggaaagcattgagctcagggtgtacaacacgtggctaggaaatcaatgtaacattcccttcaggtgtattaggcaactgcttctctcctaacttatgagaaatgtagctcagacactgcaatttcttaaaaaactataagaaaaggcattgatgctacattaataaatgttctcccaaagtagtaaaccatgtgagatttgtattcagttttctacttcttatctacatagagtgttatctccattatttactttacactcttctctatttttaaaaaagtagaataaagaattctgaaatgtttcttgaattttatttctatcagcactctacactcttatgctgtgcatggacattcttaaatgaggatgggaattcgatgcacaaaatatctttatgcttactcagaaacctggtccatggatcctgatttaattacagagaagaatgagaggagataaacctagatttctatatctactgtatccatgacacaattaatctaagactcacagaggtctacacattcagaagccttgaaaataatttctttgatgtaataaagagaaaactgttttccttaactgaatttcttgacttctgtagaccagaaatcagatgcctcatattattgtagtggtttttctccccacagtttaatctaggatcctttaaaaccaaggctacttctaaattcagtaagattatatacaaacttgattttatgaattatgtgaatgccactgctgagaagtctcactggcaatataatatgattatgcaaatgtacacatcagataaattaaaggcataaaaagaaatcataaaattgaagaaataaatttttaaggctttgtttatttcaggtctttcatgtcaaagttggaaactttcttttgtaaggatacaggtgaaaactgttaggtagggtagagaggagaaaatcataccctaggcacatatttgttgttcactgggttagtcccttacaaagggtgcataagcaacacagatattttatattggacattttgccagttgtacatggattcaatatagttgcaaatgatcccattatgaaaattaaattcaatgcatcatttttctctaacaagttactgttcttgataaactaatggaataaaagattctgcattgtattcatggcacttaaggatagatgttgcagtactttaatattacactttaatcattatacttcaatacttcaatgctttaatcatcatacttcaatactttaataattacagcaagatttggtagattattttatgcctacttagaaaagcaagtatttttaaagcaaacaaaaaatagaaatgaaacaaacaccgattacaatacaatttttctatttctcttttaaaaaaatggggtagagagagaacagaatctggttgctcactgacacaaggcttaaaatgagccccatttctcaatactaatattttaaaaataaaagttggatacttccattgtgaattctttgttttctatatatttccatatacgattactttgtatttctgtattccataaagaactgtaactcctttgagggcagacatttagtcactgatctttgcagtcacactcatgcattccttacatttgctgagtccttagcccatggtagttgtgcagtagaagttcattaaacaattgaaataaagagcacatttcattgattctaaaatccatctttatttttacattttaacaattctgagatcagaatgcctcttacattcaatagtctgtcatggttgctattagtaatcatgacctgacttaaaataaaatctcagaggcagtatttctccataatttggaattattaatgctcttaatgacacaagaacaatatcgtatagaaaaccatgatcatcaatgaccctgtaataaaaactaatttagaagtcgagttctgagtgtgaactattataaaaaattaaattattttgcttttattggcctttttatgcaggccaataaatgacatattttaaaaaaaatcaaagtataaacaaatttagaagagctttttcaataatcttctatctcataagacattatggtagtttaactggcagtatgttttattttgttttgatatataaaataatcatacatgttatacatgtacatatgtacatataataaatattgtatggtatacaattttgtggcagatggtacgctattcatagtgttttgatttacactgtaccttgaaatgttttgaatagagtatacttttgtcaaatagcatattcctaataatttgcaaaataacagataactaaaaccaccacaatctacattcacaaaatcacaagtgtttatctctatacatttgattatgttttgcttccatcataagtaattttcatttgcgtgttcaaaaggtcatcttcagcatatggatgtcccttttaacttcagaggcctcagtgtgcaccctccacttccaacccaggaccataccaggtgaagtgagatatgaagaagcatatggtctctttgtacatctgcctcagaacttctttccatcttccaaaatggagagaaaacatgcctaaatggtgccagcatactagctggtaatgaccacattagaacagcattgctactttgacttagtgacttacattttgcttcagttcctcaaataagcattgcgtcttctatctctgacttttctgtcttttctcaatttcaatctgtcaaaacactactcgacctataagacctagtatgaatgttattagatattccctaataacctcagccagaagtggctatacattttttaatttctatatcttttgtttattcttttagaacaccgtatcatatgactattgatatatattattttcactatctgacagtggaatcctgagtacagggtaatgtttgatagatctctatataacctcacaatttaaagccatgattgtaataggggctcaataaaagtttattaaattgataaatttactgaattcctaaactattatacaatcagtgtatattttacacagtgaatgttttatgctgcaagccacattttttctttcaatctttttttagctaacaacatattataaaaagcatttgatggtatcactaagaatatgttatgaaagctattcaacgcatatataaagcactgttattaatctttaacctgtttaagttccacttataattacccaccattattatttatacatgattttatctgtattttacagatacatgcaatatttgaggaggtaattttatatcaaccattatttgctttttgagagcctaacctaggaatctacgttgtaacattctttcagcaaacttacctctcacaatgatgttggtggacttttttgcagggtttcccacattattattggcaatgcagctgtaagtaccagcatcatctgaggtgatggcaggtatggtcaaagttcctccattcaaaacagtcttttcaggcagagtcccaaaggacctgacccaggtgagagaaggtgcaggctctcctcctgttgtaacacatactaatgttatggcctctccaggatttacaactataggatcatccaccaagagtttaattgacggtgatgctaaaagacataaacagaagaacgtgcacctatttagatatgctacaactagaattcaacagcatgcattatattggttcattcaaaaaattaaaatgaaatatagtcctcttttgccaaaatcatactgtattactcaaatttaaacaagatttaatggtttcatattttaattaaatggtataaacatgtagaactgtattaagaatcttacacatagaaaggggaaataaaatttatgtttcctggattattgttctgaaattggaataataagcatgattaaggttttaaaacaaaatatccctttcttttttaatgctgacaatcatcttctgtttttgtcattcccagtacagatactgcagatattcagtccttgtattttcatggtgaagatggttaattatttattttttggatcattctgagatgaaatgataaatttttgcaatctgaatacaaccaagtgacagataaagtcatagatcacccaggcttttaccattcagtgagcctgatttttgttctcgaaagaaaaaaataaaatcatctaattctaatgcagtgtccatacttcatctctaacctcttcacttacaaaggtctaggcagtgagctcctatcaacacagctttaaaacttagaaacaaacattcaagagctcaaacagccaccaaaccatgcttgccactactgtttgggttataaaaatcccttactgaaaacaagtcttttgtaatcttttaggttaaaaaatacaaagataaacattcattcagtagaaaaagctgtgtgcagccttttcatcaaacactccaaatagaaactgtacaaaaactttcttcacatatagcacattttttttctgcttacactgccgtgctagcctaaataatgcatccctaaataaaaacaggagaaatacattataatgacatttcaagtgacacattcagaaatattttgtcaaagttagagctgtattatatgaaatcaatctacatcggaaatatttaaactgttcaattgtactgtgttttttttaatatattaacttcagcttagagttgaggagtgttttactcagaataaaagctagactacttgtgaagttcaaaactgtctgccgtgtttgaaaaaaaaaaaaaaaaaagccagaaaaggcaagaaaataatttcacattacagttctatgggaaagacatgaagtgcctgtatgacctttttaagcatcaatgtttcatgttgagtcttctaacatcactttaaataatatgggaatttttaaaatgtcatactattagcccttctgaggagttaatatgaaattctaaatatttatgattacaaacctgttgggaaatgcacatcatgaaaaaagtatgcaaaagttgccatattttggtgaaaaaaacctcaaagagttatttaatgttaaactgatggaggacagtactaattaaatattctgaaaatagatattatacttaattattaatatatcatcatgaagaggtaaagaaaatctctataccctgacttaaggtaaatagcataatcatacacaagtatttgattaaaatatagagatctcaacatttatatcatattaacagattaatttcttttacatcacattttagtcaaattaaaaggcccaaggcctaaaggccattaacagcatatatttggactatggacatacccaatggtgacattaagtccgggaatatttgcccctgaaattgatttgtataggatgagttgttttctattagatattatttaatgcaaaaaagcttaagataatttcaaagctcaaaaaataatgcatatataacaagatcactgttctaactataatacattttagaactaccttcacaacattgttaaaaatgttttcttccaaatttgacttggaaacacagtattgctcaagttacgtttattgatggtggcacttattttatctgtttatacctgaaactaaaaatagcccagatagaccacaaaacagctaacaatttcaagactttaaaaatatttgtatatattttaataccaaaatttgctagctttaaatttcaaaatagaaaaaaaagttgaaatcattgtcattttgttctagtattttactttttatttcataaatatcagctttttaaaactataaggctttgcttaagaaccagagacattcagatttatcaagcaagcttcagtgtaaatcatgtcgttgagtaaaaactgatataggaaaaacataaaaatatttttgtccattaaaatattttaaggaaaatatttcatattggatgaatcatttgctaatttgggggtatacaaagagtaacataaaacattataggttagtcattctcttcttataggtttccatagctacccctgccagttttttcttcatattaccttgtatattagccaggctaccaatatgactcttcagccagatgaaaagtgtcatgattgcattctctgaagtattatataatgtgatagttaagtggtaagagtacaaattctagagtaaggtacctgggttcaagtcttgactctgccatttaatacctgtgtgaacttgagcaagttctttgttttcagttgagggcctcaatttcccattgttgaaatgggggaaaatacttgtaactatcttgaagtatttagataatttaacatgcgtaatctgaagtccttttgataatagctagtacaaaggatgcacaaagtgttttcttttatcatttatttaccctcacagcctagtccagtgcttggaactcagtgggtgcttaataaatattagtaacacgaggcagtaaatgggaaaatgaataagtgagtaactactataaaatatgtggtcactatagaatacagttattctgattgcatactgcagaaatatctctaccattttgacttttgaaagtcctataccatatatataaaacatatttaaatacatctctacatttcaaataaataattattaattttgttttataatatttttatttggaaattgaaactattgtttttcaagattcaacattttcccaggacctttaaaagctcatgggcaaaaggtactatatctatgttagcacttgtgtaggtaagtgatactttttcacaatgtcctgaaactgcccaaccaccctcattctatccattacaagcttcttcttctgcacttatatgggtatataagacatgaagaaagataaagttcattttactaaatcatgtacatgtttagcatacgtctacagcatgtgttaattgaattatctcattactatataaggttaaacatggaaggtcatagaggtcataaattcccttattaccatgaaaaaagttcactgttctaaaaaacaattacagaatgtaaatgtccattgattcatcgcagcaacatgtgagatagattattagtttattctcattgataagcaataaaaaatcaaacatgaaaactgaaatgggataaggaaacactggatgagacagtatgaaatatttatttgagatcttcatcaaaccaaaatgaaaaatgaaaaaggtgaaatacgtaaagtaaaaaagagggaaactttctgattaagcagagcatttatattctaaattatagattattttaaatgttttataattagtgtcaaattgtggctccaattacattaaaataattccaactacaccaccagctgtaaacattctctctgtaagcagtgcttaaaaatgactatggtgccagtcagaataccaggctggtagtcttccaacatgtaataatggaaggcacaggtcatgatagacattgccacagagatttgagtctcctcataaagatcaggatgccaatgttctagcatgcctgaggtgctctgtagtggggatacttgatgaatggagggacgatagatagatagatagatagatagatagatagatagatagatagatagacagatagatagaaagaaattggtcctggagaggcatagtgatttcgaatgacaagaaaataagagaagagagaaagaaaaggaaagaaaggaagggaaaggggaacaaaaagtctgtggtttctattttccaaaatcatgaactctcaatagaatttcaataactgcaacatagaaagtatattttagaaaatatctttgagaaaaaggaattcttcctatttccccataagcacctcttctcctggcaaacaaagttttcttggactgagcaacagacacttcagtgggtccaagagaggaataactggcctcttgacacccacaccaaatcccaaacatctggatattcaagatcataggagatcagtttgtcccttcctatttgaggtcactgagtgtggctgcctatatagacaaggacatagtcatctcatggaaaatactccatgttccagggagacagctcccagtcccacaatggtggaatggagggagcagagagaccagctagcactgaaaagtgccaaaaacaataggaatgagagaagtctcaggaaatatatgcctgtcaaaggattcagacatcatgctccaggccttggtacaacagcatctcctagaatttaaattaagtgggaattccaaattgataaagttttctgaggttatggcagaataaagagttgaaagaaaaaataatactgaattatgacatagtagagacagatacatatttttcaaacccaagtatgtatactggggttcatgcccactaaaaattatagtgattcagttcctcatgatgtcttcttggtgtgtgacacaaatatttaatttggggttaagtaataatacattatgtagaaagaaaacactattttagcaggtcattgacttcttaggtgctttgtttttgccgctacctaacataataggtaaatatgaagataagcatcctttttaaaatctgaaagcaggatacagtgttaatcatctttacatccttacagactttggctctctgtacatctggagcatttaattatgaaaaaggaacccagctttccatccagactctaagcaacttagtataaagcagttaacaattgtataaacctgccaattgccttgaattagagatattctaatttaagctcaagacttttttttttttgaatggaaataatctgagtattataaagtaacctaattcacagagaagattgtgaggaaggagaaacacacacacacacacacacacacacaaacacacacacacacacacaaactaactaaataaataataaaacagaataaacgccaattttaaaatgctcaggtaggaaatatctgctttagtttgaaagcaggtcctggcacagcagttgatttgggctgggatcacaggaaacatattgaagaagcagaaaagggcaaaacaaggaaggaagaaaagccagtaaagggtcactgatgagcaggttatcactgtgggaaacttggctcccagctgctaggaaccctctgagagaccaagtcaagggcaccgcaaagctctctatctaaagaacaaggagcctggctcaggtgcttatctatcaactcctgtccctcattaattgggaattattctctgggccttaactttcccatctcatgccctggtcgaacacattcctgcattcagtgaaagttctcagatcgaagaataaatatgcaatctgtccaaagaaactgcagcaacctccaggccaggacaggaggaaaggcaagacacccactgtgtctgctatgactttgtttccatgtaaatccagtgatcaacgagtggctacatggagacaatgtgtaaagagtaaagaaagaacaaggaaggggtaggcggtaagtgaaagcacccctatcaatcaagatatgggtgaaaaatgaaataatgagagcacagtatgaatttaagagagacgaggtaaaaatacacaattaagtttccgcttctgttccgtgactctacattatttaaaccatagaacacatacatatgctaaacaaattaaatccagcttgtatgtagagaaacatgcttaaactgtgcttacagattcaaggaatagaaaaatatttctcttggaagaactagtcacttcactgtgatgaagatatcactgtactttcatatatttcattgaaattcattttcaacaggtatttcattgaaatataagtagcagtgaatatttcacaaaataaagatgagataatatattagaagttgatgtgaaaactcaaaataatctacccatttatgtggagttattattcaaatactatccttcacatattgattgactctcatgaagcccaagattggtatcatgctgggaaattctatttaaaatgatgctctaggaaataacaatatttgaaattgtattcataaacagtttttaatgtaggagtaaacttttgctacagatattgaagccaacatgcatttctcattgatattcacaggacagacatttatggaaatgattgcaaaggcagaatactgttcctttttgaaaaattgcataacttttaggaagagatgcgattcatatgaccatggatcctaaatgagagattccctagatgggctttgtttgcctggcacagtatctgttgttgttgttatcaacagtgatgaatgcctttaggcattgcttgttctccctagtgcaataggttccctacccattcattcataagtatttctacagcatctactagatatcaggccctgtgacagtaagctgtgatatatcagcgaacaaaagagtcaaagaatccctgctgtcagaagtttacaacttaacaagaagagaaacagcacactctgcatgactctccttgtcttaactgactttgtatgtttacttcacctgcctgttctctgaagtcatatgcatttaccaggcttgactgggatatttatgtcattagagcacggtgagcaaagaaaactgccaaaagttacattcttcagtaaactaagactttgcaaaatatagtaagtgacacttatgcttctcaggcctctgagcccaagccaagccatcgcatcccctgtgacttgcacgtatatgcccagatggcctgaagtaactgaagaatcacaaaacaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgtgaccccccactcctgcccactgagcaccttgcgacccccactcctacccgccagagaacaaaccccctttgactgtaattttcctttacctacccaaatcctataaaacggccccacccttatctcccttcgctgactctcttttcggactcagcctgcctgcacccaggtgaaataaacagccatgttgctcacacaaagcctgtttggtggtctcttcacacggacgtgcatgaaatttggtgccgtgactcagatcgggggacctcccttgggagatcaatcccctgtcctcctgctctttgctccgtgagaaagatccacctacgacctcaggtcctcagaccgaccagcccaagaaacaaacatctcaccaatttcaaatccggtaagcggcctctttttactctcttctccaacctccctcactatccctcaacctctttctcctttcaatcttggtgccacacttcaatctctcccttctcttaatttcaattcctttcattttctggtggagacaaaagagacatgttttatctgtgaacccaaaactccggcaccggtcacggacttggaaggcagccttcccttggtgtttaatcattgcagggacgcctctctgattatacactcacgtttcaagggtgtcagaccacgcagggacgccgccttggtccttcacccttagcggcaagtcccgctttcctggggcaggggcaagtacccctcagccccttctccttcacccttagtggcaagtcctgctttcctagggggcaagaagcccccaattgcttatttccgcaccccaacctcttatctctgtgccccaatcccttatttctgcaccctgacctcttatctctgtgccccaatcccttatttctgtgccccaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaaaatcgaaataattcttgtcgtaaaataggcaaacggtctgaggtgcctgacgtccaggcattcttttacacatcagtcccttcctaatctctgtgaccagtgcaactcgtcccaaatcttccttctttccctcccgcctgtcccctcagtaccaaccccaagcatcgctgagtctttctaatcttccttttctacagacccatctgacctctcccctcctccccaggctgctcctcgccaggctgagctaggtcccaattctttctcagcctctgctcctccaccctataatctttttatcacctcccctcctcacacctggtccggcttacagtttcgttccgtgactagccgactagccctccccctcctgcccagcaatttactcttaaaaaggtggctggagctaaaggaatagtcaaagttaatgctcctttttctttatcccaaatcggatagcgtttaggctttttttcatcaaatataaaaatccagcccagttcatggctcatttggcagcaaccctgagacactttacagccctagaccctaaaaggtcaaaaggccgtcttattctcaaaatacattttattacccaatctgctcccgacattaaataaaactccaaaaattaaatttcggccctcaaaccccacaacaggatttaattaacctcgccttcaaggtgtaccataatagaaaaaagttgcaattccttgcctccattgtgagacaaaccccagccacatctccagcacacaagaacttccaaaggcctgaaccgcagcagccaggcgttcctccagaacctcctcccacaggagcttgctacatgtgccggaaatctggccactgggccaaggaatgcccgcagcctgggattcctcctaagccgcgtcccatctgtgcgggaccccactgaaaatcggactgttcaactcacctggcagccactcccagagcccctggaactttggctcaaggctctctgactgactccttcccagatcttctcggcttagcagctgaagactgacactgcccgatcgcctcggaagccccctagaccatcacagacgccgagcttccggtaactctcacagtggaaggtaagcccgtccccttcttaatcaatacagaggctactcactccacattaccctcttttcaagggcccgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctggactacagctatatctcattgccacccttcttcccaagccaaagcctcctttgcgtccacctcttctatccccccaccttaacccacaagtataagacacctctactccctccttggcgaccgatcatgcaccccttaccatctcattaaaacctaatcacccttaccccactcaaggccaatatcccatcccgcagcacactttaaaaagattaaagcctgttatcactcacctgctacagcatggccttttaaagcctataaactctccttacagttcccccattttacctgtcctaaaaccagacaagtcttacaagttagttcaggatctgcaccttatcaaccaaattgttgtgcctataaaccccgtggtgccaaacccatatactctcctatcctcaatacctgcctctacaacccattattctgttctagatctcaaacatgctttctttactattcctttgcacccttaatcccaggctctcttcgctttcccttggactgaccctgacatccatcaagctcagcaaattacctaggctgtactgccgcaaagcttcacagacagcccccattacttcaatcaagcccaaatttcttcctcatctgttacctatctcggcataattctcataaaaacacacgtgctctccctgccgatcgtgtccgactgatctctcaaacccaagcaccttctacaaaacaactcctttccttcctaggcatggttagcgcggtcagaatttttacacaagagccaggaccacaccctgtagcctttctctccaaacaacttgaccttactgttttagcctagccctcatgtctgcgtgcagtggctgccgctgctttaatacttttagaggccctcaaaataagtagaggcctttcctacagggtctgagaaggccaccgcagtcatctcttccgttctgtcagacataattcctcagtttagccttcccacctctatacagtctgataacagaccagcctttattagtcaaatcagccaagcagtttttcaggctcttggtattcagtgaaacctttatatcccttatggtcctccatcttcaagaaaagtagaatggactaaaggtcttttaaaaacacacctcaccaagctcagccaccaacttaaaaaggactggacaatacttttaccacattcccttctcagaattcaggcctgtcctcggaatgctacagggtacagcccatttaaggtccataacaccccccaaaaaattttcgccgccccaacacttcaacactattttgttttatttttcttattaatataagaaggcaggaatatcaggcctctgagcccaagccaagccatcgcatcccctgtgacttgcacgtatacgcccagatggcctgaagtaactgaagaatcacagaagaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagtctgtttggtgctctcttcacacggatgcgcaagaaaatgctgaaatctattcactgaacaatataaatagaaaagctagagaaacagaacttgtgttctaaggtgagcaaaagtcagtgaagcaaaaaagatgatccccgtgtataagctataccaatagttggggtactaatacctagcagcgtgaaaggtctttataaacattgacaaggtatgatgaagaaaaaaattagcactacacatatctccttcccttgatcaacaatcctttactgttctttccaacaggtgaggtcctggcaaacttggtctcattcaagtttacaggaagctgagcattcacttgctgcagaatcccagagggtcagctcccatagagagaaaaatccaagctaagcatttccaactgaagtgtttgttgtccataaaattttcttgttattaatggaaaacaccagaattttaagcacagtactagactgtaaagacactttcaccacaaaatcagcagagcatgaactttctatttcttctacctggaattctcttccagtgcttgtccactcattaaaccagtcatcaggcaatttatcatgctcaaataacaataacaattcttcaccaaaatttccagcttttgtccagaccaactgagttgcttctttctttgtgtgagaatagctctttataataccccctcattaggacatttgcccctatgctttcactgtgagatatttaggagtaggacatcagagtaaaaagggtagtgtttttcatctttgtaccaccagcacccagaagagtatttgacaaagaataggtgctcaataaaattttactgaataaaagaaagttgaatttaaaaattattaaaccaaaactccatctaagctctgagtattcatcaaacttaatttaaaatgatcaaaaggccaggcatgatggctcacacttgtaatcccacaatttgggaggccaaggcaggagtaacacttgaggtcgggagttcaagaccaacctggccaacatggcaaaaatatgcctctaccaaaaatacaaaaattagccaggtgtggtggcacagacctgtagtcccagctacttgggaggctgaggcaagataattgttaggatccgggagatagaggctgcagtgagccgagattgtgccactgcactccagcctagggagacagcgagactttgtttcaaaaactacagaaagtaaaataaaataatcaaaaaaacctacaaacactgtgaaatagtgtgacagatgataagaatttcatgagccatttattgacaaattctagttatgacaacttgcaagttatttcattgttctacccatttaaacttacctatgttttatattactaacaaggagatggcaaagcatttatctatcaaaatgtaatgcaccactcccaaaaaaaaaaaatacagtgtactgtttgcactcctttgtacttatttgttcatttataccattgaacattatttttaataaaccatgtaactcagccgaatgttgactctgaaaccaaaataaaggctacgtggcttttttcacaagagggctagtatgtacatactttaatggggatttagcaaattagtcaagatttaaagctcttttctgagtgtaaaatagcaacagcagaagagataaagacatcacctctaagaccatctggtgttgatttcatagctatagtttttactttttcattttgtaccatatggaaaggtactctcctactgggaaaaatattttgtctgaaaaagattagttttctttttcataatccattctggggacactttatcacagtgtaatattttgaacacctttatgactctgtaactttattttatagaaattttggctaacatttatttatagccaatcttaaaggataatgttgaataaatttaactctgctgggcctctgtttgctcttctaaaaagtgagaaaattctgttacataatttctaaaggattgcttagagcaagtttttatcatgattaggaaaacatctgcacatatagcctcttaatctatgatatatctatgtttggctactcaaatgtctacattggttccatgatatagcaaagattaaaaatcacatcaggggattaattagctaggccaacaattactaccaaataaactcattgtaaatttagagatgtacgtatgttctattttaagaaaaaatcctaattcaacatatatttattaagtaccaattgcataccaggcattggagatgttagaaaaaaaacaggccaaaatcctgcccttgtggagtttgtaattaggagacaattatagcccttaaaatgtcctagacattctccaaaagctttgcatacattaactcatttaattataggaggtaggtactattattactttattttattttttaccaaactgagaaaccatttagaaacacttttgataacccctaagtcacacagctagtgaaaagtgaagctgggattctattctagggaatctggcttaagatgaatgtaaaaggctgtaggtaaactccaatgcaaaataaacaaaattcataatttccaagtttgattgaatattggatgatatttaggccaggagaagaattagtgctgcctctctaacagaaagaaggaatagcattgatgccatctagtatattatgaaaaaattggatagagtaaaaacaaacttgatttgctagtcagaattgcagaaatattcaccatccaaaatagaagttgaaaaggatttgtgaaccacataagtcataattacaaagcctaaatcctgaagtgtccgtggaagaggttcttaagccattgctctggatatgttcacatctcacacatacaaaactttttaattggctcagtgatttaaattctcagaatctaagaggtaacgaggagaaatttaaaatggaaagacttcttgaggcaggaaaatggagagcaacagtagcagttggtaatctgccagcaagaaaagagtgaaagaaacaactatctaatatagaacagtaaatggggtcacaaagtacaatattaacctatcttccatatgtttcaactatcaccccaaaatgccagattaaaaaagataagaggtaatacacttgagcagctagatgttagtaataagatgaagattttgagacacaaaaattacatagttctccaaggaagagcctgacaaggatgtagattgtctgactgcagagctcatgctcttactgtctgcccaggctaactctttatcatgaacctgtaatatgaacaacaaaggggctaagttgaaaggactgagatgaggaacctggaatgcagaacaatggcaaagtttattcaacagtaaaaaaaagcgggagaggaaagaaagataaaagaaatgggaagagaagagaaagagtgaggagaaaaagggagacagaatgagaaaattttttgcttatgcttttttaaaaaatgtgttattttattttaagttctgggatacatgtgcaggacatgcagctttgttacataggtaaacgtgtgccatggtggttttctgcacctataaacccatcacctaggtattaagcctggcattcattagctatttatcgtgatgctctccctccctctacccctcaagacaggctctagtgtgtgttgttctcctccctgtgtccatgggtccttattgttcagctcccacttataagtaagaacatgcagtatttggttttctgttcctcattagtttgctgaataaaatggctttaaactccatccatgtccctgcaaagaacatcgttcctttctctggctgcatagtattccatggtatatatgtaccacatttgctttatccagtctatcactgatgggcatttgggttgattccatgtctttgctattggaaacagtgctgcaatgaacatatgtgtgcatatatctttataatagaatgatttatattcctttaggtatatacccagtaataggattgctgggtcaaatggtatttctggttctacgtctttgaggaatcacaacactgtctttccacaatggttgaactaatttacattcccaccaacagtgtaaaaacattcctatttctccacagcctcaccagcattggttgtttcttggctttttaataatcatcattctgactggcatgaggtggtatctcattgtggttttcatttgcatttctctagtaatcagtgatgttgagctttttctcatatgcttgttgcctgcttaagtatcttcttttgagaggtgtctgttcatgtcctttgctaactttttaacgggaatatttttctcttataaatttgcttaagttcattgtagattctggatatccactgactccacagaaatacaaacaaccatcagagaatactataaacacctccattcaaacaaactagaaaatctagaagaaattaataaattcttagacacatgcaccctcccaagttgaatccctgaatagaccaataacaaggcctgaaattgaggcaataataaatagcctaccaacaacaacaacaacaaaaaaggcccacgaccggatggatttactgaaactattccaaacgatcaaaaaggagggactcctccctaactcactttatgaggccagcatgatcctagtaccaaaacctggcagagatacaataaaaaaaggaaactgcaggccaatatctctgatgaacatccatgcgaatatcctcaataaaatactggcaaactgaatccagcagtacatcaaaaagcttatccaccacgatcaagtcagcttcaacttgcaagactggttcaacatacacaaatcaataaacataattcatcacataagcagaactaaagacaaaaaccacttgattatctcaacagacaccaaaaaggcctttgataaaattcaacatcccttcatgttaaaaactctcaataaactaggtattgatggaacacacctcaaaataataagagccatttatgaaaaactcacagccaatatcatactgaatgggcaaaagctggaagcattccccttgaaaatcagcacaagacaagaatgccatctctcaccaaccctaatcaacatagtactggaagttctggccagggcaatcaggcaagagaaagaaataaagggtattcagatagaaagagaggaagtcaaactgtatctatttgcagatgacacgatcctacatctagaaaaccccatcatctcacccctaatgcttcttaaggtgataagcaacttcagcaaagtctcaggatacaaaatcaatgtgcaaaaatcacaagcattcctatacagaaacagtagacaagcagagagccaaatgatgagtgaactcccattcacaactgctacaaagagaataaaataccaaagaataaaataccaaaggaatacagctaacaagggaagttaacgacctcttcaaggagaactacaaaccactgttcaaggaaatcaaagaggacacaaacaaatggaagaacattccatgttcatggatatgaagaatcaatatggtgaaaatggtcatcctgcccaatataatttatacattcaatgctattctaattaaactaccattgacattcttcccagaattaggaaaaaactactaaatttatatggaacccaaaaagagcccatatagccaagacaatcctaagcaaaaaagaacaaagctggaggcatcacactaccaacttcaaactatactacaaggttacagtaaccaaaacagcagggtagtggtacaaaacagacacatagaccaatggaacagaatagagatctcagaaataaaactgcacatctacaaccatctgatcttcgacaaacctgacaaaaacaagcaatggggaaaagattccctatttaatatatagtgctaggagaatgggctagccatatgcagaaaattgaaactaggccacttccttacaccttatacaaaaattaacttaagacggattaaagacttacatgtaaaaccccaaactataaaaaccctagaagaaaatctaggcaataccttttggaacataggcatgggcaaagatttcatgacaaaaacgtcaaaagcaattgcaacaaaagcaacaattgacaaatgggacccgagtaatccaaagagcttctgcacagccaaaaaaaaaaaaaaaatgcctatcatccgagccaacctacaaaatggaagaaaatttttgcttatgcttttacggtataatgtaaaacataagaagtggacaaaaggacaaaagtgatcaacattctgctgaatacactctagactaaagggcagataaaataaataaaagcattcaaattacatataaattcatacttaacacattcaagcattacaactgtcaattacttttaattccagaagtaattttataaaatacaataagaatataatatcttgattgcttgagttgggtcacaactcagacaagtactgtgtcatatatacttcaaatcttaccaaatactcattactagctcatgtctgggattgctgctctaccctttaatggatatgtgtgcattgaagatgtctggatgaggagactaattctagaaggcagacgtgcctcaataaattaaggccttccctaagaaacccgagaaatatatagattttgtcttaaatgtttgtgtgagatatttgcttttcaggcacagatatatcaagtttttttttatttctatgtttatattgatatgccttccacatggttaattaaataaaaagaggggaaaaggagaaagaaaaagattcagagcatcatttgttaaaaagaaatgtatcattcaacataagaaaatcaattaatgtgatacactacattagtagaataaaggataaaaatcacatgattatcttcatagatgtagaaaaagcattagtcacaattcagcaccctttcatgataacactctcaacaaactaggaatggtaggaaattaccttatattaataaaagcctatatgtaactcccacagataataacatattcagtgtgaaaatcaaaaaggttttcctataaggtctggaatacggaaaggatgcctgctttcaccacttcttttcaacacagtagtgttagtcccagccagagtaattcggcaagaaaaaagaataggaggcattaaaactgaaaaggaacgagtgaaactgtccctgtttgcagaacatatgatcttatttatagtaagccctaaaaactctatgaaaaaatacttcaggaaaattgcaggatacaaaataaatgtacaaaaaccagtcctgtttgtactattaacaacaagttatctaaaaagaaaatttgaaaaacaatcacatttacaataacaccaaaaaaattaaatacctgggaataagcttaactacggaagcaaaaggcttgtatactaaaaactacaaaacattggtgaaggaggtgaaacagggcacaaacaaatgaaaagacatcacattttatggattggaagacttaatattgttaaaatgtccatactgcccaaagtgacctacagattcaatgaaatctcatttaatattctaatggtattttttacagaaatagaaaaaaaattctaaaattcatatggaaccacaaaaaccacaaatagccaaatcaatcttgaggatggagaacaaagcaggagttagcacactagctgatttcaaactgtattgcaaagctatagtaatcaaaacagtagagcactggcataaagacagacaaatagacaaatggaacagaatagagagcccagaaacaaatccacaaatatatgtttgacaagtgggtcaagaaaacacaatgggaaaaagatagtctcctagacaaagacaagagatgttggaaatattggatatccatgtgcaaagaaaaaaattaaatctgatccctaacttacacaatacaccaaaaacaactcaaagtggactaaaggcttaaatataagacacaaaattataaaactactataagaaaacatagaggaaaagattcattccattgatcttgggaatgatttcatagatataacacaaaagcatagaaaacaacaacaaaaataaacaagtgggaccacatcaaaataaaaaaaaaggttctgcacagaaaaaaaaatagagtgaaaagacagcctattaagtgggagaaaacaaaatgcaaaccatatatccaattgagatttcaaaatatttaaggaaatcccaaaactcaatagcaaaaaacaaacaaacaacaaataacctgattcaaaaatgggataaagatttgaacagacattctccaaagaagacacacaaatggataagtatatgaacaaatgctcagtgttacaaatcataaaggaaatgcaaatcaaaatcacaataagataccaactcacacctgtcaggatgactactacttttaaagaaagacgataagtgtcagcaaggatgtgaagaaactggaagcttcgtgcaatgcaaactggtgcagctgcaatggaaaacgatatagaggttcctcaaaatattaaaactgtgtctaccatatgacccagtaatcctacttccaggactgcttatttttccaaaagaaatgaaatcaggatctcaaagatatattaggattcctatattcactgcagctctgttcactacagtcaagaggtgcacgtaacctaaatgtgcatcaactgatgaatgaatatagaaaatgtggtatgtacatataatggaatattatttggcctgaaaaaataagcaaagtctgcaatatgtgacaaaatagatgagccttcagaacattatgctaagtgaaatgagcccgaaagagaaatattgcacaattgcatttatataaggtacctaaagtagtcaaattcatagaatcatagaatcaaagggtggaaatgtggctatcaggggttgagtgaggagggaaatgaagagttactaatcaacaggcataaagtttaagtcaagcaagaagaataagctctagagatctgtggtacaacattgcaattatagtcaacaataatgtactgtgcacttaaaactttagaagcatatatttcatgttgagttcttactgcaattaataaaataaaatttaaaaaccatgttttaaaaaataaatgtgccaaggagagggatttagttccaagttttgcatgcagttagaagccaatttactgaactgaattacaaagccataaaaaagtgttttacctgaataaaatgacaattttaaactacagaccttgtagtaggtgtcattacttattgacttaccataaatacttaatgctgcttagtattgttatcacagatctaatttcaacaagagccaattcaagcctaactattcaaggagctacatttcttatcagggatttcagacattcagagcagattgttgccatgttctaggacaatgctcctacatgataaaggaggtatttattttttgaataagataatactgtaatggaatacatatagaagaactaaataggttactacacaaaattgaatattgcttaaagaaatattaaaaagcaacaaaaccttttaatactatttttaaatgaaacataaaacattggatcacctatgaattcacttcctctctgtcaatattttatttctcgaagctactgaaaatacagctttcaaattctagttctggtattttcaatacagattttggtaccatcacatttctcttttttatctgattaatgagctactgaaatatccttgtagagcaaaaacaaaaaataccatttgttttcaatatagaattattttgttttccaagttcttaatgtatatgtgtattgatttgcctatttaactctccaatgacttgaaagttagacccatattatatacgctttttttataaaaacaacaacatcaacaacaaaaaaaggtctctcactctgtcgttcagtctggagtgcagcggcgtgatcagagctcactgcagcctcaacctggcaggctcaagtgattctcctgcctcagcctcccaagtagctgggattacaggcatgcaccaccatacctggataatattttaaattatttttcatagaaatgaggtctcactatattgcccaggctggtctcaaactcccagccttgagcaatcctcctgcctctgcctcccaaagcagagactgggattacaggtgtgagccaccatgtccagcctacatattctcttttttttttttttttgagacggagtctcgctctgtcgcccaggctggagtgcagtggcgcagtttcggctcaccgcaagctccgcctcctgggttcacgccattctcctgcctcagccccgcccccccccccccaccccgtagctgggactacaggcacccgccaccacacccgggtaattttttgtatttttagtagagacggggtttcaccgtgttagccaggatggtctcaatctcctggcctcgtgctctgcccgcctcggcctcccaaagtgctaggattacaggcgtgagccaccgggcccggccctacatattctttaactgtggatctgtatgcatacaataatgctttattaaacttgtattcatatctaacatttttcttaaacacacaatgtttagtgtgcagaccatgcatattcagtgaatatttcagttccttaaaatgtaatataatgtctttgtacagttcacagtatcataattttatgtggctatcacatcagattgctttttactgatgattccaaaatgaaaaaacaaagccactaacattacggctttcttcacattgaactaagtttaaatttgaaagaaaatatgcagtaatacaggactttataaagtattcctgatcaagggaattagaaagacatattaagaatagaaagaatttagtctcttttcctccttttttccccttcaagacaattgtctttgtatattgaataccagataaataaagaacccatattacctgctttcttttccaatagctttgtttatatctttcctgtggtgcctaatattttctctcttcactttggacataggtattttaatttgcacttaatatgtgacaatcattttgaaggattctcatctactgttacttgttaaatcaagctgtataaaattacctctatttggtcatttcagaactacaaacatttgccagcaaaacaaagaaaattggttttgaagaattttctaaaaagacactacactacccagtgacgcttcaccgggaagactacagatcctaccttttccttggttgagtacaatgtcataatgccaaatcaaagaaaagactttaagagtagcttcttaaagtaaaaacgtaaagagtagctttaattgtcacacctatttgtgcccaaaatccaataccttgtctcttgattatttccatgcttgtgaaaccaaggcaataggtccccagaacatgagggcaaggttccaataaaaaaattcctgtgacacagggtgcctatcaaaaaccaatactgctgactaactgcagatttattggatagaatgtgattgaaaatgcaatccataaatgattaaacagtagaatacagcaactaaagcagaatgactaaaaggaggtagaagaaagaaatacctttgaaatatgaactaaagcatattactaaacaactagacatacctattttcttcaggaacagaagagtagcaagaagagtatgttgttatcaagaaaaaaataaatataaaggtggctcttagaagagactttgcagaagctggaaattgagggaacagctgaaattactgtgatgctttggaaataattgccacaactgcagacaaaaagtacatgctgcatccagatgtacagttaaaggttgatgctaatatatctctgatacttgacctgttcactatttcccagcataccaatcttctctcctgttagtccttataacaatggactggatacactatccctacaatatgaactaccacatagagtcatttttttctgatttaattaaaagctccacgtaaaccaatgtggatgttgtaaatcatgccgagttgtggtacacatgcctctgtaatattaacagtggccccaaggctaaatttagctataccacattattaaatcctatgagtgtagctaacatcagaaaaatgttttgaaagcataaatattttagcatgaagatttaacaaaaatgtatttcatcatatcagaatatcaggggggaaaaactcactcatttataactgagccaaaggagagctgtttgcattttgccttgtctgtaacttggagatgtatcctataagcgttctttggtgagataaaaaccagtttctattttcctactaaaatatttttaaaaattgtatttacctggcactgattagtttgcttggtcttcagacacaataagaacatgtttaggtttcttcattaagaaagtaaatatagaatattccaaaaaggctttagaaaattcagcagaactaatgtaataaacatactcactctaacatgcataatagtaatataatttacattaaatggatatacaatattttatatttacttattttgccaactattgacaaaattttggaatttcgctatgatttaatattacttctgaatatatatattagtagatagattatatcattgatacttttcactaaataagaaagaaaaaggaaaattgatgagctagatgatattttagaaagcctcttttctttcttcacaaaggatattttcagtacacccactaccaccaccataactaagagcctactatttgccagttactataaacatatgatttaattttatcttcacaatatctgtagtgaggtatgaatctggggaaactggtactgtaaatgccttacagcttggagaagaacagtggctaggtatgcatcttctcttaagttaggataaaatcttcctgacagtgactttttctactagaaatattgatagcacaaatatttgcaaagagtcactcaaatatgtgcattaggtccagaaataacttgtcagttaatttttaagaaataatcatgtaagccccatgtataaaaggataatagcacaatcaggtattaatcttctcaaattctgtatgcctaaactttgcttgcatggaccttggggctcaagggcagctgtgtacttatgggctgcatctactcctttgtagcaacctcatttcctctgtgttttattattgttgttattgtcattattttgctaaataaatgtgaaattttattgtgagcattctattcccatcattatgttacctaccctagaacacctcataaacatgatttagcagaaagcaaattcacagagttgaaggaattgatcatactactctactgtagagagaaccagaatccacacccagctcttgttcaataatgcttctttaggtagagttgtttaaggctccatatgcaccaacattaataattgacattaagacttgaatcttacatggaggtaggctggatagtggattttttcattgagtgaccaattgttttgttttggggggactattgggtttcccaggatgtgggacttccagtgagtccaaggcaaattaggatggttgccctgcctaaagatgacattttgacataatctatcctagtattcggagtgaataagtaatatgactggccacatgaacttaagaaaataatattttgtattttattgtatctcctttgttagagccagtaacctataaaagcaaattgtcagtaaatgatcatggagctattctaagccacaagttatatgtgactagctcaaaaatcatcaagaaattgtaaaatgtatttctaccaactgaattattgcctatgataatgcaattcttagtatttcactagaccagtaaaactctgaaaagaaccaagctgtggtctacaaatccataatctagcaagtttgaaaattaaaaattaattgttcttaggagtataaaaaatcctattactttattttagcatatcctcgacccaatctactgaaacaaatacaaaatacatggtctggacttttgcaagattttctaatgaataattattttaaatttttcaattataatctaacagcatattaaaaataatacatatttaaagttagaaaaatataatcaatgaatatcctagatgtttgctaaaacacagattatttgatatggtccaaaatatttgtattgtgagatggcttttagtgttgtctttcatttgactaaggctgtttattgtatctggattatgatatcttctgggagagttactagtttatggggtatatttatgttaagaacccatagtttcaagatacatttgaataaagaaatacaaaaatttcattggtaggacaacaaaatgcaccaatgtagggcgatctcagcaacatgcaaacttccttttatgacagtaatagaattttaaaaaatctgggtcatcttattgctctggatactgccttaggaaaaccaaagttgaaacctcttaatgaccattgcttctgttcaagatttgctgtcttatcatcatctatatttttacatttctgaagttacattagtgaaaataggtcatatatgtgcttgattaccttaggaaatgacagagcactgaaatgaagaatctgttgaatatcaacaaccacaaccttgcaagtttcttctatttcctaataaaccattatcaatttcataaaaaatattttgtatttatgttaaacatttgttctcctaataggttagatataaatatacctagaatatgagtcatttctatagattttagtgggaaatactaatatctaacatatgcagtgacaaaagtcatccataaaatgatcatgaacttatttcaagattaatcatccatgattgaagctataccctgtaggcagaacaatgctgtccccaaaagatgcccatgtgttattatttttgaaaacaaaaatgttttcttcatttttaagaaggtgaaaaataagtttagagaagctaactattagtaacatcataaaagatttcagaaccaaaatttaaaccttatacttttgaatgttaaaacttatgcaaaagagttacagggaacatcttattctctatatctacaatattctaataagatttgttgtgttccattattggctgtagtagtaaacactgttgttcagataacctggattattatctatgataaaaaattattaaagcacccatatttccaatattttagcgcatgaaaggtgaaaagtccaatgttttttcttccatttcacatattagctttgccctcactgaaaaagaaactcagggaaaaaaatccaagaataatgcacaagttcactgacttatcatttatgtccctgctgtaatcttttgacgatgcttttaaaaatccatgatgtataacaggagtgatatctgtctctccctaaaatttcatcttaccttcttcctttagagttgtgttctttgtatttccccaaagctaagaatacaaggccataaatgttctcaatagagtcacttctttaatttgagttctcagtgaggaataggctctttaacatatctgactcattttcttgctttgatttagcatatattataaacttatgtctgaaattttaaggaaaagcaatcctaaatgcaaagtccacattcagtaatttgggagtattatagactgaattgtgtctttccctccaaattcatatcctgaatcctgtctgtgtgactgtatttggagatagggcttttacagagaggtaaccaagggtaaatgaggtcctaaggatgagactctaatcaaatatggctagtgtccatgtttgggacactagaggaagggacactagagctttctctctttccctccatgaatgcacagaggaaaggttatatgaagacacagcaagaaagcagccatccgcaagccaagaaaatagccttcaccagaaaccaaccctgatggcaccttgtaaacttttgacctctagacctatgagaatataaatttctaccgtttcagtcactcagtctgtggtgctctgctatggcagcccaagctgactaacataggacatcatcatacgtataccatctattttcacaaacctaaatagtccttaaaaactgttattgatggttaactagcatatctagattctaataaatgattctcttgattatctagatgctatgaagatcatctaaacacaagaggctagagaaattcatatggctaaggaaaatggctgatgttagtactaaggtgcaagttacggcaaaatctttgctgctacttcctcttgcacttacactggctgtctatgaccataggtgtagcatatcgcaagagaaattgtttttgtattttgtttcatgcccacagctatcaaaatttatataactaagatattttctttttcataaggcttaagtaagttagttaaattcctctaaacatgaagagaactatcatgaatagataacagtataccaaaggttttatactgaaattcacaacaatttctggacatttatatcataactttcctaagagctatataaaataataaaaagagataatagttgcctaacataggaaacaaagacgtttcttgacctctatctttttccatgaaaatttattgagacaaaaagaaaaaaaaagagtagaagagaaaggaaaaaaaattgaagaataagtgagagagggagggaggagaaagataaatattttccctctatttctatagccagtaatacttttatggcttggtttcttgaattaaatcccatttaaagatgatatcttaattagataatgtttataaatgctaaggtagagcagactaaatcaagggacttatataattaggccaaatgagccacacctatcccttttttatacacttcatcataacctctcaagcaggtaaaaaatatgtttttcatcctaatataggtaacctacttaattcttatttgcctttgaagttgtgagacatcaagtcataagtgcttgaaattcattaaaataaataaaacttgttttatcataatttctatgtgtcctagtgttggtaacacacataatataagaaatttaaaataatttatactcagttatcctaattatgataatttcaaaatacacctatattaccatctaaacttataaattttaacaggcttattttaataaactatgagaaatacagctacattaagaatttaccaatcaagggagtatatattcatggcaatttgaatttatgctcccaggttaaagatatatataaattttaaaaataatttaccaatcaagaggtaagcccccttttcatccaaatatgagtagggaaacaaccaaaacaacttctagaccctcctaagcactgtgtcaattggtcagggtgcatgacaataaataaataaataagtcactttatcttttataaaattctatgaactgtcttgataaattttaagacagctagattaggtgtgatacataatgacacttctgtggcaggagacattttcatagcatgccaaacaagaaatgggagtcaacaaattaattaacactttctctggctgatatacaattatgagttccaccacaatgctatttcacagtaggaaagttaagaaaccacatcactggaattctacagatgacattgactttatcatgacacctagacactgcctttcgaagcagttctagataattaatttctattcacaaaatggaatgggctcatggaaacagtaggataacaaggactacatattattatcatccaaagtaattatttaaacttgtttaaagtgtatacattgccaggccatctgccaggaagtctagttcagcaggtatgggatggagccagaaaacttactccatggtgtaactgttctgcagtaagaactttttagacatttttacttctagtatacattgtttccatctttacatcctgtatcatttgggcattgtgcaaatcaggtccatagactgactgcaattaaaaagttgatgtgattgtggagatgttccagtggcattttgtctctaccaaaagtacattgattagccaattatttgacattcattgaaagaataatttctaaagtaaagtaagacttttataaacatattggtttacagagaagattaacgaaacatattacaatatgtataattttcttctttcaataaggtacacattttccttgacattttgcaaaccaacagtttaaaatacagtaattttacgtacatcacttagagattcaaaacagtaagaatcactaggagcaactgactttcacattgattatagcaatggtaacttatgttcctcttccactattaaaagagcaatgaaatatctcgcatgcaattacttgtagtttacagactcatttgcatgaggatgttctaagcttaatttataccctgtgtattttgaaagctacctcatttatttcacctatttgaaattcacaaacccttccaactatgagcaccaccagatggaaaaatttctgaagtgaacccagtttgaatgtgtaaagtatgaagcatatgacatgtctgattacagttactgaagagttgaataggtactagtttatatttttaaactcaattacttaccataattctaatactcattttgcagtgaacatcaatcaaaaactttgtgagataatttataaaggtgaataataggtttttatgtttgcccagtctagatacatattagctgaaaaataaaaaatgcaacataaagctgaaaggttaaataaagtatctctagtacagcactcctgtgacctccatagaacaggtattcaaagactgttttctaagccaaatttttttttttaataatcacagaaataaagtcatccagttactttaaaagatctcaggaattctatcacttttcctggtaatcttccccttttggctttaaggtatgaagtccttatttattcctaacaaaacactctggctgagatttaagttcattttctccatctctgtgaaaactaagaagagctgtcagtctcctatttagaataactcttcaaacactggagtcaatctagtccccattccttatgagctgtgggaccttggaaaatgataaaaatcacatctacaacataaaaatattaaatataattttattggttatctttgtctttaaagaatttttgcataagtcaatttagttcattctcaaaacaatccagtgaggatgctttaattgctgcaggacagttcattatgtgtcagatgatagaaaaatacatgacaagaaaaatctacctgtttatgttcctatagttataaaaataaactgagataaaaacactaaagattttaaaaattaataaggcactgctaaagtgcaaagtggtaacttaattaataatatatactagtgtttttttcttcctcattccatagtaattcttttattcatcccataggccatactttcattttatttttaattttctctgtatctatatatttcaaaaaaattaaagaagctaagaaaaacaaaattagttataaggcacaatacatttcatgccatgaagaataacataattataaccagttcttatatgttaacctgtttattcttgtttctcaatatccaatttccccttttttaagtcagatgagattaacttttataagtgctaagtccactaagattttatatttctatttttttctgcaacataatttccatcacttttttttttttttttgagacagtctctcactgtcacccaggctggagtgcagtggcgctatctcagctcactgcaacctccacctcctgagttcacgccattttcctgcctcagcctcccaagcagctgggactacagtcgcctgccaccatgcccggctaatgttttgtattttgagacgaggtttcactgtgttagccaggatggtctcaatctcctgacctcgtgatctgcccacctcggcctcccaaagtgctgggattacaggagtgagccaccgtgcccagcctccatcaactatttcttatgattattgataaagtttaattttctctcattgttcttgtattttaatgacttttaactatacgaaatagagcattctctagtttttttttttcttttattattatactttaagttttagggtacatgtgcacaatgtgcaggttagttacatatgtatacatgtgccatgctggtgcactgcacccactaactcgtcatctagcattaggtatatctcccaatgctatagctccccccccgaccccacaacagtccccagagtgtgatgttccccttcctgtgtccatgtgatctcattgttcaattcccacctatgagtgagaatatgcggtgtttggttttttgttcttgcgatagtttactgagaatgaagatttccaatttcatccatgtccccacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatcccggaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagataagtaggttgcgaaaattttctcccattttgtaggttgcctgttcactctgatggtagtttcttttgctgtgcagaagctctttagtttaattagatcccatttgtcaattttggcttttgttgccattgcttctggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacttatggctagccaattttcccagcaccatttattaaatagggaatcctttcccccattgcttgtttttcgagcattctctagtttaagacaatttaaatcttagccaaaatcagtgttcctccattgctgaaccataggagggtcccaataagtttctgatgaatagaaaaataaatgtataaaacaatgaacattttgaaatcttggcaactcgatggaacacatgttgatgaaccaatgtcatagttgactttttaaaatatattttacaataaagtcctaggtttaatctttttatcaactgagttagttggatttgctgaccagctctttgttggaagaactaataaagtgtgtttcacatgctttatacgtatccactcattaattctttctacaacttcatgagtttatgaggaaatcaggcaaagaagagtaagatgacttgctcaacaaggtgcaaaagctagtaagtggcacaagcagagtctagacccagacacaaaaaaagcccacacttttagagatttttgtttaatgggaaaagggtctttaaaaatctttagtctaatatagttacttaaaagtaaaaacttatatacctaatgtaaatgacgagttaatgggtgcagcacaccaacatggcccatgtatacatatgtaacaaacctgcacgttgtgcacatgtaccctagaacttaaagtataataatatatatatgtaaaaatttatattgatatgaaaaattggagtttctcaaaaccagttcaaattttaatttattaaagtaattctttatgcacattcatacaaaatatgtttttctcatataccttctctttgctctttcatttatcaatttcttctaaatatgtttaccgttattctggggtctatattattgaacaaaggctaacttaagtttcaatcctattaatgttttcacattttctacaaaaatattgttctaaaaacatctatctgaaattacctattagttttcttgacttgacacaaagtaaaagaaagtttcttttacttaactttgaaagcacaaaactcatttagcaacttcaatcacgaatttttatatgtagaatctagtatttctcaagaatatttttgaacaggatatatgctcgttagtgacattttagaatgcaatactttaaagagctataattttgtatgttatacacgtaaacatattacatggagtatattacaatgacattttactgtgtccatgtatgaagcttttcagatatcccaggattttctgggaataaaggtgcttattcctacatacaccgtagaaatcatttggtctttaaaaaagttaaagagagtttttaaacattagttgtagataagatacatgtaacatacagagataattccatacctgttttattggacagtctaaacgacaccatcttatcaggaatattacatacattcctcactgaagcaatgcagctataattagcatagtcctgaggtcgaagattctttagttttaagatctttgtttcaccctgaaaatgtacacaaaaaataaaagtcattagaaaaagccaacacaaccagaatgaatgaaacatcacatcacattacattgtattaaatcatattattatcagaatatgacagactgtctttttttaagggaaatgtcctatctttcaaataagttataaatgaactaactttaaaataacactgcattttaaaataatactgtaatattaagtatgcctggagataaaaactaacagactacaatgaaaattcataacattttctttgcaaactagcttcctcaggggaaaagtctatttctggtggtagttatgcaaattattatgcaaagatcagagcagtgtacttaataatggagtgcattcaacaaacactgcaatctattcagacatcgatgtgagaagacaaaagaaaagaatctgaagaagcgccaacaaatgaaacacggttgttagaacaaagttaattacgtaaatctaatgatagataattacatttataaacataaatattttgtatatggagcaatgacaggtgacagatctaaaactgaaggaaagaagcattcgtgagtgtttctatattattattgttcttgttatttcatgttcaagagtttaaggggtaactctccaggtaaatctgcacaactgtagatagatgcaaatcaagcaagtggccagaagtatctaacaaactcttgatgaaccaagaaagactttgtaaaaacattggattgaaattgttgaaaggaaaaaaagaacaaacaacaaaacgtagtctcctgcccaattcaaattaggtcccctgggctttctttgccttctaaagtcattaatgcatcatctcaaaatagttcttcttgtaaataacttacttattttaatggcaaaacagtgtctcaatgattttatagtattagggatactataaaaattcaaaatgtttattttttccagataacgtgtgtacggaacaatgtgtttcatcactttacctgggtaacatttgtcgagttctaaaacttgcaatactttcatatgttatagaggaggactggaatacttagtgacttactacataaaaacactgctgttcatttgcaagaaagcttacccagacataggcacacagttttgcaaatctgtcaaatgaatctctattctagtgtgcatggaattgtggccataagtattttcattcactgtccaaattcagtcttaaatcagtcacccctttagcattttcctcagtggtaaaaaaaaaaaaaacaaacaaacaaaaaaaaactacctttcaatttttgtttagaagaaacactgaatttttaacttacaagaaaatataaatgtatccgatacaagtatacacataaatctatatgtttctagagtttatatataaaactattctcttgtgttacagaattcccatacatgatataaaatgcctagaaagtgggcttagctagaaagaacagttgaaagaaaatgatatgctagaattagtcaactcagataatttttaaataaagtgatacatcttacctctcctacctttgtcacacgtattgctcaaatttctttgcttttctttctcctctcaatacgactagtgttattccttggaattctacttgttccatagttaacctcactttataacatttcattaggtggcattatccttgctgatgaatttctactacaagctctattttcttgccccactcccaagtctaagccccatttccagaattctcccttaagtttcagatacacataacaaatgtttgtcaatatgtccattctgatacttcagacacatctgaactcaacatatcctaaattgaacttcaaatatattcctttaaacctactcctccttctgtaataatgggaatttacacccaattataacttcttattcatacattcagtatctctgtctctcagctagatccttttattgatctttactcatgttcaatcccaattattctttgtatctatttttaatcataatgctctaaaccctacaatcaactaaaaaactcatgattgtacttagtatagcttaagaatgcaagcaagccacaatgatttacactttaaccaatatttttttcagctttattgaagtataatggacaaaataattgtatacatttaaggtatacaactgtgctttgatatacattgtaaaataatcatcacaatcgagctaattaacatatacataacctcacataattatttttattcacttgttaaatacatgaaatctaattatgccatctccttgccagacttctccctttgccagtaagtacccagagagtagagattatgtctgtcttgctctcagcattatattctgggcacgtgacacagggcttagcagagaggagacaatttttaagttaatactttttcagttaatagtactgtaactacccaaggtttgctttatatatatttatttctccagaatttactatttgtttggcactggtataaactcaatataattaaatgagtaaaatataatcagagcctaaatacacttaagagaaaaattcccttacattattacagataatcaatagatatttgtgcatattgtaaaaaagaaagtgggtctgttactctagtaatgatttatctagattgtgcttttaggtttggaaggaaatttgaactgaagacaaattatcaggacaaaactcaagacaaaacttgagccatatcaaaagaaataaaacaaatgaaaatcagtagaattacaactgaaaaaacacatggatatagatattgatgatatataggtacagatacatgcagttacatatatatgatgatataatgaaacaatatataatacatgcaattacatatttatgtgtgtatatatacacacacacacactatatatatatatatatatcacacacataattactccaaaaataaccaacctctaatcattctgaaagatttactgcatgtagtcaatattctaaaagcaaccacggagtgataatgattctcagatataaacaaataatgaacattgtcatttagatgtatatttaataataaagtctctttactcacatagagttaattatactctgtcagtccttgtttctgtttccactgacaaattctgtttcaatttgcattttctgaataatacttttccaacattccactgaaatagtacctagtaatttcattaatgatgatgatctcttgttaaaatttaataaacctttcttttgtatgcttccatacttctctgcttatttctaacactttagattacctttactactgtgacagctcctcgtatataggcaattaattacagatataataatttagtcatttcttggttgttttaccattgaatattctagttactgaagtctgcaaccttttactaatatattcctagtgaaatctgatccattatcatggttccaatgagcactaatgtatagataactgacaaatctctagacaaaaagaaaaaaagcaaacttactaaaaatcaccaatagtattataattaataaattctagattatcctaatttttcttgtccttggagttgcaatgtttgctagcatacattataggacatacttaaattttggtctatcccactcaacattttccccaagaagaaatgtagtctcttatccttttggatctcttaagataatctatgctgcatttctaattctcttttctttttttttcagggggtgggcggggtcaaggtttaagggctagaaaaccttgaattgttccccttcactgaaaggtcatttcaaaaaccgttagtttgtcatttgagactctatgcagtctaagcaaaacactttttccttattcctcacataaactcttcattctcatcaaattagttatgtcactatcttgaggtatctctttatgatttcctaatgctccccattccttgctatgagtcatttttttgttcctatctgaactgatgtgtccttcaaaaaatatattgtgactggagtgcagcgcaacaaagagcataaaatgagataagatttcaaagcttggaaaaggtcatattagaggggctatgatcgcagatttatatttattctaaagttacttattctgtgtttaacgctactaatctcctctttctaatttttttcaccaaggcttgctttctcctcttggaagatacgtcaaacttgatttccaccaaccctaattctccatttcaccaaacaactctactctccagtctttttgaattttatctgacagccattatttcaagaaagtgttttctctctttttttttttttttttttgagacatagtttagctctgtcacccaggctggagtgcagtggcgcaacctcggctcgctgaaactctgcctccaggttcaagcgattcccatgcttcagcctcccaagtagctgggattataggtgcatgccatcacactgggataatttttatatttttagtagagacgggatttcaccatattgaccaggctggtctggaactcctggcctcaagtgatctgcctgccttggcctcccaaagtgctgggattacaggcatgagccactgcaccagcctcaatatgaagagatttcaacctaaaagctcttacttctgatccatcctctaaaagtgtattcttcctatacgtattctcctttactttttgagttaatgcttttgtctatttatatcagtcacatttgtgtatatatttatatatgtttttatcatttacattatgtctatgtattgatcctgcctttccatttaatgagatcacttcaaattctcttccctaccatttgggcagtgttttgcatgttgtcaactcagaaaagattgctgactagataggaatagagcacacagtaaggttttagtaagcttcctgaaccatgttgactctaatggtagtaataggaactttaaaaatctttacattagggtagcctgcaagatagatttatgaagctgcatttggggccacccatagcagagctgaacagtcaattatggaaaagagaatgtaaaagaaaggtaagccccaagggaaatatatacaataatcaagtacagagaatcaacatcaatgcagctctggccattaaaatgcagaggtggcttttgtaaaggatgcatccttaaaatattttgtatacctgaatttttttggtcatggacactgctggtatttatgttatctaaaggtaaaaaatatgaatttggtggtaatattgatattacaaaagagaatttgtgctactgtttgagatgatttctattctttaaagacctacaagtgtggccctataaatacaatggtatgcacatccatatcctagttaattcttattcagagcacagcaacaaaattggcataggagaaggtgctatagtttggatgtttgtccctaatcttcatgttgaaatttaatcccaatgttggaggtagggcctaatgaaaggtatctgggtcatgcgggcagacccctcatgaatagatgattaatgtcctgaggggggctgtgagttctaactctgttaatttccttgagagctggttgttaaaaagaaatctgatacctccccctctctctcttgcttcctctctcatcatgtgatctctgcacataccagctcccctttgccttttgccatgagtgaaagcagcatgaagccctcaccagacgcagatgccacatcatgcttcctgtacagtctgcaaaactgagaaccaaataaatctcttttctttatacattacctaatctcaggtgttcctatatggcaacacaaaacacagaacacaataacaaaatggactgtaaagaatagacaaaaaagaaagaaaagcctctagagccatgatttcccaatggttcagctatcatgggattggagagttgttctgggtgagttaaaatgatttcctgcagtcagaaaacaagataccaagatatgtgaacctagagggcccaggtaacatggtctctaagttaatatgtaagattaatgtatataccatgccaatgggagagtgggtaatacagatgaagtctgttaatggaatattgtttaaaataacagaattatggaaaattttgagccttaccttcttaattcatgacagtcagcatataataaaaatattttaaaacaatacagcagaatgtataagaaagcagagaatatgtgcacacatagattaatgttatcaaatggcatatatgtatacctgtgataatgagtataatttaggctttactatttataactactttaacattaattttattttgttgatcatttgaatttgatactttgggtgttgggaggctttttgcaagtgaattttcatgatttgtaaaaaggaattttgagttgattattgtctaattgtataattagtctaattagactaattataactaattaggtaattgatgtaaatatgttcagtcttgtaattagatggtataattacaatacacaagatgatgtcatgaacatctttacaaaagttctagactaatggaaagtgaattttcaatttgtaagatttaagcaattgtttaacatttcttaaacaattacaaaattatctgcaatacatatatttaacttttgacattattttttaacaaaagaaataaaaggaagacatacaatgtatattagttagtggcccttaccaatgctgacattgctgtaatgaagcagcctcaagccgtatttccatattacttataaaataaactagaactttaaaaaaattatattcattcattttgatacttagatatcagtaaaaactaaagtctgtcaatttagattcattttatgaagctctaatgactaatttattacaaatttataaatagaaaatgatatatgctggcctatgtcttttagtagtaagtgagtggaaggacgaaaagtataattattcgtcttagaaatactgcattatgtgcttatgaattcatatcagctttaggaacacagaccaatttttttctggaaacattgtctataaaaaggtataaacaagatttttgtcactcaacagaattcaggaataaatattcaattcaaattgctatagttattaacatataatgaatgggtatacaaaatagatatatctcatcttagaaattctattttattaaaaacaagacattattattaaataacattattattgaaaacatatcttcaaaagaagtttcattttctaacattaaaacttaagtagacatatgatctattatctgaacccttccaccatatatacccagtatgacttcccagcttcacagttccctgttctccacacatactaattattgttctaactaaccagagatacagatactctttggagacattgtctttcttctgcattacttgcatgtgctaatgtctccaccttgagtgctccctccatagcagtgttgtgtagctctatttagacaacgatttttattttatatcataattattgatcaccttaagttttcctttatatatcaacaaacattagaggagaagccttgcctagtgacctctgtgtctctggaaaaggtatgcccatatcttgaatatactagatcttattttaactgaatcttatttacgtcatgaagccacaaaggtcaatgactatcaacctaaggagataaatttaaaaattaaaatattattgaagtgctccaatacaaacaatactaacataaaagtttttttcattatagagtacacatggcagtatgggaaacagtagttcaagaaatcaataacatctaagaagtatatatgtatatgtttatataaggttatatatacatatatacacacaaatatatatgtgtatatatatgtatatatatacacacatatatatacacatatatatatacacacatatatatacacatatatatatatacacacacacacatatatatatatatatatacacatatggagagagggagagagaggcataaaaacactagcacaataagcaaaagataaagtaaacagggaaagagtaacccaatatggaagtataaaaaggaaggaatgagacatcatatcagcttttcatagatggcttctctgagatgatgagtcctcagtgttaagaaggcctctgccatattatcaaactaaagaatacctagaaataaatttaaccaaggaggggaaagatggatacaattcaaaccatcaaacatcgatgagaaaaactgaagaggatacaattaaattggaagatatcacaggttaatggattggaagaattaacattgttaaaatgtctgtgctatccaaagtgatccacagattcaatccaatcttgtcaaaataccaatgaaattcttcacagatattggaaaacacaatccaaaatttctatgaaaccacaaaagatcccaaacagccaaagcaattttgagcaaaaacaacaaagttggcatcatactatctgacttcaaaatattctacaatactatagtaaccaaaacagcatagtactgacataaaaatagacatagagaccaatggaatggaatagacagcacataaccaaatcaacacacttacagccaatgaattttcaacaaaagtgctaaaatctcacattagggaatggacaatgtgtcttcagtagatagtgctgggaagcttgaatattcacatgcagaaaagtaaagctagacttctatctctccgcatataaaaacatcaactcaaaatgaattcaagacttaaatgtaagacctgagataacacaactactagaagaaaacataggggaaatgcttcatgacattggtctggggacaggcaactgaaacagaaatagagaaacagaattatattgaactaaaaagcttgggcataggaatggaaacaatcaacacagtgaagaaacaacttacagaatgggagaaaatatttgcaaactatgcatttgataagaggttaatatctagaaaatacacagaactcaactcaatagcaaaaaaaaatctcattttaaaatgggcaaaagatgtaaatagacattactcaaaagaatacatacaaatgaccaacagttatgtgaaaaaatgctcaacatcactaattattagggacatgcaaaacaaaaccacagtgagctatcacctccctcccattagaatgctattatcaaaaggacaaaaaataacaaattctggtgtggatgcagagaaagaggaacacttatacactgttggcgggaatgcaaattagtacagccattatggaaaacagtatagaggttcctcaaaaaattaaaaatagagctataatatgatccagcaatcctactgttggatagatccaaaagaaattaagacagtatgtcgaggagatacctgcacctccatatttattacaggactattcacaatagacaaaatatggaataaacctaagtgtccatcaacagatgaatggataaagaaaatgtggaatatgtacataatggaatactattcagctatgaaataatgaatgcagctataaaataatgagtgtttattttacctaatataatgttctccagatccacccacattgctgcaaatgatgggtctgtcccagagccagcaacatggatggatctggaggacattatgttaagtaaaataattaaggtacagaaagacaaatactatattatctactcatgtgtggaatctaaagaagttgacctcatagaattagggagcacaataatcattagcagtggttagagagagggaggtagaagggagaatagagagagattggttaataggtgcaaagttacactttggaggaataaattctagtgttctattgcagaataagttgactatttaacaatattgtattgtatgtttcaatacagctagacgagaatgttctgaatgttctcaccatgaagaaatgataaatgtatcaggtaatggatatgctaaataccctgatttgattatgatacaatgtgtagacatgtatcaaaacatcacaccataccagataaatatggacaattacaatgtatcaattttttaaaagtttgattgtgcttgtttaataaatttaaaataaattcctaaatactttgatagtatgaaagattttccaaaatctggccaaggcccctgtgttcatttccaagtgattagacccatttgcaggttagaaatagccatatagccgggcacggtggctcacacctgtaatcccagcacattgggaggccaaggcaggtggattgcttgaggtcaggagcttgagatcagcctagccaacatggtgaaaccccacctctactaaaaatacaaaaattagcccagtgtggtggcaggtgcctgtaatcccagctactcaggaggctgaggcatgagaaacgcttaaaccctgaggcagaagttgcagtgagtggagatcatgccactgcactccagcccaggtgacagagcaaggctccatctcaaaaacaaacaaacaaacaaacaaacaaacaaacaaaaagaaatagccatatagagaaaagatgtttagaatttcctcattatctataaatgttatcatgttttacaagattctagaggaaaacatgttttctaaatcttaatgtccatattttaaaaataaattgacaatagaaaaataaaatatgtaatagatgatcatttatctggataatattttaaactaaaaaaatcattttagtaacaattggagaatgcattaaagtactgcggaatgtatgggggaaaattcagtcctgcctgctggcagagaacacttagtatcatagtggcctaaatcaagagacgatcagattagaacaggcttcgtttcagtactatgttatggtgaactgactagtaatacatgtgcgatgctgatttccagagatttatattttggtaagttaaaactgttctataccttttaaaaaataaagaatacatattttaatttacaatctatttgcaaaacaggaatatatatgatgtgtgcagatgttatcatataatcactgcattattccacagttaatgtctaaatattggcaattatactaatctgaaggatctcaggccttagtttaccatataaggaaatatattcaatggtgaaaaatgggatcctgagtagctgggattacaggcacgtgccaccatgcccagctaatttctgtattttcagtagagatggggtttcaccatgttggccaggatcatctcaatctcttgacctcatctcagcctcagcctcccaaaatgctgagagtacaggcatgagccaccacgcctagccaatttatataatttttaaaattatttttcattatcacaatacttttgaacatttgtccaaatttttttttatttaaaactttttcattgttaatttaggtttatgcttctttcatcaaaaaacctttataataacagcatgcaaatattcccacgaatttcaatatcttcctcaggacttattaattccttactctttgtgtattacacaagaatatttcatattacgctcactttatgtaaaattaattcaacttttattaaatacatttttaatgactcgttaaatattttcatttttagcataattaaagctctatttctaaaccaagtcaaaaacaaacatgactaaaggaaattaaagacatatctttcctaaaactaaagccaaataaatttcaaacaagtttcttcatttttttaatagttattcaccatttgcaaatggggaaatcaaaatctctccttttgagaaatactttccacaaaacccaaatcagctagcaaaatgtataactatgtacattatagtgaaacataggaaaacttatagattaaaaaaaagttaggacatagtaagttaaaaaatgttttcaaaagttaacattttaaatttaactaaccacataaaaataagttgtcctttatatttaagttctctaatctttaagtcaagcacacattggtttttgaaaggccagaatagagaaactatcttttcaaatagctatgaattcatgctgcctgaattaggaaagtatcctagcagagtagggtggaaatactgtaccttaattcatacctgggtaaagaatggttcataaatctcaactcctttatcagatccttgcagcaagacctcctggccacgtctccagctataccgaacaggaggattggaattggcaacacaccggaggaacactgttctctcatagtaaaattgttctttagcttcacctatactttgatgaacagttactactggatcatccaaatctaaaggaaataaaaacaaccaaatggcaatgttatgagatagatgacttttaaagtattgtgcttatataacccaaccaaaaatgcatattcctcattgattgtattacttaccactaggtactctttttttcactcagcttattgaattcatttacaaagacgtttccaatgataagaagtatattagtatctctatttgtggatatagtaaaattaatcttgtatatttctaactctttgtcaatagccacataaaacagagttccatgagagagataaaaatttacaacactcaaattcaagagcttagccaaaacaatgaacctcagtgacaaaaaaaaaattaatatcaggctgcttgacttactctttctcttttttctttttttaaaacagagtcttgctctgtcaaccaggctgaagtccagtggcgcaatcagagcttactgcagcctcaacctcctgaacccaagccatcctcctacctcagtctcctgagtagctgagactacaggcatgtgctaccatgcccggctaatttttttttttttttgtacagacagggactggctatgttgtccaggctggtcttaaactcctggcttcaagcgatcctcccacctcagtctcccaaagtgttagattacaggcgtgaactactatactagacctctttgtcttaatatacttctttttccaattatttataacttatatattaaaaataatttaaaaattacaaatgattagaatatgtatagtaccaaaatatgatcttgcacaggactaaatgttatctcaaattttatattccagattatatttgttaatttgaagagtgctaaaaggcattattaaaaggcactcctgtttctattactggatattggaactaattatgtgtcattttgcatgtatcctaaagaaagactgtacagtagaggctcagcattttctgaaaaaggtcaattcataaataccttgggctttgtgattcaaatgattgtttcaactacccatctctaccattgcagtgtgaaagcagcaaaacacaataggtaaattaataatgaatgttgctgagttccaataaaactttatttataaatacagacactcctcaaccagctttggctaatgggccataatctgccaacccctgatatggcatattccaggttcttttcttaagcgaaagataaattttaaaagtgtacttcccttaaagcagcaagcttttagttccatgtgctagtataaacttagtatatactttaagtatgatgcaaaacctgctgtgttcattaccaccttcacccagctttaccccttttaattataaccaagaaaggttacttaactttggggtcttcaatttccttgtcagcagatcggaatgataatgataccatattatttaggctgttgaaggattaaatgagatagtccataaagccctggacacatagtattaagttggtgcaaaagtaatttcagtttttgacattacttttaatgaatgcttaataaaagttggctattactattattaataatattactatcattattggagtctcatttaaactcctattgattctatgctgttttcttgtttttatttcaccaattcataatacattcaactcttattataaataggtaaaatgccacttgcccattgtccagactatcaaatgcttctacatgacaaaaactttaacaaaggcctggaaataacctacagtatttatatggacataagaatagtgaagtgtgtgagcatatgctaccctgaatatttaaaagacattgttccttagaaaagattctctctgatgtgttaacataataaaatgccaaccaaagtagtgaagtaatagctaccttagagaatcaaagtaaagaacagaatccaaaatttccccattttttaaaaagttttttttcaaatgtgattcacttgacagccctactttgatttctagttttgcaacattctgagggctttttttcttccaacatcagaatattttcacagctacctcaaaggcctctaattttagtagtttaaatttacagaacaactgctgctttttggtaaagcttaaaggaactttccatttaaattcattctattagctgtgcagcgatatatgctgtctggttttattaagttcggatatttagggataccagcatcattatcataaaatgttttgagatttttaaaacctatcaaatattcattaatttggtgattagcctttcatatacatcatatatattgattaattgaatttagccttagtgacttgataaaagatactctgattcaattgtaaacaatttactttttttcttgttcaaaacataatctctttagtcacaggctcatttttagaagttatgagctgtatgtgttgtaaaaattaaattctgaattcagaaagctcaggaacaaaacagaatttgatggtaaacagtgtaacaatgatgacttccaaacagttaataggtttgtactttccaacacccatttcttgatgtatccccagctctttcttgtcaagtggtggtgtcaacagactcagtcaggaataaaccaaacctgttcttccctggtctggatgacttttgggtcattggttttcaagattctaattttgtgacaatggcttatagtattggctaggttatctgttgaattgactcatgtttagaaatttctaagtgttttttgcatttcagatttaaaaacaacatgccaaaacaagatttgtttaagacaagtgaaatgatggcacagctaaaaatatacaattttaagggagattatatatgtatgtttgtgtgtgcccacatgtatgcccatgtgtagatatacatacttatatatataataatatataatgtaagtaatttatacacacatatcacttaaatctattttaatatatattctttatattactaaatatatattgaatatttgtatttgatttaggacaggtttctgagaaaacagattcagagatgtgtgcgcagaaatggttctgggaagtatcttacagatcaacacatatgagagagtgaaagaagtaggactgatcaaggggagggttgaactacaaaaggtctcagtagctttgcagaactctctgagctgtgatatcccctcaaagctgccctgccctgaggcaaaggggctaagcctttatacaccgaccacctcccctatcaacaggtcattcaatttgtgctactcctcgctaggagacataaccttgggagggcctgctctgtttggcttatttctagagagagcaattttacctgatagcaatcatctgttaatactctcagcagcgggaggaatgagtgcttcagttctggggaagggatctaactggtgcactgcagtatccagtcagatctacttgctaggtgtgataaatctatctgtgaaaagctattccaagactctggttagtctctttctgggaaaactttcaaaaggaactatagtaggactatatccatcatctccttctactattgccattctagattcctctcaccctgcgctagtacattttttggtataggtagcttacctagttgcattactagaattttgtcagatttgagcccttgatcataatatcttctcaaaccaaggctgatgtacttgtctgtttatgaccaaaattgaacaagagaataccgagaaatgactcactgcattaactgggtatcaaacatactgtttcctgcctcactatgtaacaacagtcctaccaacagcctcatataggctggtcactcccaccaggatagtgactcctcttgtctgctgcttcctgacacagaagcctaaagttactgagttgatgctatggcttaaagattaatgggactcttgctatgtcacttaatagaagctttttccctttctgggaactgggacctctaaactggcagagcccagagttgcgggaaggaaagcaatcctccagtaggtcactggatgtgatgatagtgaggtcacttcttggttcttggacctggtattctataaggagaaaaagcagcatataataatggtcattgatttagaatttaactgcatcatggagggtagcacccactccttactgaatattttctctgtaagactcaattgccctctctaaaaggccattctatcgctctattaagttggcatttttagttgatgtagtacgtatgaccagataatccatggcaatgtgcccactccagaatactgatatccaggtcaatctggatcctgtgtatgacatttctcaaagtatctcaggagtccattctccctagtgtatgattattcaagtaaatggatgtaggttttttatagaaagaaatgagagaataattaccacatacatttgctatggtgtttcggggttctttctggtgattcagttgaagttttcagtcaacgagctcaaaatctgaaaattgcctcaggtacagaaattggacaaggatcgtggcttttcattagacagccatatgcagactcttactcacccatttttaatttgtgtagattgtgcaatagtttcttggctgtccacttattttcccctagagatgctgtgttctgttaaccatctccatagctctctgtgattctggagtcttagatatatttgaacaagccattcattaagataaatgtgcctggctgggcacagtggatcatgcctgtaatcccagcagtttgggagaccaaggttgggtggatcatttgaggtcaggggttcgagacaagcctggccaacatggtgaaacccatctctaccaaaaatacaaaaattagccaggcatggtggcaggcacctatagtcccagctagtcaggacgctgaggcaggagaattgcttgaacccgggaggtgaaggttgcagtgagccaagatcacaccactgcactccaacctgggggacagagtgagactctgtctcaaaaacaaaaacaaaaaacaaaaaataagtgtgcctccttttcttgtgacaactaagaactacctcctagcctccattattttgaaaacctgtcatccccgctgttacgagagaggccaattctataatagcatctactgctatcaacatttgcctacagaggacagtccagtcaccactgagcttcttaatgatgcttgtgtctcagccatcagcacattcttactgctttagtcaaggaggtattctccaagcctttacaaagaaaaagtgagctgatgatatttctggaacttatatgacatattcactttagcattcccacttctctgagtcatttggtccttttttcattgtctgcacagcagtttgggcatttatactttatttagtggagaccattgctttccccaagcttccaagagccatcctagcagtgtataacactatttcctgctgtccttgtctaagtgttaaatcttgtatcatggtggaatgttcccatatcaataatctgtgtcactatcctcacttgatcctattttccatcctcaattttattcaatctcttattctccatcccatctcatccagcagcctcagcatctagctccatacatacttccctaactcctggctgaggtctatagctaatttaaagcataatctttttcctgtcttagaagcccaacaattccagagccaagtaatgtcatctattgaccctatatggatctggtggccagaatggaagtggggttctatcccgagaagggtgtgagttacctccaagggaagaggtttctgtatcatcttcaagcaagatggaaatgactgcctctaattaggaggaataggcaacttccataggtccagatggtttaggataatttgagacttcaaggttgtggagtccataaactcagatgtaacctcccgtaagattccccttgttcccaaccagggttcagactctggcatagctgaggatgcaggcctcttgaaattctgttatacttttaaataagtcctaagccttattatctgcttttatgacctttgactgcagaagataagaatctctttgtattttgccaaagaggtcttatgctcacataccacggtcaagtgatgattaattacactcagcctttcattttttttctccactgcgtaaaaggaacccagcagaacctgattccattgtccttataattattactttcctctgaattcctcagaagcctgaaatattgaactcacagggcattacctttcctcaatacctatccttatcacaggtgaagattttaacaacttcccactatagcaatcaagagctataagtggttggctgggcgtggtggctcatgcctgtaatcctagcactttggaaggccaaggcaggtggatcacctgaagtaggaaattaaagaccagcctggccaacatggtgaaaccttgtctctactaaaaatataaaaattagctggacatggtggtgcatgcctgtaatcccagttactcagaaggctgaggcatgagaatcgcttgaacccgggaggtagaggttgtagtgagccgagattgtgccactgtactccagcctgggtgacagagcaagactctgtctcaaaaaaaaaaaaaaaaaaaagagctatcagtagctacctgccaacagcaatggggccctcactgcagccagctagttggctgctgagtgatccacctctaaaattccattttaaagttatcttcctcagatcacctagaatgggttctttggaaatctgattctttgacgaagacatgcatttcggaagtttgttggagagtgccctcagaatcaactcatgtagtagtgttttaaaaaaagagggattaggcagtggaatgagttcaactgtgctgcattacttccaaataggtcagatggagctgttcagttgagaaggcctttcagagtggccctgcagagttttcctacaaaggagattgatgcttcactgcattagcatttcccacagtgaggtggctcttgccagctgaggacaactccattagaagggctgactggagagccaacatcttccaacgcttccaggaagaaaaagcacctgctacagagttttatgataaggacttgaagttactattcataattttctctagcttttaaatgtagttcaggaagcataaaatatgtctctatgtttattcaacagtcaattttcatactttatgaccctgataatattacctaaccacactgaactctcttctgttattgttattttatttatatttatctctttaaaataaatttaattttataagctaaatgtgtgaaattcaaatatctagatattaaataattacaaaatattattttaaaagtgtatgatttttattattaaactggggccaaaattcttcacatatatacagtaatgtaaataattatcttatttgatatgtatttattttaaatatatttcaataacaatatggtttcctataaaatatatttctatgtgtataggactcataccttatatttatattcttaaaaaccaatataataggcacactcaataatctaataaattaatataaaggaagattaatctgtcatgaatatagtcaatgtcagttttcagcaaggaaattgatatgtatcataataattaagaaaaatgtgttttttcatttaaatgcagtagctacccctttataactaaactaattttcttgaaactttttttggctgatcaaatgtgccaaacactagtagattaaagtcagtttaagaaaattaatgtaatatatgctgttttcctcaactctagaaataactgtctcccaattgtctcccaaaagaatttgtggtatgaaaaatttgacataggttttgatgtaatggtaagagaaatgttccaagacaatctgaacttttccatggtttttctttgtatacctataagaattatctacttgcccagttttactttgcaatatttttttgagtttctattaatctcaacatgtaggtgttcaggacatggtgtacaaataatcaactaatgaatgctatgcctaatatttattgaatacctattttgggccaggatgtttggaagaaactttacatatgccaactaatttcatttttatagaaacctcgtctcttttaatgtcctgggagtcaagtttcagagaaatgaagtaatttgccagtatatatgtaacacgatgagtattatcaaatatatcttaatctaaaatgtttatgttcattatcttcatgcatattttacatgtctacaatatggtaagcattatgtaaataactcagtttacaagtagcctacagttcatgagtcaaaaaaaggcaaataaatgaataagatgaaaaaaaaacacaacacaattaactaaatgatcctatagagatgtaagccaaatacagacaactatttctttctggaaagaacagtaaaggctacctgaaaagatgatgcctgaaataaatcctaaattatgaagagagtatgccagataatatattaaattaaataattacaaaatgttattttaagtgcatatgacttttattattcaacaggggccaaaattcttcacaagtatagagtaatgtatacatgtgaagagtaggaagtagcacacataaagctctgagatatcagagccaatatcagatatccagcaaagctagaaaagacttctgggtattgaggaatagtaatttggtatgatgtttgagaaacaaaaatggaccaaatcattagtagcaccatctatgctaaagaaaatccattccattacttttttagccaggctttcgctttagaaagatcatcctagctccttctggagaagagatttgggggtggcaaaaagagtggtaaggagatcagtaagaaggttgtggtaacaactgagatgaacaatgacaggggctttgaaataagggtgacaatgggcatggagaggaggcttaactgaactgaactaggtgagtgattagaaaccgggctgggcaaaaggtgggagttaaaaaaggtctctaaggacctggatttggcagttgggtagacagtgcactaactgaaacatgaaacgtaaagagagaacttcacctggctgtgggtggagtgggatgggagttgtaaaaggtaagaaagttgagttctgtttggttgacgcagctcctccagttgcaatgtacacgacctagagccaaaataagtctgggctacagatatggatttgggagtcatcagtatgctgtggaggggaatggaccactcaaggaatatgcagaatggaaaaagggaaggaccagtgagagaggcctgggcagcactaagtacaggcaaaaaaagaaaagaaaagaaataaaaaaaaaaaaaaaacagttgggcgggagggctttgtaaaagactaaggaaaaagtgataaagaagaagagaggtagagtcaaaacaaatcaatagtaaataaaatagcacttccacagccatggagaggttggagagcagaataagtggtgaaaagacaacagaactggaaagtgactttaaatttggcaagtaatagatcactggggacctttgccagagttgtgtcagtggagtgatgggtctagcattttcctgtactttacagagtgaaagtcaagtaaaaacatggagagattaatgggtataatcctttcaagaaacttggctctaacaaaaacataaaaaataaaaaaagtagttaggggagtagaggacaacatgtgatcaagagagtcttgttttgttttgttcctgttttgtttttcattaagcagagagagtttgtttttccttaagctgagtgcatttaaattcctaggataaaataaaacataaggagcattaggaaaatgcccaatgtttgaaatagctattttttagtaaataattattattttagtgttatactttgatggcagcagtggccccatttggagtggctgctgcaaagacgacgaccgcagtgggggagatgcagctaaggctgtgcactccatggaaactgcgggagccgggaacaggcaggattcctgcccccttccaagttggtggggtgggagccctgtgatcccaggcacagctgcagccacccagccgcagcagtggacccggacatccctgtgctcttggcctgtgaagcccccctgcccctgcatgcttggaagtgcctgctcccactgcctggcctctcccggctcccagcactggctccaattttggagcaaagttgtggtccagcccaagcgctgtcaagaccaggcctggtgtgtatgatgctagggtcggtactgacacaccagcctcttactacctcacccacctccggactttaggtagtgacaagtacagcagagaggccaagatggggctgagggccactcggcaccggcctgcaggcactccctagcatgaacagccagggcgccatgaagaggcagataggcggctgggcggaaaggggcaggacccctgtgaaatcccaccttcaaaccatggactctgtagcatggggcctaggctgccagttccccctaccaaagtgagaacttatggtgctttttccagggttgcccatggctgcccatggaccaatcagcaagcacttcctcccctcggaagccgattaaaatcccagactcagccagactgggacagacaacaggataacctccctagggaaaagagctacacactgtgggtctcctctccactgagagctgtacactcatcatgacaacctgagggccgtacagatgctgcgatgacctgcctgcgaaaggaggtacccacttcaggtctcctgagacctgtgctattgctcaataaagctcctcttcgccttgctcacgcctgtagttgtccttgtacctcatgctcactggatgcgggacaagaactcgggaccttctgaatggcaggattgaaagagctataacacaaacaggactgaaacatgcctccctgcttgccacattgcggatgatgagaagaagagaagacagaaacagagaagagccatggtccttcgggaaacccagacctagcagctccccaagccagagctgtgacactctcttcggagctctgcagttcctcgcgtctccaagattctgggtaccaccatgttccccagtgtctgcagtgaaagccgcttgcagtacgcctgctccagctgcggcctagcagggagccaacgcccatgccgggagttgcccaccccgctacagctggcatgtctggctgtacacagtggccagaccctgtggttgctcaaacagccctcaccgttccatggctggctcacccttgacaggtgtgagatccaggccagtagcgcaagctgagcacagcctaacaggccgagagggcaaaacaaacccagtgaaactgagcaaaacttgggcaaaggtgccactggccacagaggtttctggctggcaaagcgacaccccaagggtcttgcgacattttttatatgaatttttttacaattcttttcttttcttcttcttcttctttttttttttttttttttttttttttttttttttttttttttgagacagagtctctgtcacccaggctggagagcagtggcgcgatctcggctcactgcaacctccgcctcccaggttaagcgattctcatgcctcagccgctggcgtagctgggattacaggtgcgtgccactaccccggctaatttttgtatttttagtagaggcggggtttcaccatgctgggccaagctggtcacaaacacctaacctcaagtgatctgcccaccttagcctcccaaagtgtggaattataggcataagccatcacacctggccaagatttattttatcagttgtgtgtccctatttttcagaaggttttcatttaagcttctaggattctaggctagaaaacttaaaattatttttgacccttccttatatttacatcaaggcatacgctttcttaacctcaaaaactccaaagttagttattatacactaaatagcttcgtttgagttcagttcactaaattatggaagcatttgtttagtccactctccactaccactcgagtttctctagtgacataaaccagctaactcacctcccaacatgcactggtgcaattaatccataggcttatgattaatcagttattaactgcgactgaagtcacaggatgtagtcacaagttaaaaaaatcaattaatctaaaaaatattcacagcagaagcatgttttccacaggagtttattccaccatttggtccaatttttctgtctttaatctttgaattaaaccaaattaatctgaaaacccagatggaaagacacactaaaaactatattggatgtcatctttttctctggaaagttccagaaatcttaaaaatcctatacagaagatatataaatgtggttccttaaggaaaataattgctcaatatacttggaggcactaaagctagagaagcatattattttttcactttatgaacaagaatttatattactaatacaactatatatgaatgcactatatgagtgatagctcataacaatagataacgctaattatatgcatatgtctgtcaatgaccacaacctgactgaaatggttactgtgaagctatacaaaagagaaattaaatcattgttagacatcaataattaagaacaaagcatcaatataaatgatttgtaattctgcagatatcaattcaaaagcactgttttctttgataaatcgatgggaaattttgttcaaatattgatgacaggaaatgtttcatatctttcctacatagcaatttttgaataacgggtaatcttatttgatcattcataataaaagacaaaatgaatacttacagccaacttcctcaaatgggacatttctaagaatgtggctatctataaaacttagattcattcattctaatgtgaaattttgcttttactcatttacttacacaaattagaatccattgcatcttcaataagttttttaaaatatatgcaactacatgttttatatatctttgctaatattatcctgatgattttgcatattattctagagaaagagtttttgaaccttgatatgtcctggaaaaactgtcccaggatttttcttttacctcttcctcactcattttctatcaaactcctgaaaaatgaaaataacaaaggatataaatttttaaactatgtacatatatgtgtgtgtgtgtgtgtgtgtgtgtgtgtgtgtgtgtgtgtgtatctgatatggtttggttgtgtccccacccaaatctcatcctgaattgtagttcccataatccccatgtgtggtgggagggacccagtgggaagtaattgaatcatagggacagtgtccaccacgctattctcgtgataataagttctcacaagatcttgtggttttataagggctccccccctcactcagctctcattcttctccctcctgctgccctgtgaagaagtgcctttaaccatgattttaagtttctggaggcctccccagccatgcagaactgtgagtcaattaaatgtcttttttttgtaaattattgtcttgggtatttcttcatagcagtgtggaacagactaatacagtatctatacacacacacacacacacacacacatacattatacatacagtcatgtgctgcataactgtgtttcagtcacaacagaccgcatataaaatggtggttccacaaagtataataccacatttttattgtagtttttctgtttagatacacaaatatatatcactgtgttacgactgcttacagcattcagtatagtaacatgctgtagaggtttgtggtctagggttaataggctataccatatcacctaggtgtgtagtgggctataccatctaggtttgtgtaagtatgctctacaatgttcatacaataatgaaatcatttaagggcacatttctcagaacatatccctggggtgggtgtgtgtgtgtgtgtgtgtgtgtgtgtgtgtgtgttcatgtacgcatataatgtatacagatttttgtctttttgtaaaaattaaatcatataacacttttttgatacttatagcagcctttttttttttttctgagatggagtctaactctgccactcaggctggagtgcagtggcgcgatctcggctcactacaacctctgcctcctgttcaagtgattctcctgcctcaacctcccgaacagctgcctggctaatttttgtatttgtagtagagacggggtttcaccatgttggccaggctggtctcaaactcctcacctcaggtgatcagcgtgcctcggcctcccaaagtgctgggattacaggcgtgagcaacgcccagctagcagctttatttctaattgctaaaacttgtagacaactaagatgtccttcagtgggtaaactgataaataaaaggtagcacatacagacagtggaatattattcagtgctgaaaagaagtgagctctcaagccatgaatacacatggaggaatcttaaatgcatatgagtaggtgaaagaagccaatctgtaaaggcaacatgatatgattccaaatatatgacattctggaaaaggcaagcaatggagacagtaaaaaggccagtggttgccaaacatttgtagggaaggagggataaataggcagagcacagaggatttttagggcagtggaactactctgtgtgatactaaaatggtggatatgtgtcatgatacattgtccaaacctatagaatttacaacattaagagtgaagcctaatgtaaactatggacttgggtgataatgatgtgtcaatgcaggttcatcaattataatcagccactctggtactggaagttggtagtgggaggggttgtgcatgcatggaggaggaagtacatgggaattttaatataacacttaaaaaaaaatcttacttttctcacacaaactacttcatggaaattcctccaaggtagagctctaatcctccccacccttttaaaaatagttgtataatatccctggtcatgaatgttttctaatttagtcaatcattcccattaattgtctctaaactcccattaattgtccttaaattcttgtaaggaacctggtttgtaactagttgtatcgaattttgcctgattgctttccaaaaggaatgtacatttcaccacaagcatatgagtattcttcttcctgaatttcagccgtaacaggcttttttgctcttctaaatttttgtgcactctgattgtgtgaagtgatagctcattgttactttatatttgcacttccctgatgactggtgaacttgattgggctttcacttgatgattttctagatttttgcttccttgaactgtctacttagatcctttgtctatttttatcctgggttagttatctttttctttaaaaatttaaaaaatctttgtatattatggagaatcttttggttatttttctattaattttgttcagcaaatatcatttcatagacatataacttaatttttatatagtaagatatgactgtcttttcttgcatagctttggttggcaaaatataataaagtatggctagttttcccctagattgcagatgaagtctttactccatccagaaccgaattttgaatgttgtgtcacttcgaggtctaattttattttcttttgatggagatatagtagccacaccaccattgaatactcattcttccacaacgagttgaacccaaaatttatcatgtattaaagtttcacatgttaggatctacttctggcttacctactctgttataagaatttatttttcttttcttgtgcaaaaccatattaatgtgacatagaagtttttagcttctgaactctactaataaaacttcaccctgtcccagtcccttgctgctattctatttcgggcttttttggttattctcaggcatctatcttgcagttaatgtccagattattttcttttacaaacaaacaaacaacaacaacaaaaaagcagctgagaagtggctcatgcctataatcccagcactttggctaggatttcaacaccagcctaaggaacatagcgaaaccctgcctctacaaaaactaaaaattagctgggcatggtgcatcctgtaatccttgctactcaggaggctgaagcaagagaatcacttaagcccaggaggttgaggctgcagttgtgagccataattgcatgccactccactccattctggaccacagagcgagacctgtctctaaaataaatgaataaataaataaacacacacacagacaaacataaaactctgctgggattgttcattgagaatcaattaaattcacatataaattttaattttaggtaagtgaaaactcagatatccatctgacctggtgccatcaaccaaatacagatacttaatcacatttctaatactaactttaaaagcaaattttttgattggcactgctctttggacaatatttaacaatttaaattttgctagaaaataatcaatttccttaagaactgcatgaagcatctcttaattttgtgatctctcctttttctaaggttatgtctctttccttattccaaatcaggagtatttttacttcctttcttccctattttattagaattacaagaggtttgtcatttttatttttcttttaaaataaccagatttgcatttttaaaaatttctagctgtatttgcttgctgttatgctattttcagcttttactttactaatgctgtactaatttacttaatttaattacatttttgtgattcattaggatgagaatttctggtgttccattactttttaaaaaaataattacggcattttgagctgattttccattgaatttagcatttgttttgttcatagtttttactatcaattatctgtttaagtgccttctaaatggtatataatttgactactgattttcctttgatacaacgattatccaggtatgtttaaaatgtccaagaagaaataatttaacaatcaccattttattacttatttctattatggttagaacttatgccatacaaatatttacatattagaatgtaaggttatatatatatttcaacttaatgtaattatttttctaaaatatatatatacatatatttagtcaaatacaaaaatttttgagagaatacccaagaagaggtaattttttttcatttccaaggtgattaatttctaccttttcccctcatttcaataaagcaaaaattttagatgcccttcagggcacactctgcccccaccctctgctgcccacatccttgcccctgataaggaaacttagaacactttttatttcttcttttctctcctgccaacctcaactcttatattttgttttcgttgattttagatttcccttaaactcatagctttcagttttaagaatctaattgggttcttattccacacactgcagaatgtttattcatatccattagatttaaacacccccctccccagatcctttttttttttttttttttttttttttttttttttttttgaggagtcttgttctgttatccaggctggagtgcaatggcacaatcccggctcactgcaacctccacctcccggattcaagtgattctcctgacttagcctcccaagtagctgggactacaggtgcttgccaccacgcccagctagttttttgtatttttagtagaagcaggatttcaccgtgttagccaggctggtctggatctcccgacctcgtgttctgcatgcctcggcctcccaaagtgccgggattacaggcataagccaccgagcccggccaacccacattcttgacccatttgaggtcactatttttttccttcaatcttttctacagtatatatcttagactgtataatataaaggaatcctcactggattcctgtacaacaatattttctccttatggtcaatgacatggtcactggctacaggattcctgagttgctgtcttcttctttaataacctatagatattattctgctgccttttatcgtttgaaatcaaatataagaactctgatataaatccttttttaaaatgtgtccttttttgctttgtgatttcctctttctcctcggatttcatatctttttgtattagctcaggtggttatcttttctcctgattcagtatgagttcaggattttcagtaagcacagctacaagttcaggccttttcaacttaatgtaattatttttctaaaatttccggtatttgtatattatttccataggctatatcctccaagtctttctccctctttcccctcctcatgatttatatatcttcatacttcatgctctgtattttgagatatttctagcacttcctgtcctaggccactaatttgatccccatttccaatttttttactgaactatttagttaagaaattatgattttcagtatcaccaaatctagcacgtatatgtgtatgtatgtgcacatgcactcgaatgaatgtacctgacaaataaatctctttaaatattagccttctttttatttattaacacttaagctgttctatgtttcattgggtatatgttccatttaatttttactaacttctgcttctgacacaggacactattgataggttattcttctttgtcacatctttggggctctaatctggttgttgatgaatcctaatggtaggtgatatcaaaagtgtgggaagacaaagtcatccctgctccatggaccagtggtgaagaggcagactagcctcttctgaagaactggagacaatctccctgccttctttgttgctatagtctttcagcctcaggacagagaacactttcccaacctacctctactatgcgcatggcaaggtttggctctgtgtccctacccaaatttcatcatgtagctcacataattcccaatgttaggggagggacctggtgggaatcatgactgaatcatgatggtgggttgtgggggtggggggtctttaccatgctgttctggtgatagtgaatgggtcttgtgagatccggtggttttaaaagtgggagtttcttgagcaggctctctttttgcctgccgccatccatgcaagatatgacatgctcctccttgccttctaccatgatcctgaggccgccccagccacatggaactgtaagtccaataaacctccgtcttttgtaaattgccctgtctctggtatatctttatcagcagcatgaaaacggactaatacagtgcacttttgtgtttcagcacgaggaggaaaacacatttagccaaccttgcactcagacacatctagtcccataattcattggtgaagaactggaaggacccattccagtggcatatggtgacagtagtgacaacaatgttgtttcctgggaagcaggagcaattgtgctaattacagcaccctgaatttaatatgagcacaacagcacacattgagaaattcagcacaccctggctgcaaaagaggcagccatgtcctcactggctcgtggagggattgagggctgtgcttctccatgtcatctagctcacagactgttttccaaatttcattctatgatcgtaaagcaattctataaagttcacttttacttatttatttgtttagttagtaggtgagtcagtaagttagttgattaatttaaatcagccaattttgaaatctgctgcttgtatggaacagtttattaaatgagtattaatcaatagatatagctataaattaactccattccctctcccactggccctgaaagcctatgtgacaggctatttcttatcctgctattggatgaaattttaggcacattccacagctttcccagttccctgagtcaatcacaagaacagtcccatttctggagaaaatttttacaatctcctcatctgacaaagggctaatatccagaatctacaaagaactcaaacaaatttacaagaaaaaaacaaacaaccccatcaacaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgttggagaggatgtggagaaataggacacttttacactgttggtaggactgtaaactagttcaaccattgtggaagacagtgtggcgattcctcagggatctagaactggaaataccatttgacccagccatcccattactgggtatatacccaaaagattataaatcatgctgctatagagacacatgcacatgtatgtttattgcagcactattcacaatagcaaagactgggaaccaacccaaatgtccaacaatgatagactggattgagaaaatgtggcacatagtcaccatggaatactatgcagccataaaaaatgatgagttcctgtcctttgtagggacttggatgaagctggaaaccatcattctcagcaaactattgcaaggacgaaaaaccaaacgccacatgttctcactcataggtgggaattgaacaatgagaacacctggacacaggaaggggaacatcacacaccggggcctgttgtggggtgggggcagggggtagggatagcattaggagatatacctgatgtaaatgacaagttaatgggtgcagcacaccaacatggaacatatatacatatgtaacaaacctgcacattgtgcacatgtaccctagtacttaaagtataataaaaaaatacaaaaaaagaacagtcccatttctgtaattaaaatatccagttcaataactttgtaaaagacctgtgaagtttctgatttaaaatttctctattcttcccagctgtcttctagttcaggcttgatatcccgaaagtttgagggggaaagagtggaagtggtattacttagcctttcttccctctttatctgctttgttctttgacccttccattttcactagccatagggtataactccttcaggactgtagaggtgatgatagaagcaggggaggtaagggataaaggtaccccatcctttgtagaggaaacagtctacagatcttagggtggaactctcgaaggaccctcaattgcttccatttctaggttccactctgagctgcttatataaatcaaagtggaagggtctccaatgctggtatggatggtcttttaaaatgatttcactttttaggcctttgccaaaactgatatacaaagaaactcagttaaaaataatattttcagaacaaattagtagtaataatggaactataagtcctcatacatagatatttttggctcttgtaataaacccttgtcccaaactaatctcttacataccgataggcagaataaaaacacacatttttgttctaccttgatttgcataaataaaaaaagaattagtggctaaatatgagataattccattttttgaaggctcatatacacctatacacccttttctgtgttttgatttatcccattttataagcagcactgtttactttttttttttttttttttttagacagagtctcgctctgttgcccaggctggactgcaatagggtgatcctgactcactgcaacctccatctcctaggttcaaacgattctcctgcctcagcctcccgagtagctgggactacagatgcatgccaccaggcccggctaatttttgtatttttagtagagatagggttttaccgtgttagccaggatggtattgatctctagacctcgtgatctgcctgcctcggcctcccaaagtgctgggattacaggcgtgagccatggcgccccaccactgtttactattttaacctttaattcattcttaaaaactttcaaaagatttaataccaataataacatatatagaatttatttcatcagttcaaaaaatatttatagatatataattttctatattctctgtctactcaaaggaaacataattgcatttctttcttttaacaacattggctctctcatccacaatgcagtcatcagcattatctggtcttaggcaacataactttattagcacctcttctaagaataggtctttagaatagtcctcaaaagagatacaaccaagagagaactttatctccagctctagacttctagtctacaaagcttgaaggaataggaggaatacaacttgaaacaaatgattatcgaaatgaaaaacaaaagccaaaacaaaaatatgaaccgtcacaacaaaaacttcacctgacgtaagagcatattacacacgactccagttgtagcctgatagtactaagagcataaccaactttgtaccttccactgattaccaaatgctcctcattctaattattaattttaaaactgataaacagggcctccaggctgacaagacagtgtgtgtgtcagctagaataatcagacaatacagccaagtatccggcacatagaattctgctctcagttgccatctctggtctgggcttagcactcagaaaattgggaaaaattaacaatactctcaaatgtagactctgaccagtcaccactggtatgtctaacctaggagaatccaccaactctctctatatatacttttaatgctgctctagaattagcttccaaatgcagatgtgaccatccatatttttttttttggtccagactattattgctgaagttgatacatattttttaaagtaactggataaaacaaattctcattaaagttgaataagaattagtttatcatactggttacaaggtaaactaagtaatcaccaagatctttgctcttctcataaaactaataatgcagtttaaggcaagatacttaacctctctgtgtactcatgtcttctccttataaaggctctgctgtgggaagcacctccaagccagttgattgtgaaaaacataaagcatgtgctgactgagtgcatagggagaaaggcaatagaaattttccaggaagaaaaaaatcagtagcagtagtgtttttttcacaagagacaaagttacaaaggccaaaaggagcagaagggaggcaagaatagcaaaagtgaaggacttccaagcatcagggagtgctctgattgacactcctctcaggcatattagattacaagagttaaagcacattccagctacacatggaaaacatctcagggagttatcggaaatattcaggaaggtcaatcctagaaaaatatttcaatttcttatttgacaagtgagtggttatatgaacaaaatgatattttactctaaatacaattatttcatttatagtctcaatcaggtaaaacttgagaatcttggtagaccagccttgcaataatgagtgactgctgcctgtgtaatgtcccaagcatataacttaattgcatttcaaccacagctgcatctcttttattgcatatttccatttgataaaatgtacaactccattgcatttggccatagacacattgtttatggataaatatctctatttccccattttaaactgaccattgtcaacatattagacatctgttacagaaaacctgtgtatctgtatggcctggatgcaatgggagtaggtctacatctctttatttgacaactgccttcccttctctgccatgaaggagtttgcttttcctcttatggagtttctgagaatattttttaaaaagaaaaaaagagcctaaaagcaaccacttgctgcttctctctctctctctttaaccatagtgacagggcggaactccatctcaaaaaaaaaaaaaaaaaaaaaccttaacatcttgaccacaattaaatgtcagtttaattttgttttcaataacatctatattctatataatttttcatcataaatttaccataatttcattaccataatttgagtaaaatgctgctaaattaatacacaactcttcagattcttttaagttgggtattctcaactgatataagctattgtttttcttttgctcgagttcttttcccctaactacctgtctctcattggataattgatgaaaagttattactaaagagagtgttgaaactaataatatattacataattcagaatctagagcagttacatggcacgtactgagttctagaaacaaagataagctgaatgtgctaagttttagattctgatagagctatcaaccaagttcattttaagaaactgcctcaaagtcaaattaattcaccttaaattacatttatatgttaaattaaagaagctgaaatttcacagcaaagtaataaaatgctaataaggctaatggaagaaattctgccttcaagacactaattcaatgatttttcttttgactgggaactaaatcacctaaagtatttcaatctgttaaaccttagcaacatttagatctgatatttctgggtataagtaaaataacatgagactttaaatagtactcttttattgtctcattattgataaaattaagtggctaattcagatatatagatagatagatagaaatttaattaatttatttatttagttggtctttctcaggcattaaggagtttcatatgaacttaccaaaattccccttccaaatgggcatggtaaggtgacaggaaacaaaagccactttgctttatttacatacacccttcaacacaggcatgctgagtatattgaatctcagcttacttatgagttcgatatgaccaaatataacatttgacaactttaacaactaatttcctttcagaatattttctttcatttcttgttgttaaaatattcatagatatttctataattaattaattatacaaggaattgtgagccaatggcttatatgatgttaccttttcatatatatatgtatatatataaatttgaattaagttgtatgcatgaagccaatatgtagtgtgtcagatataattgtaactataacttctcaaaatatatcatgttgccttcatttatctatagatactaacaaaaaaattcatatttattggtaaccagtaattttgctaagaatttccaaaaattgtcaacatggaaataaactactacttacatatgacaaaaagtttaatactaaggcatgaatttatggatctaattagaacaaaagtaagcctagcattagcttaaaaactgagatttttatatttactaataatacataatcagtttttctacttgacagttatgataaaataacaatggcataacagacaaacttttctgtagtttattaaaactgaaaatttctgtagttttgtttctcagcttattaactagatactactgattaaaggtttttaaatgataatttcctctaaaatataagtcaaatatatttaaatgagaaaactcacccagaaattgaaaaaaattacctatattgtcaaagacacactctactctccttccacattcacaacattccagtcaggccaagacaatacgatgaattactaagtaaatacaaaatgttaaatataatattgcaacaatccggagttaatctgcctatactgtcaatcaccagaataactcctggagttcatacatgaacacagagctcttctgactagacaaaataagttcatgccctttaatcccaggggttggcaccttgcctttggcttctagtctcactccaagattttagatacattaataaattgcttcttgatttaattgctcaactctcagttaaccagaggcaaatgagaagaaggaaagtaagaaacagcaataagaaattgtttgaaattttgaaatgcttacttgaaacaactgataatgaggaaataaatcataataacaaataatgctaaattatttgttatgatttgtcagagccaactatgtgtctgaaactgtacaggcatttgacatttcacccaacttttacaagaatgctttgacaaaggtgctatcattgtcattttataggtgagaaactactcacctgctagtttctcagagatgttgagtgacttaagaagtcaagcaaagattcaaggattagtctattgaacctcaaagctctttctgcaagaattaaaaagctgagccactatgaacattttgtttagggggaaacagctctatatatttaattagaactttaatgcattattacaagtttatacaaaacaattagatacagagttatcatattaaaatgacaaaagaataaaacattctaggaagtttcctataaaaacttctgacaagtctacttaagaaacacatttctatagactaatttcaaaaccaattttgattcagctgtattttcattttcctagatgaaagttggctaacctaaagaagaatattttttaagttaacgacgtgaacaaaaggatgtgattttttaattgacataaactttaaatgtttcgctttgtggtttatagagcatcttctcatatacttaaattgaaatatcaaaagatgggatgtctgacacattagatattggcttaataaatataggctaattcaaatatacatttgaaaaagtaaagtcatatactcataagccattggctcacaaccccaaggataattaaggcaattttctaaaaatcataacgttttaaaaaattgcttatttttattagaaatattatgttttttacagtccagaaagccataatctctgaagagattgtgggaaaatactgaaggttctaaatatagaatgtacaatgagagaattctaagtgtacataatacaaactattttttttgctttaataatactaaggcccaaacataatgaatattatataaattcttaactgaatatgccataaaaacaagtaaaaataatacaaaatatcaaacaatttcacactgttaccattgagagaattgagaagttcctttggattaactggaagaaaaactaaccaaggaagaggcaatttatatgaaaaatgtaactacttttctaggattcttctcaattattcattactgacaaatgacacaaatcaatgggggagatttcttattgttcaaagggaagtagtttctttcctgaaaatatacattttgaatgcatgctgctaatcatttcagaagctagtctactttagaaattttatgtcaatttggagagggcagccaagatggccgaataggaacagctccggtctacagctcccagcgtgagcgacacagaagatgggagatttctgcatttccatctgaggtattgtgttcatctcactagggagtgccagacagtgggctcaggacagtgggtgcagcacaccatgcgcgagctgaagcagggcgaggcattgccttactcaggaagcacaaggggtcagggagttccctttcttagtgaaagaaaggggtgacagtaggcacctggaatatcgggtcattcccaccctaatactgcgcttttccgacgggcttaaaaaacggtgcaccaggagattatatcccgcacatggctcacagggtcctatgcccactgagtctcgctgattgctagcacagtggtctgagatcaaactgcaaggtggcagcaaggctgggggaggggcacccaccatagcccaggcttgctcagctaaacaaagcagccaggaagctccgactgggtggagcccaccacagctcaaggaggcctgcctgcctctgtaggccccgcctctgggggcagggcacagacaaataaaaagacagcagtaacctctgcagacttaactgtccctgtccgacagctttgaagagagcagtggttctccaagcacgcagctggagatctcagaaccggcaaactgcctcctcaagtgggtccctgacccctgacccccgagaagcctaactgggaggcacccccaagtaggggcagactgacacctcacacggccgggtactcctctgagacaaaacttccagcggaacgatcagagagcagcattcgcggttcacgaaaatctgctgttctgcagccaccgctgctgatacccaagcaaacagggtttggagtggacctctagcaaactccaacagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagagcagaaaaactgggaactctaaaaagcagagcgcctctcctcctccaaaggaatgcagttcctcactagcaacggaacaaagctggatggagaatgactttgacaagttgagagaagaaggcttcagacgatcaaactactccgagctacaggaggaaattcaaaccaaaggcaaagaagttaaaaacttcgaaaaaaatttagacgaatggataactagaataaccaatacagagaagtgcttaaaggagctgatggagctgaaagccaaggctcgagaactatgtgaagaatgcagaagccccaggagccgatgcgatcaactggaagaaagggtatcagtgatggaagatgaaatgaatgaaatgaagcgagaagggaagtttagagaaaaaagaataaaaagaaacaaacaaagcctccaagacatatgggactatacgaaaagaccaaatctacgtctgattggtgtacgtgaaagtgacggggagaatggaaccaagttggaaaacactctgcaggatattatccaggagaacttccccaatctagcaaggcaggccaacgttcagattcaggaaatacagagaacgccacaaagatactcctcaagaagagcaactccaagacacataattgtcagattcaccaaagttgaaatgaaggaaaaaatattaagggcagccagagagaaaggttgggttacccacaaagggaagcacatcagactaacagcggatctctcggcagaaattctacaagccagaagagagtggaggccaatattcaacattcttaaagaaaagaattttcaacccagaatttcatatccagccacactaagcttcataagtgaaggagaaataaaatactttacagacaagcaaatgctgacagattttgtcaccaccaggcctgccctaaaagagctcctgaaggaagcactaaacatggaaaggcacaaccggtaccagccactgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacggactggcaaattggatagagtcaagacccatcagtgtgctgtattcaggaaatccagctcatgcgcagagacacacataggctcaaaataaaaggatggaggaagatctaccaagcaaatggaaaacaaaaaaaggcatgggttgcaatactagtctctgataaaacagactttaaaccaacaaagatcaaaagagacaaagaaggccattacataatggtaaagggatcgattcaacaagaagaggtaactatcctaaatatatatgcacccaatacaggagcacccagattcataaagcaagtcctgagtgacctacaaagagacttagactcccacacaataataatgggagactttaacaccccattgtcaacattagacagatcaacgagacagaaagttaacaaggatacccaggaattgaactcagctctgcaccaagcggacctaatagacatctgcagaactctccaccccaaatcaacagaatatacatttttttcagcaccacaccacacctattccaaaattgaccacatagttggaagtaaagatctccccagcaaatctaaaagaacagaaattataacaaactgtctctcagaccacagtgcaatcaaactagaactcaggattaagaaactcactcaaaaccgctcaacaacatggaaactgaacaacctgctcctgaatgactactgggtacataatgaaatgaaggcagaaataaagatgttctttgaaacaaataagaacaaagacacaacataccagaatctctgggacacattcaaagcagtgagtagatggaaatttatagcagtaaacgcccacaagagaaagcaggaaagatacaaaattgacaccctaacatcacaattaaaagagccagaaaagcaagagcaaacacattcaaaagctagcagaaggcaagaaataactaaaatcagaggagaactgaaggaaatagagacacaaaaaacccttcaaaaaattaatgaatccaggagcgggttttttgaaaggatcaacaaaattcatagactgcttgcaagactaataaagaaaaaaagagagaagaatcaaatagatgcaataaaaaatgataaaggggatatcaccaccaatcccacagaaatacaaactaccatcagagaatactacaaacacctctacgcaaataaactagaaaatctagaagaaatggataaattcctcgacacatacacccacccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttgtgaaactattccaatcaatagaaaaggagggaatcctccctaactcattttatgaggccagcatcatcctgataccaaagccgggcagagacacaaccaaaaaagagaattttagaccagtatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaactacccttcatgctaaaaactctcaataaattacatattgatgggacgtatctcaaaataataagagctatctatgacaaacccacagccaatatcatactgaatgggcaaaaactggaagcatttcctttgaaaactggcacaagacagggatgccctctctcaccactcctattcaacatagtgttggaagttctggtcagggcaattaagcaggagaaggaaataaagggtattcaattaggaaaagaggaagtcaaattgtccctgtttgcagacgacatgattgtatatctagaaaaccccatcgcctcagcccaaaatctccttaagctgataagcaacttcagcaaagtctcaggatacaaaatcaatgtgcaaaaatcacaagcattcttatacaccaataacagatgaacagagagccaaatcatgagtgaactcccattcacaattgcttcaaagagaataaaatacccaggaatccaacttataagggatgtgaaggacctcttcaaagagaactacaaaccactgctcaaggaaataaaagaggatacaaacaaatggaagaacattccatgctcatgggtaggaagaatcagtatcgtgaaaatggccatactgcccaaggtaatttatagattcaatgccatccccatcaagctaccaatgcctttcttcacagaaatgaaaaaaactactttaaagttcatatggaaccaaaacagagccggcattgccaagtcaatcctaagccaaaagaacaaagctggaggcatcacgctacctgacctcaaactatactacaaggctacagtaaccaaaacagcatggtactggtaccaaaacagatatatagatcaatggaacagaacagagccctcagaaataacactgcatatctacaactatctgatctttgacaaacctgagaaaaacaagcaatggagaaaggattccctatttaataaatggtgttgggaaaactgactggccatatgtagaaagctgaaactggatcccttccttacaccttatacaaaaattaattcaatatggattaaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacacaatgggagaaaattttcgcaacctactcatctgacaaagggctaatgtccagaatctacaatgaactcaaacaaatttataagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattaaaagtcaggaaacaacaggtgctagagaggatgtggagaaataggaacacttttacactgttggtgggactataaactagttcaaccattgtggaagtcagtgtggcgattcctcagggatctagaactagaaataccatttgacccagccatcccattactgggtatatacccaaaggattataaatcatgctgctataaagacacatgcacacgtatgtttactgcggcactattcacaatagcaaagacttggaaccaacccaaatgtccaacaatgatagactggattaagaaaatgtggcacatagacaccatggaatactatgcagccataaaaaatgatgagttcatgtcctttgtagggacatggatgaaattggaaatcatcattctcagtaaactattgcaaggacaaaaatcaaacaccgcatgttctcactcataggtgggaattgaacaatgagaacacatggacacaggaaggggaacatcacactctggggactgttgtggcatgagggcagtggggagggatagcagtaggagatatacctaatgctaagtgacaagttaatgggtgcagcacaccagcatggcacacgtatacatatgtaactaacttgcacattgtgcacatgtaccctaaaacttaaagtataataaaataaaataaaaattaaaaagaagaaattttatgttaatttattatatgtatgtggtgtgtgtgtatatacataatatattaaacctgctgtactagttttgcatttgtgaattgttgaggaacaaaggttaataaaaatgcttagaggattaactgcaaatatatatagtaatatttcatcataatcaattctgttccatggctaatagtgtcacaaagaagattccccttggagtgcatcccagggatatattacttaatatacacattgagggggttgggtattgtagattcataatccaaaaatatagtcaaggacagctccattttgataaaaaaaaagttaaaggcattaagtaatattaaaattcatttgaaaaggaccatggtgttttaaagtaactgacatggcactgtcattttctggtttaaaacaagaaatgcacatttggcaactcattaaactcccaggacttttctagggccattgtttctttccatatctaaaaagcattcaagagcatctctactcggtcgagggccacaaggctgacatcagtgttttttccctattcataatagatatttaaagctgggactatgcctggtatgcctggaaacctttgactatattgccttttatttgtttctaactttgggctcttggagatacaaaataccttttttccagtctattttctttaagagttttacaaaatgcattgttcagttaattcacttattatataaaaatgtttcatgtttaccatttatgtaccaggcactgacctaggtataagaataaataaataaaagaacatttctactttggaataactcacaattcaatgaggcagaaagaaacagaaatataagccatcatcatcttgtgtcgtggtgctatgggaactatcagaaacaattatgttatagaaatgtgattaactacacaagctattcaaatgtatatagaaactcagtcagaaatagcaacaaattctgcctgaaggaatgtagagaaggatactttacctgagtttagaaagtgagcactgttccaggtagagggaacagtatactgttgtatacagtatacaagtaccttatacttgtaggtataagagaacaaggtatattcaggaaactgcaaagagctatccattagagagacatatgggagtactggtcttaaaagcaatgaagatccaccagggactttggtagataaccggtctatatatcattagaatgttaacttgtttggtaaacaattttagttgacaacctactgtgcctagccttttgttagaagacaaacaactgactgtgaccaaaactcagtgattgtcctcatggggaagacaaatattaaacaaataataataattaaataataattacatgtgtacaatattatatggggagccgaatcaacagcactcataataaagttttcatatgtaataaaaatatttatacttatgttttctacttttgatagaatcattacttgagacttttactatttttcttctatttatatttacactacatagttcgttctactgtagcttaatatttaaggtcaaacatcctcatttttttcataactctttgacttttaaatatttgtattattgcaagtaaactattatatatttgtgaagacctgatatatccatactattcaactcctaaaatcatgttcacaacacatccctgtattaattcgagtctcatttacacataattaaaggtttggggttttctttgtaaaatcatttttttattatatattttaataggctactgtgatattggagatttaattatatacacatcacataaaagtatttaaagcacagaattataaggttctatggttcacagaggtaggtgaagaatgttaaactaacaattataaaaaattaattatcaaattgaaatatttcaaattcaaatatttcttctcaccaaaatattctattggagtagttactcacagattcatgatactgaattattctattttttattctatcttaaccagattatcttttttagaactaaatttggatatttccctaatttgccaatatcttcttagtgactgttttgggattgttagacatacttttattagttatgttaatatatcttaatgtgttctaataaatttgacttatttactcattattttattcttattctattctttaacttttattttaaacttttattttgagttcaggagtaaagatgcaggtttgtcacataggtaaaattgcgtcatgggggtttgttgtacagattattgcatcatccaggtatattgagcctagtacccattagttatttttcttgatcctctccttcctcccaccctctggcctctgttaggccccaatgtatgttgttcccctctaagcatccatgtgttctcatcatttagctcccacttttaagtaaaaggagataggcacaggcaaagatttcatgacagagacaccaaaagcaactgcatcaaaagcaaaaattgacaaatgggatttcattaaactaaggagcttctgcacagcaaaagaaactatcaatagaggaaacagacaacctatgagatgagagaaattttttgcaaactatgcgtctgacaaaggtgtactatctagcatctataaggaacctaaacaaatttgcaaggaaaaaccccataaaaagtggacaaagttttcaaaagaagacatacatgcagccagaaagcacacgaaaaaaagctcaacatcactgatcactagagaaatgcaaatcaaaattacaatgaaataccatctcacagcagtcagaatggctattattaaagtcacgcctataatccagccctttgggaggccagtggatcatgaggtcaagaattcgagaccaccctgggcaacatagtgaaaccccgtctctactaaaaatacaaaaattagccggtcatgatggcacgcgcctgtagtcccagcaactagggaggatgaggtaggagaatcgcttgaacccgggagaaaaaggttgcagtgagctgagatcgtgccactgcactccagcttgggcgacagagcgagacttccactcaaaacaaacaaacaaaaaaataaaacaaacaaaaacaaaaacacagatgctggtgaggttgcagaggaaaacgatcatttatatacttggtagtagtgtaagtaagttcaaccattgtggaagacagtgtagttattcctcttattctatttatttaaaatatttattttactttaaattccaggatatatgtgcagaatgtgcaggtttgttacataggtatacatgagccatcgtggttcgctgcacctagtcatataggttttaagtcctgcatgcattaggtgtttgtcctattgctctccctctccttgtcccccacctcccaatagaccctggtgtgtgatgttcccctccctgtgtccatgtgttctcattgttccactcctatttatgagtgagaacatgtggtgtttggttttctgttgtgttttattgcagcattggaaccaacctaaatgtccatcaatgatagactggataaagaaaatgtggtacatatacaccatggaatactatgcagtcataaaaacaaatgagatcatgtcctttgcagggacatggatgaggctggaagccatcatcgtcagcaaattattctgttattgaatcctttcatttatatcactatgcttttacttaatcacaaatacattaatataaccttagcttgtgattttttagaaacaagggtttactacttctcacttcagattcatagatgaaagttcattttagttgaaatttagttttatcttctcaattattttttttcctactaaataagtgaacatcacatcttttgatcttttttctctcctgatttctattttcatattttgctttgcaagtcacattatactgtttttcctgcaaaccaatatacatcatgagctagtgtgggtgaaataaaaattaaaaaggctatgtcctaaacacaatttttccattaactaacttatgtgacatttgtaaagtatttagactgatctgtaattttattcatatttatattaaaaagttgaaactgaattatttctttgttcctatatataaacttctaattgcctacatttagttgctgatgaactaatcaaatagtaactttttcacttagtgttcattcaaaacttaatagtttaacacgttaatctatgctaggagttgttccaagtatgtgtgggagaaggcacccttaatatttgattcttctatatatctatgatatcaggataattattcttatctctttatatagaatactctaaaggggtagattttttttcttgtaataatcatttcattgaggcagttttaatcctattgcagattagaattttcaactcattttgatattgtaactcttatagactaagttatgtaccccacacccaaattaatatgttgaagccctaacccccaatgtggctttatttggaaatagggtctttaaggatgtaattaaagttaaataaggtcataaaggtggggtcttaatccaataggactgggatcctcataagaagaggaagagacactaggagtgtgtgcacacagtggaaaggccagcagaagaggacacagaaagaagccagccatctgcaaaccaggaagagaggttcactggaaacctacagggcagacactttaaccttgaacttcccatctctagaactgggagatgacacatttctattgtttatacccagtctgcagtattgtatagcagactgagcagactaagacagtaaccaaagatgcatactttaaggtaaaattggtctttgtagttgacattttgaattagttgaaaataacaccaacaattacaagaactataactgatacagttttatattttctgctttcctaatgaaattcatatacaaatctgctctcaaacaaattagactgcttttttgggtttttttgggaaactttttattccatttgatatttaaatatggctgggtgtttctcaggtgtgttctcactctttacagaaactcaattcaatttaattcactacatgattttagctttaatctaaatgttgatgataatgtctaattatttttagctgacatatctcctaaactgaaatccagctcaaaaaactgcttgcttagacacatacatttggttgttttctgaacatttatatgtatacatgttcaaaattagactcattatcttcctctgcatatgggctcatccctgtttttccagggaactgtatcatcatctatctaatttactacatttgagacatctacatcagccttgatgtattctggttcaaccgctggatctaataactaagcccagcacagttgaacctctaagtatctctccaattttatcactctctacttcatctaccacaatttaggcccatcatctcttacattacaagcatttctcctttcggtttcattccacctgcccctacattcattcatcacattatagcgagaaagagctttctatattccaattttgacatttcaatagatccctactgccacaatgttcatatgttttaatgaggttgataagatggttcatgatctgccatagtttaccttttcctcctactttaattcttactactctttcattttagtgtgctcaaattatgttgaaataattatagcatcttaaataagcaacagtaataattatagcaaacactgcaacaataattataatagcatatttattgatcacttactttgggctaggaattgcgcaaaacatacacacaaacacatacatatgcatagcaaatctctaaaacataaattcgagattgttattattgttagagactataccagtatttgaaataaaatgacctccacgaaatagttcagcaccagaattcaaatccaggtcttcctgacatgaaaatcccctgggctctcttgcttctgtgccttatatattatactttcctctacatagaaatctccacctccctttttgcatccataactctgacatagttcttgaggtctcaacttagacatcaattccaggaatatgtcttccatgataattcctcctgttaacaaatactgacttaaatcctcttcccatgcaatttagaggaaagactgtatttcctctattacacattcactatatataataaataaattttaaaatctatgtgtgtgtatgtgtatatgtgtgtatgtatgaatgtggaacaaaaacatttattttcttaagttttataattgtttactgcttaaacttcatgctgttttcatattgtcttattgatttaaactcttttgcttcgatattccttaattaaaatgtattagtggtcaatatttccttgaaagctagtcaagatgtatttattcatgaatgattgctttgtagataatagtagggtaaaacaatcaaccagctgcaaattagaactctattgggatattttagaacatttttttgtccatgtagttaaccggaaatcaacccagataatgacagattttataaattgatactggtataactttgggttatattattaaatacccatgtagcccagattcatttctatgttctttctttctcttcccaagttcttacgctatttcatcacctataagactagcaacatttgcatttttcagaggaagttttgctatttgataccaatatggctatatagaacaaatattctatgacacttctttaaaaataccactaattagatgacacttaaggtgaaataattgttttacaaaagtagagcataatattctgtctttaatttttagtagtaacaataccatattaaaaatttttaattatactaatagacttgtagcacatagaggactgaggtgaataaagatgtttaaaacatatatatcatgaagggaactgagacactgattaatgtttaacatataaggttgaatatgcatgctaaaattttagttgttaaaatataaaaatagaatgtgtgaatttaaaacccattaaaagaataaataaaacgaaaacaaataaatggaatgaaagaaagaaaatgaagcaaataaaccatataaaatagaaataaatgagtaatatgctagaactatgtcaaatatgtttaacttgataataaaagataaacatttgcttttcaaaatgtctaattatcttttacaagagacatacataaaatatgttaaaataattttataaagtttttgaattaaaaagatgaatagaattttaaataaaaaagatgaataggaaaaggaaaatattaaccagaataatattatggaagcactattaatgtagaaaaataaggcaatagttataaagtgtgtcattactttataatacagaataattattctggaaaaaatgaaaaactatatgccaggtggtgttctttaatcacttaacatgtattatcttaattaatcctaaaagcacccctatgctttaggtactattaatattcccattttgtagttaatgaagctaaaggtcagaaagtttaagcaatttgcctattattacacattattatgtgatggcaatatatatactataaacatttgtacacagtatcaaaattgactcgagagggaacagaagacatgaatagaattataactcaataaaattaaatgagagtcaaaactgtaaaaagaaacatgtagacaatttacagagaatgtttaccaaattacctaggaaagaaaaaatctgtttcatgcggctaacataatcttaaccataaaactggttaacaccaaaggagaaaggacttttagctaatctaatttatgagtataaatcttatttataaacatattcaaaaatcttaaatattagcaagcatcattcttaattgtatttatcacagaaatactggtaaaatttgatgtttggaaattgagtactatatttagtcgcattaagataaaagatacaaaaaacccacaaatatagatgacaaatcaatgcagacagaaaataacattcaaacatttcaatacctatttataattaggatggaaggcttgctatatgcaagcttaatacataaaaatcagtaatatgtgtacatatgttcataccatcaatactcatttagataaaaaagaagaagaaaatccattcataaaacaagattccataaaaaattcggggccaaattaaacaaaataaattcaaaactattaagaaaaaatagaattattttattgaagttcttgagaaaaatatctaaataattgaaacaattcatatggtcacagataaaaatattcactattgtaaagcaacaactcccaccccatatcaatttataaatgtaatgcaatgattacataaagattattttatggaatttggcttattaattttaatttattaattttaaaattcatatgaaagaataaattgccaaaataagacaaacttgaaaaaagagtagaagggcttgccctattaaatatcaaatttcttataaacctatagtactaaattattttcaaataatcacaaatgcacacataacatgcttcacttgtaaaatctaacatttatagggtgcttactatagcctaattatttttctacatgctttgtgaaaattaactcaatattcagagaaatcctatgaagcatatgaggattacaagtaaggaaacagaactggagtgtttaggaaattgtcaagattccatagctattaagtaattgagctgattttcaaatccagacagtctagctcatgctattaaccaatgtgccttaaacaccagttgacttttaactgtcattgaaacctctagtaatttaatccttctcaaattactcgacatttgtaaatcaacagatggaatctaatcctctctgaagaaatatatctgctgcatttcttcgattttctaggattattatgtattgttgattatcattattaccaccctcttttgacaatctgttctcttgttttgctatgagtttataatcatttgttttatctcattctgaatgtggctctgtttctacaatgagcctgggccaatattcccatttatttctgctgccaataatgaagagttagaaagatgctatttacacatgttattatttaaaatgtaaatagttagccacagctgctgcaattttcccaattgtaagaaagagaaattaggtggggaaatgggggcacaactacatctatcaattctctaggcattcagaataaaatatgaaagaaaaaaaaacgagaaataataatttgcttccaggacactaaactttgaattgaataaacctatgtaaatcccagcaacacttaatatatacaataagcataatcataagataggcttggaattagtaatttaaaagtttaaacttttataagagttttcagaaatattctgtttaatttccccatataaacaattggcaaaccaaaaaaacaaagtgcaagatataatttcttcagtttcaggaaaggtgacttacatgcatttttagcaagtaactttgaaccacttaaaaattcattgaaatttttaagtattaagtattaaacatattttcttcaatttaatgcttgtgagatgaatccatgttaatatgtgactctagttcattcattttcactgtgcataatattcaactttatgaatacaccaaaatttatatatccattctgctattaatagatatgttgattgtttcctctttaaaagttttggattttttggctgttatgaacaatgcactttccaacaatctttaacatttattcatgggaacacataaagataccattaaagttttaaaacaacaaaataataacacattgttaatagtgcatatatctagcaaaattacaagtaaatatatcggaaggaaaatcaaagtcaggatgtcagtcatccctaggaaaggaagggtacatcggggattttaactacattgttcatgttttattattaaagtaggttgtgtgtgtgtgtgtgtgtgtgtcttattgctctacattttttatgttccaaatactccatcaaattacaaaaagtgtagtaaaaatatgaatgtaaaaatagtctaaaggaaaagatattttcccattagagattttataaaaatgactccggaaactgtctctttttgtttgcttgtttggtaacatcgttggttgcatgtcactatttgtgaaaagtagctcctaaaacaaaaacccaatgattgcctctatctgatagtcatgtctttgtataagcttttccctttgaatgtgggctggacctattgactgacttctaacaaacagaatacagcagaagtgatagaatttcacctcaaaacgtatgttacaaaagcagtgtggcttccttcttgggtgtccactattgctctcttgcttgcttgctctaagagaaggtggttactatgttgtgtgctgccacatggcaaggaactgatatttctggcaaacaggctgtgagggaacagcagttgaagcccaccaacaatcacgtgagtaagcttgaaagtgaatctgccccgagtcaaacttctcctagatgacacactgatgacagccttacgtgagactctaaggaggagacctagctaagccatgaagggagtccggatgcacataagctgtgagataataaatgttggttattttaagccataaaattttggggtaatttattccacagtaataaataagattctcttcttaggaaaatactataaactaggctatgaaatgtaaaaaatgtttgtagcagttaaaattacaaagaacaaaaatgaaacagtcttgacatattcaaaaagatgattggaggagattcatttctagcacgtcagagcaaagagatcaaaaaaatcctcaaatactctccccaaaagaaaaccaacattccaacatgctggagaatgactgtgaacatacaacaaactgttttgtgaacacttattcccaatatttactgaacttcaagtaaaaggatgaaaatgtgtggtgtttatgcttgtggctactcctctaccccaaccaggttctgtctgtataatactctaagcagtccttagaaacaagaagctttgctgttgttgttggtgacagctcacttaatttgaggtatttttcagttaaaaacaagaagacagaagagccaacagctctggtatcctgagattgcaaccttgatctcactctatcctgtggcacacattctctctcttccccttacctctttctcaccctaccatcccctccctcccccatccatatatagaaatacccatacatgctcagccacaaacacacgctaaactatatgaacaattttatcggtgctgctactgcaatcccacatgatacagggacaatttagagccatcatgttgctcttttgtgaaaagattcctcccagagtgacttgacaagaaaccatagagattatttccccacagccacggaatatagtaggtttaagtacctctgcttaagaatcataagataaaggtgaaaaatattatttatggcaaccacagctgctgatatcgagtcaggtgtcatttctattcctccttaaaaaaaaattgaggtattctgaatccatttacttttcctcctccccatcaccttttaaacaaaaatgctgtcattgatttgcagtttcatgatgattgaaagcatgcttttgctgttagacaatcatcatttaaaagtttaatcccataattgtttcctaaatcataaaaacaaatcttaaatttcagtgtatatttaaattattaatgtgacagacagaacttagatacatgatttttgaagagtacagaattaaagaggtatttaatcactttgtcaggtaggagatggacttaatatatctaaaatcatttttggtggtctttctcactgagatggtgacaattaacacctaaaagacaccttcatgtagcaataaaaagaaataatgaggctgtgttacaatgccctagtaaaatgtcactcttttgattacttctccagaatttgtctgccaaatcccatcatttgtctcatttatctgtcattttagctgtagggtagtggtagcatcttacagaagtgctcaggttcctggctatttactaaacagtccacgataaattcaaatctgtcactacacccaaaatgaggctagagttaatttacttgtgcaaattgaaacatgccagatcttccttttgtttccgtatagttcctggacatggccactttgctgatttaagagttggaacctaattaccctttgcaacgctgctgtggtaaaatagcatgaatgtgtaaccagtctcactgacagcaatatacacagcctcccaggacagcaagccagattaaaatcaatgacttgggtcgaagggcctttctgtcctttgggctgaaatattagaaagtcaggacatgctgtattatataaacacattgaccttcaaggtatgtgtcctttggaatttttcttataatctccggaggaaatataaaaacagcaaattcaattaagttacttcacagattgacttgaatgtaaggtcaaagttcccagaaatagaccttaaaacattatctttggctacgtaaaaataacaacaacaacaaaataaaagcaaaagtgcatctctacaaggttgccatacctgtacaacatgtaacatttagtctcataatgttcagaaaatcatgatcccatataaattattcggtatttttctttcctctcttaataaaatgagttttataaacagaaatatttccaggaggggaaaaaagagaaagtagctcactatggaactacctaaatcaattttcatttcatattcatagttgaatacagctataactggctggggtaacatagtggaaaatccaatatggagacttgtatgtgcactggattttcaatcttattacactaccttgtttgaaacaacatagttagaggtcagttagtgcagtttttttctctatataagctcactttttcgggagacattcattcattcaactatttgaaaatatcaagttgagacttgccctatggttcttatattagatttagggaaggatagtttttcaactgaatgttaaatttttttaagttcaaaaagtacttgtagcatctgaatttagccactctaacatatatatacatatctgtgtgtgtgtgtgagtacacaagtatgtgtctattttcccccttaggactacaatctcatgcatattagcacttcaaatatttgaaaacaatatggagaccctagaaacctaccataatgttcttacatattcttcttttatatatctatatttttaaagactcaataaaattaaccagtatcttttctttcattttaagaaagcaaaaatttctttctacaaaatacattagcttctgaatgtatacatttaggaaatatatctcatatatatttacatatatatatatatatatgaaaattctagaaatattatcaccaatttttatagtatccattattagaaaaggccatcttacggttatctttatattctcaaaaagtttcagttgtcacatcagttgttttaacatcttgatttgattaaggtgttgattaactactttttcaaacaaaattgtttagtagaaaaatgaccctatgtccatgaaaacaagattaccaaagtaagaataatataaattttcccactaataatgagttgctacttttctacccattttttcatcggctggccaatctttgcaattaatggacacatcatagttaaataataaatctcctgatgtaccgcagtcagaaaagagtaatattgcatatctactgtttagcttttcttctcagagtcagaacagagtaaaatgaacccacccatgatgagcacatagggagggaataccaaggcagaaaaaactggatgctaatcaagtgcagactactacagctcatgtaaatgagaaaaaccatcccagagaatgagtaactgactgcttgcaccttagtgagcatactggagaaaacaaccaccccagccaagcaattaatgaagcccctgcatttaaaatctaaactgtgctcaagtgcagacaataagaactttctgcaattagtagttgataataaaggcaaggcaacgacaattgcagtggagataagtgtgagatggactaagagaaatttgtgacagacaagaagagaaacaattgcttttctaattctttgaaaagaggtatgggaccgaacgaggtggctcatgcctgtaagcccagaaagtgtgagatggactaagagaaatttgggacagaccagaagaaaaacaattgcttttctaatactttgaaaggaggtatggggccgaacgaggtgactcatgcctgtcagcccagaacttgggaggccgaggtgggtggatcgcttgagctcaggagttggagaccagcctgggcaacatggcaaaaccccatctctacaaaaaatacaaaaattagcctggtgtggtggcacgtagctgtagtcccagctacttgggaggctgaggcatggaaattgcttgaacctgggaggcagagaacctgggaggtgagctgagatcaccccattgcactccagcctgggtgacacagggagaccctgtctcaaaaataaaataaataaataaaaataaataaataaacaagatatggaaaaatagtacatcttcagaatatattgttcagagtttactgtacaaaactctgttgaatttagctataaaaacaagttatacaaaattattactttatagaatgtgttcagtcattctcagttagctcctaaatgtgttagctaaataggccaaccacatatgcttgttaactttagcaagggtgtcttctaaccagtcatgtataaaaacagattgatattcactgctataaaactccttccccaaaactcaccagtggtgcagtcttgtgttcaaaggcaggtgctaacagcacagttttcatgtaaacctcctgttagagctatctgaatctcattgaaagaatatcattgtattttttaaaaatcccaagttcaggaaacctttttattcttaagttatttggtgacattcctaatcatactttaagacttatcttaagtattatctttcttggaaaactttctcagtcctctcgaaaaagtaagatttcagtaatcgaatgcaactttatttatcctccgtaataactagattccaggcaggatctgtcataatagcaacagtaacagcagaaacagcaactaatagtttgccactgaatgtagcatcttaccttattatattgtttaatacttgtcatcacattgtatggtaggtaccataccactattaactactttaatatctggaatcttacctattgtctcatagatagagtagattaggaatcagacccatctgtcccagagtcttggatcttaaccatgtgactatgtaatacttccttattattctgaatttttttgcagtagcctatgaactttctgaagatgtagaatatgccatcctgtttatctttgatctctcaatgtatataagttaagatggggaagtcatggttctcatgatagaaaatgcacaaaaatagaaaaatgcacataaagggcttagcacactagctttctcatattagcagacagaaagctactaattagtgtctgcaaagtcagtgaattatggcattatttgaggtgtcctagcctggattcacagcacacctagagctcagagaatgataaaattgtgctcctttcttcgggtgcttttcagaggcgtccttcagacagctgctgaaaatgccatttgtcacttgtcatttattataaaattacattaaacatgctataacaataaaggacagtaggaaaaagatttcctatagtggtcttcaattactttagtcgtatggtatagttattaaatggtcagacttacctctttagctactaagatcaaaagcagaataaattttctgaagtccctttagcacaagtaactcaaaaatcacttctgcagcactataactcaaagaggtgtttaagaaatgtttccatgtatttcccataattatatttctattttactatactgtatcctaaatagcaaaatcacattctaataatagtgttgaaatttaactgaaagagattttctagacacagcaacaatgctcttaaatactttgagagacaagactgatttaattaaataataacagattcagaaggttcaggcttaagttcatccagaagaatgtgagtcattcatttcccatttttcttctgctgactcaccaataataaaggcttttctcaaaaactattttcaaagtagcttcattctgatgcatatatagcatagacaaatttaatcatcagcacgttttcagtgaagaattgtagtaaattcacccattttgatatatatatatttttttacagtatccacacttcaaagttgttgagccttttaaaaatagggattatccctttgcataagaggaatagtaaataattctcattccactaggttaactggacccttgggccctctctaggaagcacagtttcaagataagcacttggatctgacaaaataaagcaaccagctaataataaaccaggaaccaataataaaactacagtattgaactgaagattcacataaaggaatgtcacagagatatgatgctttaagttatcctagaattacaattaggaagttaggtgaatctcactctctctctctcactctctctttctctctcactctctctttctctctcttcccccatcacaactttgcaagattattactattacactagttttttaaaataggaaatctgagtttaaagacacttcatgcctttcccatagccatttagctataaaatatagagacaggaccaaatgcattgtttgtgttttctgttgcaatgtatcattttcttacttattttatatattctggaatgactgtaatatgaatgtgtttgatttaaacacaagttctcactttttttctctggtgcaataaggtacaattctcatattttggcataaaattcagtgtatctgttaaataatgatagtacatattctatttaaaaccagtggcataaaaatttttcttcattcaacttcaaattatattattttcatgtgcactttacttatatttcaagtttcaatgattgtattttgtttttagtttccatcaaggttagcaatagtttttagatttatttaactagcatgaaaagcatcctctttcaacaaaattattaataatattgctaatctactcgaaaatagagaaaatattctcaaatctccaaggagcacttttaagcccttatttaaaatttgaaaataccttttattaaaatgcaaagacattaaggctcaccagctactacatctcaatgcagggtgtattggatgtgtttgatgaactggttttattgggccatgggaaaatgataaataattaatataggcttatatctacaaagtttaattatcttcatattaaggtttcttttgatattcaaatcaagaaataacctggtgatttgcaaaactgaaaatcatataaaaagagataagttcaagcagttcattgacttttgttgtgtatcttaaatagaaatttaaaatgctattgcaacagagatttaaaacttgcttaagtctgtaactgacaattgaaagaaaggcagctgaggaatttataaatagattacatattcccttcaatctgtggataacatcttaagtgcctgagaagtgcatttatagaaagtcatctgaaaaccatgcctaataaagaaaattaaaagccacgtctgaaataaagttaaaactgacacaaagagaaaatgcagcaaattatgatttttgagcattctagtattagctaattttaatttgatttacattttaaatatatcctattttggcacttagtccaggcatttagtcatatatacatatatatatatcactagttaaatagtaaacttataaggaagagttttcaaaacaaagagacatttatgtaatgactttgtaatctacttaatttctaagaatattgcagtcatttttaaaaagtgttttctgcttttagttacttgttttcagggaaaatggaactagaataccttaaaataagctaaataattttcccttgagtggtaaaatttatgtaaagcaccaaacacattgtgtgaaataattggttcacattaaacatattataggagagtataagtagctgtagtagtaatagtaaagaggttctcagtgacaagaatcctgggatgaagaaatcattatttccatttattatttaagagaaagatgcagaggttttaaatactgtaagattaaacaacttctaagcattggagccagaattttaagtactagctgcttcctaagcgtatactttttgcagtgatttaacaccgcccactaactttatataacatcaggtcttacaagctacattataatataaacagatgaatagtggcataaccctaaaaagctactttataagagcttcacattttaagaagttaaaaattattttcattatttaaaagtatattctcaatttaggattcatgtatcatcatttacaacataggcattattaattttaggttcaaaggaatatgtgtaagtttgttacatgggtaaattatgtgttgctgaggcttggtatacgaataagcctatcaccaaggtagtgagcataatacctaataggtagcctttcaatgcacaccctcttccccactctctaccctcaagcagtccccagtctattgttcccttctttgtgtccatgtgtattcagtggttagctgccacttataagggaaaatatgcagtatttggttttctgttcctgtgttagttcacttcagataatggcctccagctgcattcatgttgatccaaaggacatgatttcattattttgtatgactgcatagtattccatgctgtatatgtaccacattttccttatccagtccaccattgatgggtatctaggttgattccctgtctttgatattgtgaatagttccatgatgaacacaaaagtgcatgtgtctatttttataatacgtaatacatatttataaaggttcattgctgctattgactgaatgtttatgttccctcaaaatttatatgttgaaatctcaaccccgaatgatatggtacctggaggtggagcccttggtcaacaattaggtaatgagggtggaagcctcatgaaggggattagcatccttttaagagatagacccttgctgtcactctctgttctccaccatgtgaagacaaagcaagaagacagccatctgcaaagcagaaagtgctccgtggctcactagataccatatcttccagcaccctgatctggatttcccagactccagaactgcacgaaataaatgtttgatatttacgctgcccagtcatctatggtattgtttggtaacttgattgactaagacaactgccctcaggcatgtttgtcagaaatgttcttgttggtgaatctgaaacaacaagattagaaaaaagtactgtaggctgggcctggtggtttacgcctgtaatctcagcactttgagaggccaaggagggtggatcacgaggtcaggggttcgaaaccagcctgacgaacatggtgaaaccccgtctctactaaaaatacaaaaattagctgggcatggtggtgtgcacctgcaatcccagctactcaggaggctgaggcaggagaatcatgtgaacctgggatgcagaggttgcagtgagccgagattgcaccactgcactcctgcctgggcgacagagctagactctgtctcaaaaacagaaaggaccataacagccaagaaagcttatattattttagcactatggagttatggtaacatattcagtccttgatttcctgcaaaatgataccattcatatgcacttttgcagcaatcctgtttaagtaaaaaatgtattttttttacttaaaaaatattcatagccatgtaattatatctctagctacagatctgtgcatatgagcaataagtgtattgtcttcatacatttgcattgaattacttttgtgtgacctagtcaaaacaaactggtcaaaacagcaatttgtttaaaatagattaaatggttagtctttacttcttaaactttggctagtgatatctactttaacttgtttaaaaaatgattgagggctggacatggtggctcacgcctgtaatcccagcactttgggaggctgaggcgggcagatcacgaggtcaggagatcgagaccatgatggctaatacagtgaaaccccgtctctactaaaaatacaaaaaattaaccgggcttggtggcaggcacctgtagtcccagctactcgggaggctgaggcaggagaatggcgtgaacccgggaggtggagtttgcagtgagcggggattgtgccactgcattccagcctgggcgacagagcgagactccgtctcaaaaaaaaaaattgataaaatgataggatgagtactagctataaatgaatacaattatgatgaaaacattgcaatgatgctatgaatattctgttaaagctttcaaccagactcatttagcaatgttttcagacttttattttataagtcttttattttaaaagagaattgattagacatttggatgaagaataaactctcaaataattgaaagagatgtgatgagtaattttatgtgtcaacttgcctaggttatggtgcccatttgcctagtcaaacattagtacttggaagttattgtttagatgtgactaatatcttaatcaataaacgctgaataaaacatattattctttataatgtgaacaagcttaaagttgaaaactttaagaacagagactgaggtttccagaaaagaaggaattctctccaagattgcaatataaaaactctgcctaagtttccatcctgctgctttgtgaagttaggattcaagactgaaacattaattcttacctaaatttccatcctactgacctgccttacaaatttcagacttgtcagctcccacaattgtgggagccaatttcttaaaataaatctcctcctctgtccctctccctctctctctctatacatatatatgtcatatatataatttgaaatagtattttcacatctgattttttaaataaagacacataaaacttgatgtctaggtaacttcccatcttccaattcaacattccaacaattttgactatttatcctagaaacactttctttaattcaacaaatcattatgacaaagtaagcatctctgaaagaataataaaattagcttttaaaatattcactttctactaattttttggtttcactaatttgttgcttcaaaaccataaacttttatcagaaatgaagattgtagtaaaatgtcagtgctagagtgtacctgagaaaaacatcttccaactcactcatttcaaagtgattgttgctctgaggtcatacaaataacataacaggatgaagtctactaataagatactacattgatatcatactcaaagaaaaacaatcatacattatgtggaataaatattaataataaacagacaggtatttgttacataattgaagaacaggaaaaacaaggacagtttcttcctccactattttttcagcttacagaatagtaattcagatcaatttgcaaagaatataaagatggatttgatagtcagaagttttagaacaacataatgtatgacatttctacttcattgcaagttttggcttaaatggctgaccaatagtaaaaagcatccttaagtaaatttaaaagtataaaaccataatatggatctcagtaacataaaatacagatgacataagaacccagaaataatatgtaaaccaaatgcaatgaataagggtaaatgaaagagaaaattaggagactgaaacaaaaagagagctgttaatagagaaaaaatggaaaaagaaaacagaatacatgctttatatatatttatatatttacttgtatgttgtatatatgtgtttacatatgtatattctatatagtaataaggatgaccaaagaacgaaaaaggaagaagaaagaacctaatagtggagaagccttagcacaaaaaaatcaccaattatcaccaccatatatggcatttttaatttattttttgctgaagtaaaatgtaatcaaatacaatagagctaaaataattagaaatatttattgaagacagaacagaatgaacgaaacaatttaaaagaatatcatatttctaaaactattctttttatagaataaatctgtttcactggaggcaatcaagagtttaatgccataatcaatatatgacattagtttttaattactcatatatgcaaccacttccctttttctatttttcttttcttttttctttttcttttctttttttttttttttgaggagttaacagtctttattgggctcagaccaggagtccgtgagtcttgaagacctctgtatatttgtcaattttcttctccacgttcttctcggcctgtttccgtagcctcaagagctgtttcttcttccagtactggatcttggccttctccttcctcttctcctgcagggtggctgtcactgcctgctacttccagccaacctcgtgagccaggcgccccagttaggcaaactttcttgcaggcttcaaacgcacgaccttcagggcagcaggagccaccatccattttttcttgtcatagggcggtgggatgccgtcaaacaccttaaggcagtccagagcggcctggcctcgcttggtcttgtggggcagcaagcctcgctcggtccgaacttcaacttgtttctgtagaaattgccagaaatgttgatgccttcgcagcatacgaccaccactttcctgcccagcagtacctgtttagccacaatggccgccaggcggcccaggagatggcctcgaccatcaagcaccaagacctgcacctccgccatcttcggcagcagcttgggaaagccctttttctatttttattgcattagctgctagtttacctgctccatcaacttcttgaggaacatttttcacgtggtttataacccctctctcttacatgattcctgctaccaaatgctgtgatttcaatatccgcatcaatccatcctcactaactccatattccctaataccctctactgaaaggacagtcacttccatttcacttcggcaacactctcacaaaagtattatctagaccttaggatcacacaaagacatcctagctctgaaattataaacccagattgttctcccttttaccttggcctcccatctcctgttctttctctgtcttgcctggtgcacctactcatcaacctgactgaaaccttagtgctgtttcacaagcctctctcctccaagtaaatggcatgtcctatgtttcacaatacttgtctcaaatatgtagaattctcttcagacctctaacccaactgttgctcacattctcaccaaaataactttctattttagtgtctcaaaatggacaacacatacgaactctttcaacttcctagccactgccagcctactttatctgtttttctatttccttcttgtctacctttgtattacaaagacagtttttcctaaagttatctgagtttttattccagtccctccagattctcaattccatcaaatatcctctctgctttacatcatttatctttcttcccactcatcatctgtaaaatgggacttgtacctatttaatgtattaggtgaaatcctatatgtaaagcacttgacacatgtacagtacatattaaatgctatgagatgttattttattattgttagtagagtaccagtagtattaatagtgatataattttaatatacatgaagtcttttacacctaaatataaacaaattaaatatgacatatcccactgcctcttcctttcactcttactctttttcttcttagcatcctttattgagttcttaccatgtcattcatcattttaaacctttctatagttgtaaaacttaaaatccttataatgggcttaacacttttgggggcaaatagcaagtacttgattaatgttagtaaaagtagttgtgatgattagataataaaaacaactgtatagatatcatcatgggcctttgataaagagccagggaaattgtccaaggctataaacctagtaaaaggtggagatgcatgcttgcaattagattaactcattaacacatttgcttaacaatacctacccttggaagctttccattaacttcctgatttttttttaaaaagggccctttatcaggcaccaacccatgtgaaggtcacaatggctgtcaaagacaacaatccttcttggagcttttgtctcctataacctagcatgccatttgtcgataggaattaagagctgaccttcctgagctctgactttgtgtcagccattgaaccaataactatacaggccctgactaattttatccttacagcaatcctataagggaggaattgttattattgtctccattttacaaatgagcagcatttaggtgcatgaggttcagacagtgaaaatatctgaattataaaaatttatacaagtgacagtgtaaatccaggatgagaagccagcagcttggctcatgtttgtactcacaatggtgctctaatgaccttaatgcccaagttagtagcacataatactgaatacatacttgtgggacaaatgttaatgctatagaacttatataacacatagctaaatgcaatgttaaggaagatctttgaaatactggaaaataacttttctctccagtttggtgttttaaatacctaaaaagagtttccaattctcatgttcaatttgaagctaaaggatttgtgtttatggtcttaacatatacctagacattaaaaaaggagaagaagagtaaaagcaattacagatcctatcacgaacaccacctgggcactctgcagtaacaggaatccaggtatttcttatttggctataacaaggtagaagcatttcattaatctaatatttggcactagtttccccaaagagatcactctttaaaaatacatttataggtgttcagggtgaaggtaaagctgggagttcaggagggagggcctatcggggcttagagaagggggatgctatttgtcatgacatgggagttgatgacagatggggaaagagatttgttttgtggtcctgaaaggaagaaggaaagagaagcatgcagggatgaatggtgccaggaagacagagaatgtttgaatacactgagggaacacaagaaactaggatcaatgattccatcaggtccaggtagagctttaggtattgctaggagcctcaatcatatctggacaattttcagttaagtcttctgggctcatggaggcttggtggtagtggagttttggtgtgaaaacaaatggcaccatgctttatgattggcccaagcaagattgcacagtgacagagaaagagaagtagaagctcaggaggcagaaggctttgtgaaccagggtaattttcagaaaccctaggggaagacttttgacagagtgttaaaatgacacacctagttttgattcaagagatctgggcttagaccaagagtcttcaaatgttttaaatcacaagagattaggatatataaccagagttaaaacccgcaatatggtttcagagctatgagaaggaaacttatctaaaaatacttcctgaggatacactctaattgcaacagagcagataaatgtctttggggtctttaggcaaggtaaaagaggtggtgagatctgacaggtgtcaataagaaaaatttgagttggcacataataatatttagaaaagtacaaagatgaaaaattcaaacagaattagaaatgagcatatacacagtgaacattttgaaaggactatacaatcttaattgaaaggcttgctaattaattttttatgcatactaagactggagtcattccactttgttttatccagcagttacagtcaatattaccaatattaccattcttgtcttagaacaacactacatgtttaacttacaagagaagatatatggtagacaaagctgaatggaaatggacttaccatggagagaaaattaagcagcaacaatttagtaaaatgattttattataaagttatgcagaaaatgtgttgatttatgcatatatgtctttcaagtaaaataaaacacaaattcaatgggaaaggaaatcctgaaatagaagtgaaaaactaaaatcttctctgtcaaaaggttaatgcacttactgaaaaagtatataataatcagttacttcattttaggtatactttgcattctcttctaagctagagtacagaaactatattcatgggtttttaaaaatacattatctcattcctctaattcccatcggttgcaacaccttcttcattcctagtattattctgttaacagtggaacttcaaaaaggtgtgctcactgaatgaattagcttgttgacaatagtttacaacagttcagactcatagtgaacttgttattcactatgttattaataaaacatgttatttgctaaatgacatgctaaaaaggaaaatgtgctagttttctatttctaatgttgagttcttctactaccaacattatatattctaaaacaattttactatgtaccaattgtgggtacacagttacaagacttaatttctaattcctatttttgccaacaacatgctatgaagatttgaacaatctacttaaattggagtggcctaagtcacaaatgtagacaagagggcttctattgattgctttctctctctcagccccttcatcattcacacatatactagcaaattttttcaaatgacaaatgatatatacagatacataacatacatatatagttcgtttctgtctgtacgtgtatatgtgtgtttgtgtgtatatatatgtgcatatgtgtatatatatgtgcatatgtatgcatatatatgtagccccattctccctgtcagaaaaatatctccctctcacctagacttgctaagtcaactctttcttgacaacttcaacacttcctttgatcatgatggtctttagcgactatttattcccctcagcttctgtaacatctcttccttgtgcttatgatcttatgtctattcttacttctcaaagagtctataatttattattgggtagataatatgctttatacattttaatatctccaagcctaatgggtattcagaaaatgtttattggtacattattaaaattattcagaactgttcttagaaaaagaaagtaaatatatgtttattagaggtctatttttccttctatactacaaaaaacactcaaaaatcttcattctagatgatttctgcttaatgtgaaatatcctttcaatagaaaaaaagttcataaataatctaaaacttttgcagatgattaaggatgtttcatccaattttttcatttagaaaggaaaaaacaagcttagatgtagaaaagtaagtctctttgttaaattcacaattttgcaagtctgagagctaacacaaggagaaatggaaccgtgatcttctaatcttagcttagcatttcagctactacaacaattatcttaactctgctatgctggattctactctccctgatgatataaccatgctgtctctgtttaccactgtgttcccagcactgagtcacacaaaatctgcgacacagaagtcatttgataatggtttgttgaatgaatactgaatgcttcactatatactgtaccatatgaagtagaattttactcccacaaagggcactattcaaaaacattgttttgcagatctcagtctcacattgaaaatactgctgttcatagaaaaaagaaagaagatagctaatttgtaacactgggttttccaaccaaaacatactgacccctcagagaactgccattaagattattagttacttgctctctttttcataatatacatatggacaaatgccatcatgtctttgcctgaatgcttgctttgaggaaatttataagaacacaatgtttaagcagtaagttatcattgagaatgagttatcacagactttaatttaaaacatatagagaggccaggcctggtggctcatgcctgtgatcccagcactttgggaggctgaggcagcagaatctcttgagtccaggagtttgagattagcctggttaacagagtgagacctcgtctgtacagaaagaaaaaaaaatagcctggcatgttggcacctgcctgtagtcccagctactcaagaggctggggtgggaagattgcttgagcccaggagttaaaggttgcagtaagttaggatcactccactgcactctggctctgtctcaaatataaaaataaaataaaataagtatataggtagggctgggtgcggtggctcacacctgtaatcccagcacattaggacgtggaagctggaggattgcttgaggccaggagttcaagaccaaactgggcaacatgcaagactcagtctctacaaaaagctagtaaattagccagccatggcagtgtgcacctggagtcctagctactcaggaggctgaggtgagaggatcacttgagcccagaagttcgaggatgcagtgagagctattattgcaccactgtactccagcctgggcaacagagtgagaccttgtcctaaaaaatggagagatgatagatagatgactgacagaccatttcttagaagtcagagatcatgaaagtccacaagtctaaagaaggatgaagataaaaattcaaatgcacattttaaaagagataacatcactttgattttgtctccagtgcccttgagtaattaagcaacacgtgtttctcataccctaagtttgtcactgagttgttcatttggacatagttacagtaaataatgacataaggtgacctctactctgtaggagtttacaagacctttgggagaacaaaatgtatagctatgaatatgggggtcaagaagcatgatagaggatggggagcagggaggtgaggtcgaaggatgttgctttaggaggatgaggaatttaatttcaacagaataggagaaaaaataagcagaggggcttggatttgtagtaatcaaaaacatagaaagaatgtaaatttttagcggcaagtactgtgataagcattgaatttaaggaagattgatctggcaataatctgcagaatatatttaaggagagaactattattgagggagaggtctgctgggaggccttttgcaggaaccaggtgtgaagtgatgagagactggaataagatagtggaagtgggattaaaaaatggaatttgttcccctttctctattttagctcattctgaaaactggaaaatatttctaaaagctttttttcacatattcccttctacatttagaatacagcgcttagggagggacacctgaaaacgtttgaaacaaaccctttcatttacttcattcacagccatctggatgtcttgattgcatatctgcctcagcattacctcatgaaacagggatttttatattctaagcctggtgacaaactcaagagatcatgaataaaaacactgcagtgccctctagcagggtgcagaaattttcacttcactttcagtttaagagattgaaagtaggctgcttttcagatacttcagtatttcatggatcaatcacaccagtatgtttcagaagctaagacgtattaaatttttccctctatcaagagagaacagctaagtttttgaaaatatcaagtattgaagcaaggtcagatgtactctctgacacccttctcaagaatcatttccttcaattgtcaaagggaaaaaataaaataaactcttgtcttaaagttggaggtagaaatcattttaattttaaagagcttcttattttgtatgaatctcatggcttttttactctctctgagaatccgtccaccttatcctataatgccagtcaacaatggatatttaaagtacttgaccttactcacggtatagaccaaacagcaaaagcaaaggtagccaggtttccttgaaactgttataaatttaaatttgatagtataatgtattctgaatacattcagagaaagtatggcctcaagtgctaaataattaagtaagcaataatttacctttcaaacttttactttaccttctgtgtgactcagaatttgctggactttaaaatacgtgggaaaaaaacacattaaacatcctcccttttttatattcaaaccattttattagctcactttacttgtacaaattatattccttctctaaactctttttttttttttttatgaaatgtctgtgcaatacagagttgacggtagcagactttgccctcagggagaaagctagattcagagggctccatgaaccgcctggaaatcagaaccctggatgccaatgtccattctctggctgactcagcaggagcatctgcctgccacataacctttggctagggaatcccacctagacaatggactgtgttcttaagggccttttattcagtttaaccatagatttacttcttttaaatgaccaaatttataaataatttttagatgaaagagaatctttatgaaatttagatgtgaacattttaaaagatctcttggtaacaataagagcaaaagtataaacacaggcacacattcgaatagccttctatctttatgaaaaacactacaagctttcattacaaatgtattcctgagaatacgtttgctcgggaatggatagtttttataagagtaacaacctagaaattaaatgcacactgatgtaatgattatatcctttttttttaaattccttaacatatttagtgagagggctaatgaatgtcatgcatcacttttcccttagtacttttgatatgtaaacaaattttttagatttactcatctaatttttaaccaaaatacttttaggtctatttttcatgtctccaattataaggttctacagggcaaaagccttgtatttttgttttatctctcaccagtagttcgagtagagtggttttcatattgtaggtcatcagttaacattgcaaactgacagactaattgaagtggccttcccagccctccagctcagaaggcttatagaatgcctgagattttcagaatcaggttgaatgagggacctaaaggcagtaggaacaggtgcagagcaactgagggaaagctgacagttgccattctgatgatgtatttgtgagattctggaagactccagtaggtgctctgtgaatgcatcttaagagggtgcatttgaccagtactgaatggataataattgagataggactaaactgatttaaaagtaattcttctctaatgtcttctgaacacgaatcagtaaacaggtatgtaataggatttttgacaaagctcttttattaggaactctaatactatttggaaattagattggttgtatgtcccacttgtaaataacactgataagcaagtactcttcatcggtataattcagaaaattgcaaaatcctgtctcaaattttattaatagggcaatttgcatgacagcaactcattttaataagcattgtaattgccacatcaaacattattaagaccttccaaacccaaggctgatgttttgggaggatgggtggtgggtgagaaaattttgcttaataggatttacataaaggattgttttctttccagggtttgtcacgtttccagaattcccattagtcattctagcccttttcctaaacttttctgtctaaaaatcaagttgatggttccaataaaaataaactcattgtcaataatattttgctgtttggtttataattctttctaacacaggtaaattgtacttgtaaaataaactgataatatgttatactaatctcccagttgaaaatgtaataaatctatcagacaaggaccaaaaatatcactgcttgttctgaacataatgaaatgcagcaatctacctaagtgacatgaaagtaggggataagcttcagaaataagaatgcttacaacatgtttaatggatattggaaaagatttgtctcatgtgtgaacagtgtctgtacacataaaaacttattaagctaatgcctctcagtctaatttctttttgaattaaaaacaagttttaatcaaaccctaacctttaaagtcatatggcctctattaccctatgaaccacacagtcatggctaagaataagtgaaaaaattagatgaacacactcttagaaaattgtttaaatgtcctcaagaatcttaaggtaacaaatatatttgggaataagcacatcaaaattctatgaaaccgttttttttcctacctaggatatactctttcttcctccaaagatagattttagggttctcaataagtggccattgcttcttaggacaaatgaaacagtatcggtattagaatgctgaccctcatcagtagttctgcagttataaaattacaattgcaggggctgggcacaagtggctcacgcctgtaatcccaacactttgggaggctgaggctagaggactgcttgaggccaggcatttgagaccagcttgagcaacaaagcaagaccccactatgcatgcctgtagtcctagctattcaggagcctgagggggaggatcccttgagcccaggagtccaaggttacagtgagctatgattgtactgctgcactggagcctaggtaacacagcaaaccctgtctctaaaaaaaataaaacataaaaaaagaaagttacaatttatttattttgcatcttacataaatggcagatcatcattcatatggtaaaaacattggcagtaaaagttcaacataattatgacataattaacagtctatctttcaatttaagctctcatttctcccccaaacccaccatcgtaaccactagtccctaaactctgtgggattattctcccttatttcgtgcctttaatcaaatttctcacccattaaaagatacctttggccttccctactactctgttaagaatggtgaggggtctgatattttccctacttgctaatatgttagtctgccacagtttcatggatgctaaccaaaaacacaagactcctgggtctgagagaaaagacctcattactgaagcctcaaaagtatgtgcttcctgtcttcataggttttcccgccttaattttcataggaacaatgtgttgggcagcccaggtgaatgccaggcacaccattggtttttgacacagctaagagaccctgagctcaggaagctccccatcttataaaggtcctgcaagaaagcctgattaatctttgcccctgaggtagatattatctttactatcctggtcaggaaacaaatctgccctcttccctaaaggcagacactatctctattgtccaaggctgtttgttacacaaacactcttgaaaaaaggagttccgaacccaagctgccaaaaaaagtgtagaactgccagggagaattctttcaaaacccatccttaaaattgcaatgtaaatcctacttctttcataagaggccacaataaacttttacttccagcactatattttcagggtcattagcatatcattcactgttgtgtggcataatttatgttattaaccttattacttaacatttgtaaaccatttaaatgaattaaattgtcactttgtcttcttaagtagtttaaacccattgaaggtataaattatttaataagttcctttttagcccacaaaattcagtggagctatattttgaatagacactcaatgaatgacgtaaaagtcaaagttattttttaaaatattttattctaaacaacatgtaagaaaattgtagtggaaattaacctaaagagttttattctaaaaagtttagaagaaaaattagttatcagaatgtagtaccaacattccttatgctatttgcctatcttttatataggagataatatgtttttagtcaactttatttggtgtcgaatataaaggaatgccaattcttatgaataaataaagtgtgagtataaacctagttttaagtttctgaattaataatgatctgctaaaatttggaatgaaattggttttgacttcatggagcttagtaacaagaacctccaaggtaaaaatcttcacatctgtactttattaattttttaaaaatcaaactatgcaagtgcagttttaaaagccaaataatgatacatcaaacaaccctaggtatttccaatacccagaggcaaccttttctaatgcatctcctcttaactatttataaatgcttttgccttcatatttttaagtgttcaacttctgtttatagacttatttttcattttcacattgtcttactgatttcttcttacagaaaggaagcatttaactcttatactaacctcctctcatccactatatatttatagcgtgcttttggttaaatcaagtgttgctattatgactatgcaagcgatctttaccgcggaaccttgtagtgtatttggattacatttcatttcatatagctttttacattcccttaataactcacgtattttgtatactcaattttgtatccacctatcattaccatattattaagatttccatgagaatttgtctctaaaatatcaggtaagcatccattattccagcttcaatctgtcccggttgcttctgaagctcaatgtatgacaagcttctattgtcgtgctgccctgtttccttatcattctgagattaacttcaatatcttcctatacatagcctcttattttggggatgatatttcttccttttttgtttacttcttagttttggaggaaaatagataaaagtagtatcctcagcaagggtgcattagccaaaaaaaactgaaatcttataggtctaaaaatgtctttcttcttctttgatatttgaaaaaatagcctggccatacagaagattctagttgaaataattttccttcagaatttcaaaagctttactcagttgccttctagccccagatttccattgtgcggacctgtgccattttgattcctaattttttacatgtgagcattttggaaaaaataaaaactgtttggacattttaaagagcttcgtttttttcctaatgttttgaagttgcatgctgatatgtgcattgaagatttatttcattgtgttaaggatccagtggtagctttataattaagaacacatgtccaactatgataggaaattcttaatttaaaaaaaacgtcattttgactgtttggaactcttattattcaaatgtttgatctgctagataaatactctaattttcttatcttcttacgtagtatctacttgattgtaaaattttgttttactgttttccagcccttctgctgatttttatgttatcacttttaatatgtaagagctattttatattctctgaaagtcccttgtttgtgttttcctgttcttgtttcatgaatacagtattttccttttttttctgagaatactattagtccattttcataccactataactgcccaagactgggtaattcatgaaagaaagaggtttaattgactcacagttcagcatggttggggcgacctcagtaaacttacaatcacagcggaaggcaaagagaaagcaaggcaccttcttcgcaagtcggccgtgctgagcacagaatggaaagagtacctttttggcgagtagtagccagcttcttcacaaggaaaagtaccgagcgaagaggggggtaaagagtccctcataaaaccatcagatctcataaaaactcactatcacgagaactgcatggaagagaccacctgcatgattcaattacctccacctggtctctcccttgacacgtggagattatggtgattataattcgagatgagatttgtgtgggcatgggggaaactatgttcagccactcagaagacactcagaagcgatttaccccaacaacaacaacaacaaaaattgtaattggttagcttttgatcagaaatatttgcataaataaccaaatcagattcgggaaattcaagtcactgtgtggttataaaatctaccagcctataaacatattttatcaataaattatgtttcctaaaactcttggaatgcttttacaattcttaaatgataaaattataggtcctataaattgaggaacatgattataataatttttcaaactgtattcttgattaacatagtaaaaaaatgcatgtggtagttcctttataaaatctatataccttaatattttctactaaattttagaaaattatgtgggaaaaagtcgccaataaagatacataaactttctcaaagtgatcaaaatgttaatatagatattacaaagatttcaaaatatctaaagaaagtcatctcatcttacattattcaccattgtgtcaaattcctttcgtgaaactacatttcctcatcaaaataatgttagcacataattttattttaggaaggttttagctctaaaggtagaaacttgtagaacgtgggatttgctgagaggtacccattttcactattataaaagctctctaagactactgatgcattacattaatatatacattatgtgttattatacatcaatagattatggggcagattttagagacaatcttttacaagggattcaagaataaattctaacatcattaattattctttttgttaaaccaagtcatagtctgcctcagcttggtgttgtaaaaatagtttttactgctgattttgcatgagtgtattttgtttttatgcatatcctgcttccaagttgtactgatattgatgaaagttccacatgtgaaatcagtttagaaaaagaaacagaaacctacaatgcagtggatgattttaaaggcatgatttcagataaaaacagtcctttttttttagcatttcctaaaatagttaaagcaaaagtacctgaaataaattaactcattcacttgcttatagtttatataaatgaatatctattcaactaagctgtccaacattcaatcaaaattagagcacaaataaatcttaaggattataattcaattttagacaccagcattgccatatttaaacataacatgaatacactagtcatgtctttatcaacaatgataaagcatgttttaaattatagaaactcaggtagagaaaatgtacttgaacctaaaaactctggtcttcaatcaaggttgtatttggagcacatggactccttagataggtctagtggtctctattgttaagtgttcttatcactcaaaggatgtttgaaaatttactatctgaaggaattaatttattcaagccatcaaaaataggaataactactttaaatatatgtttacatccgcatagtagaaagatcattggtgctaaaggtaaggcattctctgggaaatttatattagagagatgtcatgtttatttatagagtatagaacttaacatcatgttattttctcaaatggtataattgtagacagcttgttaataaagcctagccaccaaacaagtactgaaaatagtacttcaacatggtatgcatcacagtgatgtttcattgaaataacatagaacgagatgcttgtcaagtcgaggttgcatgagaaaaccccaaaggaagtcaaagaagagaaaggtaacaaaataaatgtcttcaggcgtggttgaatggaagaggagtcaaactttagaaggctagcagggtttgggaaatctggagataacagtgctattatttccagtaaggtgtgtgatatgaatgagatactcaggcacaacccagtctgcacagcaagagatatgagcaggtagaaaggagaagggatactgcagactagcaatgaaaaaggctttctagtaaaaggaaaagagaaaaatattttttaagtctctaaaaatgtgaatttcccgctttatatttaacttgttaacccagcaataagatttttaaattatcagacctattgttgcagaaatgcaagtcaaaaattccatattcaaaacctttggagtatgtgtttcagaaattttcagattttagaaaggttatatagtatacatgccatctattacataacaaacttagctggatatttggctatattgtataatcaaacacatttcctgggcaaaacgtgattattcaaagtctggtaaataaagagtgtaaagcttttttctatttttctattcaagtcatttcaggtcaaattttgacaccacactagttaacatcaagttttgcttataaaagttacaaacaaaacatacccactgattttcagaagtttttagattttacaattgtgtttaaggtattgaagaggtgtattttaaaatttcatgacctaaactacaataactaaaacagcagaaggatgtactctacactattatattacaaaaagtattcaattcatgtaaattaaacttaacctaatttaaaattgtatatgaacaaaaatactgaaaatatttagtcaggaaaatggaagccaggggctatattattttgggaagtatacaggtgtggtcaacctgtgcacccataataataaggaaagggtggtacaggggatgaatgtttctgaattatgctaagggatgaggggcagggggcctcaggaaatagaagatactggagaggatgaaacaaggatttctcccccatcctttccagaaggaaagcaggtatctgagtgtggaaagcaaattacaagtgctgctttatcacccacttctcagtcatctaaataactaaatgagattcagcagagcatctgacaagtagaccatgtataatttcaagccccttgctaactaggtaacatcctatcctgcaatgaaagaaaagaaaggggaaagaaaggaagataggcagaaaaacaacatctctcagttgttgcttatgtctaaattactttaagaaaagaaaaataattatcttacatcagagacctaaaaattaaaatgcaaattcttgtaaaaacataatgaagtgatagaaaaacctgggcaaaagaccaaattaaatgtaggcccttgctttgtttcggtggggaattaagtaaggagaccaaaaagatttaaaatattatcatcaagagcaaaatgtaggaaaatgagactaagaacaaaaataaatcaacaaacacttttcaggtggcacagcattgtccagggttggtgctgattacttttaacagaattggaccaaaagcagactatacgtagagatttttggtcatttacaggccaattcataatgctctgtttgtatgatgtacatttaaaaataaacaagaatagctgtattcacatgtaggtaaaaaaaataaacataagttaaagaatatacagcatgatcctattttaataaaaatataaaaatgcatgtatatctttatatataaagataaaaaatgtgtgcattaaaaccctagttattagtgggattaccaatggttactgtcttcttgttaatattgttcctaagtgttccataatgaatatgtattatatcatagaagttatgaaagtttctagtgaagattcctttcttcaggaacgttttaagggagctatcattattttacacagttttcattctcagctaaacagaacgctatggtttttcagaaaaccatagacttgtaagacaaaagaaatccataataggcttaattatagttttctggaaaatttacttacagtatacatccactctgattgactttatcgctggagaccccaagccattctctgctttacagtaataccggcctccttggtgtcgctgaatatttgtaatcctcaaagtctcattgaagacacttgagtcttggaatctgtcagaggcacttcctgctgttttggtccacctgatctgagcaagcatcaacaaagattgttactttaggttggttttcccacagagaaatcaaatagcaatcactcatttgaagagtttgcatttagagctgctacattgcctctcccatcaaattattgaagaaaaaattaatgtttacagacacgattgaattaaaaaatttttaatgtaatgtcatcattgtacagtgtgtgtaatttgaattcaattgcatagaattcatcaattgcctagtcagtgtggagggcaatataaactataacataaagggagttaaatatcagtagtacattgaaaatatagattaacttttctttttgttggacatttatatctgtttttcatattttccaaaccttgtgagataattttacttattttgtccaagtaggttctcattttatttttggacatgcctcattcttttatttgaaattttctatttgatttgaatagtttagacataataccataatggcttattgagattatgtataattttaaacacctggttgtttaagagtttgttttcctttgatggctttgcttaataagcccacaaatgatttgtctattttgatcatcagtattcactttacatcaataattattttaaaaaataatgtaaacttttcaaggagaacatttctactaaactgccaaaacattttgaatatctaaaacatttcattataaacaataccattattttaaacacagctgtctacaacagacttcgtttttgctggcaataatgactggtattcaactcaacttttgtgtattttagtgtataaaacctgaataaaagccacatactcatactgtaaagtgatacaaaatagaaagtaaaaataatttgattttatttccctttgtgccctgctatatattttagtttgtttttaaggttgagaaacagctgatagaaatcctctgttcaaacacatatgctgtgacatggaaaatgaaactaaatactgaatcatcaaaacagaaatcctataatattgccattatatatacctattttcatatgaagttaattaaaatgtatgagctaatggcataaaaagtatctttaaaagttatccacataattaaaatatctataaatataaccacgtttgcccttaattgtgaatggaataaaaatgttattaagagatgaattttaaaaatctgtaaatcacaaaaagaaatatcaatatttattccaaatcttctatatatatggaatacacaaagatgcaaatggcataatttctgatttccagtagtttataaatgtattactgacatacccataagaagaaaaggagaaatttgtaaattatgtcaaaaatggaagcatactaacactttcacttagcaattatctggttaaaatttaccttactaacatatttgcaaaataatgcatagaaattagcctactgtatgtataaaactgtaacattggaaatgatataaatgctaaacgataggtggttataaattgactctaaaattgaactgaatacagtcattagaaaaaataaaatacaaaatgtattattaagttaaaaaagacaaaaagcaagaaacaagagaatagtctcgtctgtgtaaaaatagcatatgtgtgtattcatgtgtgtacatattactaaatgtttattaaaattacacaaggaaacatacaaaactctgtaaatgggactgggagtaaaaagaggatagtgaaatatgttattttcttaagttttattttaaattcttatttatacttaatttactttaccagaagcaaatattgtttattgtaaagaagttttaaaaatgaaacaattctcaaatgaaacataggaaatagaaaagtagaaaatagaagtagaaagaaatgcaaataatcacttagaaaatttttcctccctttttattctctacttttaagaaataaatactgaaataaaatatttctgagtggtagaaagacataaatttacacattggaagagtttaccaagtcacatgcctaactgatgagaaaagaaacctccatacatactccgataaaagttgtgacctcaaagtctacaaagaaaattgttcaggcttccaggaaaaagggacaaacttgtaatgtcacagagcccagtcactccctaatgttgtctttccttcttcttaaaccccaaattattaatcgccacatggctgcccaggataaagacatttcccagccatccatttagccacattcttgctgtttcaagcagaaatgtccttacagggaagcagcacttcatgttttgcacagttttggtagcttccatttgaacagtgggccgatttgaaacaaaaatcaagcacagagaagtagtaaaatagaagaaatctgaaatcctgacaccatggagttatacctacctaacctaaactatttatagccctggacttctatatggggaaaaataaaatttttgtttacttgttattcagatttttctgtgactgatagccaaactcaattctaattgattttcctggagtggtatggaggtcagtttgtcttcagcattctcatctccaacacggaaagctcaaaaacagtggaataacatccacatttactgaaaaaggtgagggaaagggctatctcccaatatcccatatccattcaagagctcatttgtgtgaaataaaaatattcagtgatatgcaaacattcattaacctcagggttcaaatagccccccatgatgaaaatatttgaaataatactctaactcccaactaacgaattgtatctgaggtctgggattgtgagaagatatagaaaagcatattgtggtgggcagttaatagatattcatttaatgaataaggaggatttccttgggttagtatacaatttaaatactaaataaagttttttaaaaccaaaaggacatagaataagaagatttgtaataacctagcaaaacctagaagtttgggtgggaatgtaatgcaaagcagaggtaacattgtagggatggaaggaaaggaaaggagagaaaaaagttactctggaatcttaaaccttgggatagttgaaaggggaaaatgtgtccctgtgggtgaaacagatcttgtttatacattttaaaaagcataaatgtcaattaaagtatcacaaaaaaatcagtttcattaatggaaggaaaaatgagataaagagggccgggcacggtggctcacgcctgtaatcccggcactttgggaggccgaggcaggcggatcacgaggtcaggagatcgagaccatcctggctaacatggtgaaaccctgtctctactaaaaatacaaaaaattagccgggagtggtggcaggcgcctatagtcccagctatttgggaggctgagacaggagaatggcgtgaacccaggaggcagagcttgcagtgagcagagtttgcaccactgcactccaggcggggtgacagagcgagactctatctcaaaaaaaaaaaaaaaagagattacgggaagtgagtggaaaaaatagaaacttggtaaaatgatgagaaaaatagggcaaaggtaaaagaaaaatgtataatttaaaataaatatacatttaatttttattttatttttaattggcaaatatatatatgtgtgtatatatatttggggtacgatgtgatgttttaatataagtttacattgtggaatgattaaatcaagcccattgacaatttcatctcctcgaattttttttgtggtgaaacatttaaaacctactcttttattaattttgaaaccagttaacagtacattattattaactagagtcaccattctatgcaatagaccactatacagtaagatacaacacttatatcagtcatagactagatgtgaatagattgaatttatccactaaaagagcctactagactgaatttaaaagttaaaacaagcttgcgtacagttaacatctaataaaaataaatgattggaacaatagaaaattggaagccaagatgggaaaagaaggcatggataaagttgtaatggaattatgtaaactaaaatcaatcaaccaattaggagtgataatatttatatataataagattaaattaataataaatttgcagttaaaaactaacagggagagaaagacatcactttttgtaatattaaaagtcaaaagcataaatatattacttgtgattggtattcagtaaagtacagagccactaaagacaaaaagcaaacaaaattaaaaagggaagaatttgacaaacacgcaattgcagtagaaagttacaatacagctttctgagattcaggcagttcttgatagtgcaactttttaagttaagaggaaatacaggacaaactaaaaaaatacaataaacatataagactaataaatatacagaaagtcatctatccacaaggtaatttttttcttatgtccattaaatatttacaaaaattgatcatgtagttgatagcaaagtaaaccttcactaatcaaaaattagaggtaggacaggcatgctattgaaacttagttcaatacagctataaataaattatcaaaagatgactaatacatggaaacctttattcacattgttattgttcaaagagaaaattaaaaggaaaattgctaagtatccagaagccgatgaatagaaaaccatttcatactaaaatccatgaatacagttgtacgagtctgttttcacgctgcctgtaaagacatacctgagactgggaagaaaaagagttttaattggacttactgttccaaatggctggcaaggcctcagaatcatggcaggaggtaaaaggcacttcttacatggtggtggcaagagaaaatgagaaagaagcaaaagcggaaacacctgataaacccgtcagatcttgtgagacttattcactaccacaagaataacatgggaaagatcggatcccatgtttaaattaccttcccctgggtccctcctagaacatgtgggaattccggtagataaaattcaagttaaggtgggtgggaacacaaccaaaccatatcaacagtgaaaagaatacacacaggaaaatataaaccttaagtaccctctacatattaaggaatgaatgaatgaatgaataaaaaactcatctgaatttattttaacttaattcagtactcatcagcatttattttaatttaatgttggtttgggctgtatcgtaaactactgcttaagattgtttaggagagaggaacaggcaaaaagcagctgctacttgttttttacagaaggttctagaagctgcctcatgacactgcttatatgatatggttattcttccttagttacaagaaaggctaggaaatatactctttactctgaatagcaccttcttcctatcccccagctaaaatttgatagttacttaactctggaaaaacagaagagtggatgtttcggacaacccctggtttcacaatgtgaataaaatacatccagatttcagatatgctattgtattagtccgttctcatgctgctatgaagaaatacccaagactaggtaatttataaaggaaacaggtttaactgactcacagttctacatggctgaggaagcctcaagaaaattacaatcatgggggaaggggaagcaaaaacatcctttttcacatggcggcaggagagagaagtgccaagcaaagctggaaaagccccttaaaaaacaatcagatcttatgaggattcactatcatgagaacagcatgggggtaaccacccccatgattcaattatctctcactggatcccttctaccacacacggggattgtgggagctacaattcaagatgagatttgagtggggacacagacaaaccatatcagctatattattacatttgtgtttaaatcctcttacaatttaacattaaactcatttctgtaaaaataacattaacagaaaaagaatgatactagagtttaggaaatacttttcttggtaactctcttcctaatctgaagaaacaacatggagattctcttatttcaggcctattcaattcccaatagagtctgatatagatatagatatagatatagatatagatatagatatagatatttcctgaaacatcattgcttttacatagccttaaattaaatctgtattgactgagataatcttaggaaaatattaaaaacctgaagcatagatagacttggctgaatccaaaaagtatattgtgtagatgcaacaaactcaataaatactttgacctgagacttctaggttgccccatttaattaatgtctagtgaatgaggatttgtacactgaagctcctttctattgtttgccaaggagttcagccagatgtactcatgtcaatgtgagcattgtcccagcattatttgtactctgaaggaagatcctttagcattaaaagaatccttgagaaaaaaattacataaacatcacctgatctgctataattattgggatgatctgccaccagagccttgggaactaaacctaaaaaggttacagagtgccagcctgcaagaatattaagaactatcaatggtacgtaattattaataggcagagtttattagagttttcaaaataaaaattatccttttgtcctgcactgatatcagggaaaattacagaggaaataggttctctttgaattacttattagaataagtggaattctgaatggcacagaactctagagcatacaggttcaatttttaataaattgtatcagtctacaataattatagcaatatgtcacacttatttctgaatctgtttttataaaaaaagaaccacaattttctaacaaagcaacaaaattttaaccttaacatttctctgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgatcctcagggatctagaactagaaataccatttgacccagccatcccactactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatagacaccacggaatactatgcagccataaaaaaggatgagttcatgtcctttgtagggacatggatgaaattggaaatcatcattctcagtaaactatcgccaaggacaaaaaaccaaacaccgcatgttctcactcataggtgggaattgaacaatgagaacacgtggacacaggaaggggaacatcacactctggggactgttgtggggtggggggagtggggagggatagcattaggagatatacctaatgctaaatgacgagttaatgggtgcagcgcaccagcatggcacatgtatacatatgtaactaaccagcacattgtgcacatgtaccctaaaacttaaagtgtaataataataaataaaaaaaaaccatttctctactcaatgcataagaacccatttttctagtatatccagaatattagggaccatgattactattactattaccaccaccactactactactaagatgcaatttaaaatatttctgcaagatatatgcagataagaagctcatggcagtaatagaaaaagggagcctggccgggagcagtggctcacgcctgttaactccagcccttggggaggccgaggcagaaggatggattgaagccaggagtttgagaccagtctgggcaacatagggagacccctatctctacaaaaaataaaaataaaaaaatttcctagctgcagtgagttatgatggcaccactccagcctgggcaacagagtgagacactgtctcaccataaataaataaataaataaataaataaataaataaataaataaatgggaggagtctgaagaacaagggattcacaaagtaggtctactcactatgcggaaaacagaatgatgaagagggactcatcacggtagacaagtaagaaacaggtaaaatagcggggcgaggacataatatttctgaacactagatgggccttaaagcagatagcaataggttttccgatccttttttccctttgtcttttctttgaatttaacctttgaggaatttattcacctctgtgaataaacaatcggagaaaacagataaacttagtacttctcttaaacagcatcagacttcctatatgcatgtggagcactacgatagggcctgctggcactatttcacactagaggtgacaggagggtacatcttggtgcaaatgcttataaatataaaatgctggaaatgaatgcaatcatcatagagaagtttgattttgtcgcactgccaagacattactcttgggccccaaaaccaccattatcagaattcggtctctttaaaagtttacaaaatgttattgttccatcctctgattttaatgccacaacaagcttagaaggtaagaaaaattttcctccccattttacagctccagtccttccatgaccgtgagactatgtgctattatatactgggatcctttctgacttgaaagttctccctttttccttcatttagtatctagttaacaccctccggtcctccagatatcatttttttagaaagctttccctctctcataaagctctattatgtcctgccccctttgtttccatggcagtctgaaattccctctgtgagagttcttatcacatgctttagaaatcagctgtgtatatgttgtaggagataataggtgttctgtctgattcccttagagccctttacccttcctatatgttacctcactaggactttttgtttctcatgaaataaggtactagggattcagagttacttgcactcagagggaaagcctgggaaatcttgggagtttattccctacccctgtgactcttagccgatgaatgattattgtgggatatgaaagccctgctcccgtgcctctagatgggatagattctgcagcataatttacaccccaatttatttgcagtgtcaggctgacgctaacctcgtgaaaccacatcctggctcagcttcctccctttcctctcctgctttcttgctccattatcagtttcttctaagggcatttccttaataaatcacttgcacatgaatcctcatctcaagctccatttctaaagaatcagtcttaaaatataataattttgccttaaccaatggtaagttcattaaggcaaggactattcgtaaacttggtatctccagcccaaataactgagcctgagacacagtaatgattaaaaaaaaaaatcattgttgcttgaattgtttcctggcaatataattctgctgagaatacaattatgaattagacaaaatctcactccacaatgcacccaaagtagaatgagtttagtctattttggtggtttttacttatctccttgacttctgaacagttgactgccttaaagcctcatcattttctttgtacattcacttcctcagtcacttcatggagtactttaaataccatttatgtaatgatggctcctaaattagtatttgtagttcaggcctttcccttgaatcccagacttttagccaccaagtgcctgctctccatcgccaacataacacatccaaaatgaactcttgatctcccctccaaaccaactctcccagtctttcccatctcgattactggtaactccatccttccagttatttaaaccaaaactttacagtccaccttgatgaaaagagaatgttaataaaaacacaacatactagtatttatcttagttataaaaaaaaatactggatctgtgatagactttaaaacatgtttcataacttgaaaagtagtaaaatagtcatttactaaatttcctgtttgtcagggatccccaagaccccatcaaggttcaatgattcacagaggactttgtggaactcattatacagtctctgactgattgtttcacttacgatttgtttgacttaatgatttttctacttgatttttgactttatgatggtgtgaaaacaatacacattcagtagaaactatacttcaaattttgatcttttcaataaattacagtagatactcaacactttattataaaataggctttgtgttagatgattttgcccagttgtataataatgtaactgttctgagcatctttagctagcacattaaggtaggctaagctaagctacgatgttcagtaggttaggtaaattaatgcatttttttctgcttacaatgggtttattggaatgtaacctcattgtaagtcaagaagcatatgtatagtaatattcatgactatgacatattataatgaaagaaggcaaagcacaatcagtaaaaggaaaaggtgcattgggcaaagtttggtgaaaaaaggatacaagctcctgagtcctctccctatggagtcacacaggatatgtttaatgttgaattatgacaactcttgtgaaatgctgtctagcagggaagttcattagaaactcagtgcccaagatttttgctgggggctggccacttaggcaccctctgcccaatatatcaaaattccagtctcccaaaattaaagcaaatttccagcataaactatattgtttgcaaaaaaagagaaagaaatagacatagtgagccactcttatcagctggagaatggtgggacatttcttgaagtccagattcagagatgccagccaaaggctaacctggcaaacaggtatggtattttcaagcttgctaaattaactattttctttttttacacatatatagtataccgcataagcagaagtgtcatgtgggaattctgaaaaagctccttaaaaggagcttatctttctagcttttcttccttattctctgaaattcaagtgtgatagctgggaatccaggatccaatttaaattgtgggcctacctcaagagagaagtcatgtgctaagaatgggtccctgatgacaccatgaagccactataccatctcaataatctctatcactagactgtttttctgtgagacagaattgatgcttatctttagttattatttctaaattcagaattagcaggcaaacaatttttaataaaaaattacttaataaaaatacacaaatacatttttaaaatgtgaaggccctataaataaaagatctgttaatcaaatgcaaaataataaaagtaatgcccttgaagaaacaactaaaagtaactaaagaaataaagaaaactgcattcattagaaatgctatattttaaaaatctaaaaaaaaatattgagtagcagctcatgagagaaaaaataaactattcattaaaaaaaaaattaaactgggcctttaatggcctaaaacaggaaatcacagctgaatcatcagtatgtcatttttatgtaggtaaagatgctataatgacataccatatattccaagcccttttttgtaatgagagttaataaatacaggaggatattccagttggctgtaatgtttttcccatagcttcaaaaggtttccctgatgtaaatttggcacttttacacttaataatcaatattgatttatcacaaattttacaaatggaagattttttttaagtgttgctgtggaagagcatttccatctttccttaaaagtttcttatgggaatttctttcaccattattctcaatcttgttgaaaatgaagcagaaattcctttaatgattttttataatagaatataatctaaattaacagtattgcaaacactgcagagtattagaaatgtaataaaaataaattgctctgttccagtgtgctctactacagtcatatttacatctattcataaggtaaccaaatgaactcctgctatttaagggattaaacaccaacaaaattatacaacagcacaattatagaaaaatgggatgcttccaaggcatataggtttgacagagatgtttgtaattacagtattcaagtattctagcaggtaaatttagccaaactataccaaatacataatacagtgcaattctaacagtgttttctaataattcatctaaaatcccccccaaaacaagttaaattaaaatggcttaaggaatattatagagtgaaacatctgcccctctgcatttttccaggcatctgaaactggaaagagaaaattaacatctccaattcctatcggtacattttcaatcttatggacaaatttttacctcatattttgccactataatatttgaacgacttttagaaaaataggaacaagaacaacaacacattatatgggtaccttgcaacacttggagatgtaaatgacctttacatctgtcagtttacaatttaaactccattcaacatccaggtgattgaaagctatcaataagatatgcgaaactaaactgaggcataagaaacaatatacattaaagaggaccattttaaatgttcatgtaagtagcccaatttaggaccaatgaatcagagagcattaacagtacactattcctacacacatttgaaatatttcaacccactagattaatgtagggttaaatattgcaaggatttatatttaccttctttggattttgaataaagcttaaaaagataagaaatgtaaactaattttgtgctcgattttctactggggatttttcaataatcgtcttcatgtaaaccccagcagtaaatatattgtagtcttcaatttgcagatgactaaattgagattcaaaaatattaactaactttcctactactgcacaattagtaaatagtgcttccagggttccaacaagcatctgtattgactgtttttctactgaaagtcacacatatttattaaagacttattcggccaaattatttattaatgcatctcatttaaccctcctaagagtcacattaactaagtactagatcctaaatttacagatgaggaatctgatgcatcagaaaggaaaatgattttctcagatcccaaagtagtacatgaacaagctaggatggaagtcctacaccatctgagtccagagcctgtgctcaatctcactttgatgttaagagacattgactccagtagctttaatttaggtagatcaggaaacctttctccaagaacaagtgaaaatggaaggctgctgtaactcttggtaaagtgagcacacattattaaattttactcagccattgtaaagtttcctatacatattatatttctaccagattttttttcctaattgaaatagcaatgaagaataaaacacaaagttatcctataataacactacctgggtttcttggaactgaatgttcctggtacggaaaaaataagaaaaagaaaaaaaaattgaaccttcgtgttggaaaaaaaaaaaagggagaagatggagaattcaaaagttaaaataaaaaaggtctgagaatcttctgaaaacagagtgttcttctccacaaacagcagggaaatgataggatataattgttaacatactggcagcttccagacatatgtcttgagtagcaaattagatattttgacttttgtacaaagatggtaagatcaaatgggttatgggggtagatggataggaaagttctccatatgattgccccatatgaccacaggatacagtttcctggacactcatcatctcattccacttttgactagaaagtcttctttcaattcaggggccagaaagctaaaatctatgtttaccagactcccttgctctaagcttgcagacagagtttgggttatatcatgaagaattcagaaccagattaagtgggaagagatgtgctttgtaaagcatcagtttttgttggtgcaaatcacagtatacatagtcaagaaacagatccaacagttttagggcaggcttcttaatcctttgattataactaaggtacatttttcttggaccttggtagggagagttactttggattctaacagaagaagcagttctcttggtgggcaagtgctgtgatattattctgtatgttattcttgcaggcatagccttaggacatttctctgcagactttatgttttgtaaggaattaattacctagagtaatccacttgtgtttaaacaagctaaatgaattctattgtctgcaattgaaccctgactgataaaccttttctcccttcactctccaccaacctcaatgaggttcaccttgaaagccaggccaaagaaagtgaagtgtaaagtcagtactactatgccacctctacagcccccactctccaaaagtatgctccctccagggaattacctgtggtacctataaaagaaaaccgcagctttattccaaaatgataaatcaacaccatagactctaactgcccagtgaaatttatttgttgacagatactcttagctgcctaagtattatctgtaaacccatgagtttaaatgatggttttcaattctataattttaatgacagaaagaggaatgatggaaaataggagggcattggtaactaaagagagaagtggcaccatcaacagagtgtgaacaatcagaagttacgttctgctaaatgaaaacattacttggtactattttaaacatgcagaagctactctgcgtaattcataaagactttaatgtgccttcaactgaaagtaactgctattataaaagagtttcacactcagtatttaaattatcagtgtacttacactttaataaataactttataaagtttaaaactaaaagtttactgcttgatagtaaactatgtcaccagttcatctatccatgtaaagataaaaccaatatctgcaaaaacccatgaatacttagtttcatcctgacataaatgaagatatatttcacaatatttacaatcattagaccttataactgagagaactgcatataaaacactaaactatatgttaggtaaaatataaataaaattcttattacaaaaccgatatattaaaatctatgtcaaaattacaatgcgtatgataaagatttggtcgtctctccttacgcgcttagttttcaagctagcaattatgtgaacatatattcaacttgcatcagtgtactgtccttgatttcttaaaaatccaaatttgtactttagccttggttgtcattttcttaaggatatctcattgctttgaatactcttcatgtgatatgtagtatgagtaaggtgggtcattaaagcaagatggcagagggagaataaaaatgaggaattactggtcctaaaattcaaagaaaaagatgttactatagaaaattttacgcaaagggcgggaaaacaacattttgttacagtttataaaagaaaccatgctatgtggttaactaaaaggcaaagtattgacctgatagtatattagactgtttcaattcaaacctacatttagacatttctgagaacatttcactcccaccacaaggactggggagagagaactcaaacctttaaaagttatgaattagaacccctactaatggatctctctattagcctcacaacttgcactcaggtcctctaagaaaataggtgacacaattgaaactattcagcctgtttgttgcctcctgaactattgagggtaacccttaaaatgttttcgtctacctggctagttcaaattaaaaacagcaaaatatcttttttaaatatttatttttcttgtcactgaacttactttttacattcagataataagaccgacaatcacatagcaataaaaataaaattaccagacacagtaacttaatattgtcttaataatatatgtgtgtgcatatatgctataaatacttatatcattaaattataaatattaaatgtaaatattcatattatatattatataaatgcatatatgtagatatatgtgaaaccataatcataagtcatctagcataataacaaaccctctagtatacaaaataccataaggtaaattatagacaccgtttatcaattatcaattaaggtttggacatatctgaaattttggtttatcatagcaattttcacatactgtattccttaagtaaaggaaatgataaaaacctaggatctcagtattccgaatgcacatctaccactgcagcttctatacttgattcccaagaagtcctgggatattaaatatgttcaaatatcaatttctctggcaagagtacatgttaaagatacaacaccaagaggaaataaatacatattaaacttatcaggccacaggaaatgacatacattccaagacgctactgtggcacttcatgataaggatttttgcctcacctaatacatttatacattcattattttaggtaacagtctcacagcaactctcattacaaaatgaatacaatacacataagacttccaacaaatagcagatgctagagttcatagaaaggcattgtattataaaaatgtatttttatccttccctaatattctctgatggaagtatttacttaattttgtcacttcagtcaattacggtatatttacaaagctggcttgtcttttattaagaaattagtgttcatatgtgtaacaatttgaacacgtaattatgatatctaattatataattagagtatgttgaaatgatcaaaatcttcattatcttattgattttaaaagagtgtgagatatttcttaagcatctcaagcatcacttacaatattgtcttccaaattgcttactttccaaagttaataagacttgaaagacaaagagaagctaatgacagaagtcacgtatcctactgggtcataaaacaatttttgcatatcacaacctatgacatatcaaaatgcctattagtaatagctcatgattctttggttcaatcattcaatttattaatttataatacatttattacttaaaagttttgactgggaagaaattttcttagtcctggaattatgatacaaaaaagtttcagtgtcttttgaaggaggaggttttattgtttttgcttttttagaaactcatcctcgaaagaataatgtgaacaactaatggcaattcagacagtgtaggcagaggggatcttaaaaacctttctgttcctcacaatctttgctaaatgcgtagattaataacagttatcttagtctgaatcctttaaaaagaccagagcctgaagcaaggattagagtactgacattttctttgagaggtgcaagctcaggaaatgaagatgagagaagaaaaggggatggacaatcttgtggcaaggaaaaatgtgaggaaatgcaaaggatgtgttgttcgtgatatgcctttcttctgcataccagattatctggaaggtttgcaaagggaaaacatacttccattgccattccctgatgggagaaataataataaattatctgtcttatcccttcctgttcctgtttcccatatatctagactcatgccgagaggaactaactttcccacatggctgagcttcattagctgaccccagtggctgctcaggaagccatatctgaaggctaaaattggccttgggaattaaacactttaccaatgccaatgcgtgggtccaagggtcaagaagcagagagtcaaaggtatggttagagaaaatgtgttacaagcaaaaaacactgtggggcctgtaatcccagcactttggaagaccgaggtgggcggatcacgaggtcaggagatcgagaccattttggctaacaaggtgaaaccccgtctctactaaaaatacaaaaattagccgggcatagtggcgggcgcctgtagtcccagctgctcaggaggctgaggcaagagaatggcgtcaacccaggaggcggagcttgcagtgagccgagattgggccactgtacaccagcctgggtgacagagcgagactccgcctcaaaaaaaaaaaaaaaaaaaaaaacaacactgtggggaggcaagagtgttattacaagatacttttccaagaccaaagctgaaggatacacttaagcctagtaggaaatgtgtaggagcagttggtgtttgaggaaagtcatgagaggtaacataaagagactgagattcacatgctatttctgtgataaagaaatgttaagtaggcaggatgctttcttcgaatgaccttttaaaacaaaacaaaaacaaaaacaaaaaacctgattttgctagtgatgtcttctcaaatgcttccctagtttctgggcaaagatagatgaagcaatgatagcatcccataagtgattgctaaataaataaagaaccatttcagtgccttctgagagcagataaaaggatgctgtgtctttatacattagcaaagtattaaaatacccaataatcaactagtttgaaaatgtccaaaataagttaacataaaatatcagcttttagattttggaaaagtttattttcaagaagctttttcctgaactgggccataaactataaagaaaagtctccatgaaaatgcactctaactttgcttgcaaaataagccaagctgttagaaaccttgtaaggcaccaatttaatatctccctctgacccagttcttagaaatgttatcaagttacctattaatataacttactagtgcaaataccctgaatgtggagtacttataatattcaggttcctataaaaatagctattgcctccccaaaagtagagcaagtcttccctatcccacaacctaaatctaatttgacagacattattaattcagattaataatgccagagaatctagtgcattaaaaaagaaagccttgctaaggaaaaaaatcatttattgggcaggaaccaagaaggtaaggtcctaaaatctaaaacaccttagttccctgacttaaaaaaaaaattaaaatcacattaagcaaattggagaactctaacttctaacataatcaaatgatttgcaacacttatgagccgcattttacgcccgggtctcccaggccttgcccttaatgcaaacttacctttatacctctgaattcacctgagacaatgcagtagaaatgattctaaataatgagtaggacttttaaacatagttttacaggtaaaaatgatggcatatttcttctcagtcactgaaatggggcaaaatggaaacaacaatcaagatattctttctggaatggtcacagattgtcacttagctgcacaaaaatattagaaataaaataattgttatacgaatatatctgttcgtagtggatgtcgaagtgtactgtcaaaaagtagcaaattaaaactccatatccatgtatatggcatgcaccattcacccagttcctcatatcgaaattcttgaatcacctccatatgcagtccctcaacaaaattctccactcaaaatacatttgatctactttcttctactactctaaatattcatctgcttgcccaagtcaccatcatctctccctagacacaaggtccaccttccattcttgacccctctaatctatgtcccaaattgcagccagagtgatcctgttaaaacacaagtcacattctaactgcttaaatcctcttttggcttcccattgcccagaaaatggaactcactcctgttcaccaggccctatatccttcctcatatcttgtcactcacccccagtcactgaactcaaggcaaacctaccttcctgaaagacaccaagagtcctcctgcttcagagcctgtactctttgctgtctctcttcttttaacttcatgcaagcctctgcctaaatgtcatttcattggagtaggcttccctgaacactctattaaaaatagcagtttctattattcccaatcaccacatctactccaattttcttcagcacacttaccaatatcagaaatcagaacatatatgaatttgtgtattacctgtttttccctaaaaaatataactttcatgtgggctgagattgtgtagatcttgttgattgctttatcccagcacagtgcctcacacttagtaggtggttaatactcacctcccttctatgacatgctgctgtctttctttagaatattctgggtaagcattgacaagcagaaattatctcggtaatgcccccatgtaattctaagggaaatctgtactctaagaaattcaaggtcttacgtgcttacaaaacaaaacaaaacaaaacccagattacctatttaggaataataaaaacatcaacattattaattaaaatgtttgtgttataaattaccctatggaccgctcaaaaaaaatgtggaaatgccatgttcccagacgggcatttactcagagaataagatttatgaaaagactttaaagcttagcagtgttaggaagaatagaaagtaaaagttcaggaacaaaaaggagatatattcattaatttctccacatataatgatgtaaaaacaaaataaaacaacccaaaatacactgtttttagtaaaactatgactaatgcagaggaccccaaataatacaaaatgatttataataatattttttaaattaatagaaagtaaggatgagctaagaggtagaaagtttaaaatgggaagaaatatctcaattttttgttgtaagtaaattgtgatcggctctgcaagaatctctttattctttaccaaaaactccattactggtgtttatgtagctgggtttagttgttctcagataactatcaaacgtaaattatcttccacaaatttgagtgctactatcgccatcataaagttgtattgagggcctaatatgaacctcatgctagcttgggggaaacaaaacatattatgtgaccctgacgaccgtaacctttacgaaagtcaaaatttattaaaaaaaaaaaagggctctgataagtgctaaattaaattacggacaaattctgtcacattgctttagtttcctggactagtatcactgagttgaaacatatcattattttaatcataaatatttcactataggcttctactttaacatgtctaatataaattactgtacattgtgtaaaataatttataaactttctaagggatgagaaaatcagccttctcaaaaagatgtgtttgcattgcaaaaggcaagtaatatgctttgatcaatttgatgtgaaacataaaaagcttctttcatagaaaacagataccaggcatacaattttaattgaagagaatttttgttacttcttaatatttcaagggaacacataccaaaaggagctgtaagtcagttattttattattacctttggctattttactattacatttcaataagataatgaattttcctttggggaaaaaaaagttttcaatgcttaacaaatgagatcattctaaattaaattatctgcctgaaaagacactattttaataaatatttgattgaataaaagttattttcctccacatacacaaatgttattgcatccttgctttttgaaacaacgggctttatatcaaaattttatatctttttttaggcatacatttttttcccagagtttagtagcaatctttttctctatatatttcagtccttgaaacatattgtgcacattcagtgttataaccttgtcactcaaagagctgatacaacacaaagtgatttcaccaaaaataatggaaggatagacattatttttggttagaaacagtttttgctgtttttttttgagacagtcttgctctgttgcccaggctggagtgcagtggcacgatctcggctccctgcaacttctgcctccctggttcaagcgattctcctgcctcagcctcctcagtagctgggattacaggcgtgcaccaccaatcccagctaatttttgtatttttagtagagatgggggtttcaccatgttggtcaggctggtcttgaactcctgacctcctgatccacccaccttggcctcccaaagtgctgggatcacaggtgtgagccaccacgcccagctagaaacattttttaagaagaagaatattgtgcttgtcatgttcagtttcttgaaccgggttataggagtgtgttaagttatgaacattcaataaaacagcaatcataataataaagagtaactagtttattaaaaagttcaagaagcactgtattttgtcagtgtctggaaaaataacaccaaatgtgcctttctttgtggatactccatttaggaaaaggtacaaattggaaatgaaaaggaacgtggtatgggagtggagagaaaaagaagtatttgaaaagaagtctcagaaatcatggatagaaaataattaatgattattactatgtaagtagtgcatgtcttagaatattgcacacacaactgaggggttttagcaaaaaatacattacccagaaaggaaaatgtaaagcagaagcagtgtgctaaattgctgttgccctctcctgatctcccaattagtgagcacttagccaactctcttgaaagcaaatacctctaaggagggtgtcacttaattattcatattttattaccaattactttaatcagatggtttcttcataacatttggctgaatcagctaaatttggaaatgttatgcataccatccaagagtataaagaggcacatgtgtgattttagaaaatgggttatttgaaggaaacttgctccagatatgtttgttgaaatcattgagggttttcatgttctgcttgaaaacttaacctttaggagtggatgaccaatccaggagatgggctttcagagtcacttgatgttgcaaagttgatcatttaaaaggttactttaatacttccttaaaacaagtgtaactaattcaactctcaggaagcttaagatggcctgggggaagggaaataccttaagtaatcctaacgaaagctaagtctgtgctttatggttggaggcacatgcaggcaaaatggtgaaaccattgctctccttcaggctccatgcacttttagataaacatccaaacatcctcatattgcctcaggctattttcatagggccaactccctgggacttagaaaaatcctatcttttccattaaaatgtcaattccttcacaggatagaagaaatttaaaaattattgtgtttgttttttgtgtgtgtttctttccattgtaaaaatttgttaattttagaaaggttttagttgtttgctttagcaaaggtgttttctttaattaaaggtcactccttgaaccaaaagtttaagtcgccagtgaattatttgtggcccaaattatttatatgaataattatgtgaaaagagtagaaatgttgtcccaaacactttcatctcccaactcttttcctctgactgtcctgcattccataatgtttcattgtatcataaaaccctagcacatattttatgatttttccactgaggtaaaaaaaaatgtttaacattcaattggcaaagtgatgtttacctaccaagaatatttttgcataggggaacaaaacaaaatagctaaattgaaatcccttctttactatgaaatcattttgtgatcctgaagaaggtactcttttttctagaacttcatttccacatcagtaaaatagagacaattatatccaacatagaaggccattgtgaagaaaaaatgagatggtgcatagaaaatgacaataggtgttgtttttattttccttagtatcttttctgcttccctggcacttaataaaacctactaagtgtcttatcctaataacctatgaagattgctactatttcatttagaataattgttcatacagattataacaccttccccacacacacacgcttgcagttctgcttttcaataattacgtagttattcaatggtttgataaaatattgccttgcatagaggatattaaactcatgaaactgagaggtgacagcgtgctggcagtcctcagagccctcgcttgctctcagcacctcccctgcctgggctcccactttgtggcatttgaggagcccttcagccccccactgtactgtgggagcccctttctgggctggccaaggccggagcccactccctcagctttcagggaggtgtggagggagaggcacgagcgggaaccggggctgcgtgtggcgcttgcggggcagctggagttccgggtgggcgtgggcttggtgggccccgcacttggagcagccagccagtcctgctggccccgggcaatgggggacttagcacccgggccagtggctgcggagggtgtactgagtcccccagcagtgctggcccaccagcgctgcgctcgatttctcgctgggccttggctgccttcccgcagggcagtgctcgggacctgcagcccgccatgcctgagcctcccacccactccatgggcccctgtgcggcccgagcctccccgacgagcaccaccccctgctccagggcaccgagtcccatcgaccacccaagggctgaggaatgctagcgcagggcacaggactggcaggcagttccacctgcagccccggtgtgggatccactaggtgaagccagctgggctcctgagtctggtggggacgtggagagtctttatatttagttcagggattgtaaatgcaccaatcagcaccctgtgtttagctcaaggtttgtgagtgcaccagtcgacactctgtatctagctgctctggtgaggacgtgcagaacctttacatctagctcaaggattataaatacaccaatcagcactctgtatctagctcaaggtttgtaaacacaccaatcagcaccctgtgtttagctcagggtttgtaaatgcaccaatcgacactctgtatctagctgctctggtggggccttggagaacctgtgtgtctaaactctatctaactaatctggtggggatgtggagaacctttgtatctagctcagggattgtaaacacaccaatcagcaccctgacaaaacagcacacttggctctaccaatcagcaggatgtgggtggggccagataagagaataaaagcaggctgcccaagccagcattggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaaaattagatgaccactgcaattatttctagcttaataattctaaaatttatgatctataaataatctattcctacccctgatgattttcccttttttggcatttagcaggcttgataattgcttctttatttagctctctcttgtgagagattctgcttttaaggggacaaacttacctgttttgttaattattttatctccaacagttagcacagtgcctgacatgtagtagtctcttaaaaactacctgcagaactgtaatgtattggcttaacaaatgaataatacccaatgtattattatagagaagataatagaagtcaattaattttaaagtatttaaataaaattctatttgccctaaagcaatgtattttctgtataagttatgtaccctctggaattaagtgaataagtccctatgtatccaatattacactcttgccatttttatttatatatctgtcttttctactagaacttcttagctattggaaggcctatctctggcctttggtatctaacatatttttttggccacgtatactagaatactctacaattttccattgaaagaatctcaattatatacttataaatataattgtcttaattcttcaaaattaattttgcttatatccttttcatttgactcttggatctatgtcaatactgatttctaaaggtttcataaaatagagtcagcctttatggcaaacatattgttgtctaggttatagtacacagaccagctggtatttttcaatgacatgacatcttgattaaaggtgtagaagatgctatcctgtgaaaaggctttgaaaatgtgggttctgtgtctgtatatttttatatacatataccgaaacagtattttgttcccatgttctcttagaacaagatcatttgtatgtgaattttcttctacctcttccatccctaagacagcaagaccaagtgctcctctcttcctcctcagcctactcaatgagaaaacaaagataaagaccattgtgatggtacacttccacttaataaatagtaaggatattttctcttccacatgactctcttttcatttctttttttatttgtttgtttttgagacaaagtctcactctgtcacccaggctggagtgcagtggcaaaacatggctcactgcagccttgacctcccaggcttaggcaatcctcccaactcaagtctcctgagtagctgggactacaggcacatgccatcatgcctcactaatttttaaattttcttctgtagagatgaggtgtccctgtgacgagcccaggctggtctcgaactcctgaggtcaagagatcctcccctcttggccttatgattttcttcataacagtttcttttctttatcttactttattggatataatacatacaacatacaaaatatgtgttaactgacaatttatgttactggtaagacttctggtcaacagtaagctattagtagttaagctttggtgaagtcaaaaattatacatgggttttcgactgtgtagggttcagtgcccctacccactgggttcttcaagggccaactgcacaattaattcatgatatggagttagaagggtagaataaaggacttcaaagtgccttcctaagtctaaacaactatgaaataagagaaaaatttttctgtcctgaccacagaaaattgttcaagacatactttaagtgaaaaaagtaagttgtaaaactgtaggtacatagtggtagtattttttgtaaacatacaagattttaaatttattcttatttctaatatttaaagaaaaacatacaaaatgttaaagtcgttcattacctagttggaaattcactcaaataggaacatcctatttgtaattgcaaccatttgcttaagaaaataatggtaatcacttatagagtgctccattcaagcatttttaggaacattaactcatttaatactcacaacaactctacaaagtgatggtcattatcacctctttttgcagacgaagaaattgaggtaagaaaagcaactttcttgctcaaagtcacatagagctaatgattagtggagctgagcttcacagatagattctttggctcagaggccagttttctccaagctcacttcctacactatgctgccctatgctcttccctcggcagcccactccaaacattaacctgatgtttatgctaatcaacaatttgattttatatttacttactatccatgtattttacaaataatgctttgagcaccaattatgtgcaaaacacagctttatctccagtaactggtaagtccagcttttcagtttgttcccagtaatagctagccaaaaatttatcagtccttcccccgatcctgatctagtcatttcacacccatttctaacatcaccaatattggtaaaaaataagaggcatttgaaggctgctgggagagatataaaggcacctacttcaataccctccagaaggctgcaatttcccaaactcctttcaggcaactcaaaatgctcgtgtattagaataggtactgtatgcatacctacagtgaattgttagaagagactactgacaggtataggaggttgagctagatgactcctcaggttcatccagataagtgtggaaagagccagttacttactaactgccttggaaagaacagcactttccccaggaatgaagactagtaataaggtcaacaaactgcaaaaaccaaatgactcctccctttattttttaaataaaagaagtatttaaagctgtattaaggtttccaaaggaaataagaagaaaggttaacaggaaagaacaaaaacccattaattctgaagcaggtaatgaaacacacacacacacacacacacacacacacactcagacgtatcaacaaaaagccagatgatccctaggagcataataggtagcagagggtgaggctgcagtccttggtttggagaataggaagattccccataatctatccgatgcctatggccaaagcaagaagttactgctatattgtgcgatcctcagttatcaaatgggcattgtacatatttttctgtgttggtgtgtttttctgtgaataaaaattactttctaccatgtaatgttaaggctatacttcaggctgtatcttaaccagtgtcttttggtctcaggaccattttggccacaaggaaaatttaaaccttgcaggacaagaggtgctgcgtctgctgaacctgcatctttgggataagggtagtatttaaacgaaggagtcaactgtggaactcctccgggtgtggagacagaaataaaataaataggtgtgtatatcccatagtgctgatatagtttcatattttttttttttttttgagacagggtctcactgtgtcacccaggctggagtgcagtggtgtgatctcagctcactgtaacctctgcctcgcaggttcaagcaattctcctgcctccgcctccttggtagctggaagtacaggcacctgccaccatgcccgctaattttgtaattttagtagagttggagtttcaccatgttggtcaggctggtctcgaactcctgacctcaaatgatctgcccacctgggcctcccaaagtgctgggattacaggcgtgagccaccgtgtccagactagtttcagatgtttaacatcagtacatatttattattattattattattattattatactttaagttctgggatacatgtgcagaatgtgcaggtttgttacataggtatacacgtgccatggtggtttgctgtacccatcaactcgtcatctacattaggtatttctcctaatactaaccctctcctagcaccccccactccctgataggccccgacgtgtgatgttcccctccctgtgtctatgtgttctcattgtccaactctcactcatgagtgagaacatgtagtgtttggttttctattcctgggttagtttgctgagaatgatggtttccagcttcattcatgtccctgcaaagtacatgaatacatccttttttttatggatgcatagtattccatggtatatatgtgccacattttctttatccagtctatcattgatgggcatttggattggttccaagtctctgctattgtgaatagtgctgcaataaacatatgtgtgcatgtgtctttatagtagaatgatttataatcctttgggtatatacccagtaaagggattgctgggtcaaatggtattgttaaataagtgaaaaaataaataaaaaaaataaatataacatatattatacaaggagtaggagagtaaaaaggatgaatttattttacaaaaaaatgagaaacatcagacggaataataggaatagaaaattataacataaaaagcatgcctctttccacatcttatataagcctcacagaagagagaatatcatgttagaaagtttaggaaaatagattaatgaaagaagacaattttttctgtgaatttgcagaaaatcattgctagatagtagccacaaggtaataatttagacagggcaaagctaaatataaaattatattttttaaaagttatgtgacaaatctttaatatctaattgaacttatacggttttatagtaataaaataagtcaaaattggcagatggctggcatcatgcaaactatattgtctgggttttgtttatttttgttcagcttggtttgctttattttttaatataatttctgagcatcagataattgtaaatcttattagtggctagaaaacaaaaacagtttgcttaaaagcaacggagtattaggtttatcaaagtaattttaaaatttttgttgtatttctctaatagcaagattgatttgaaaaaaaattcaattaatgctgctataagaactcagaaaaaaattagtatatttggtgatattaccattgcctaaaaaccaaaagtaaatttatgtttcccttccttccttccttccctcccttcctccctccctccctccctttcttccttccttctctctctttctttctttctttcattctttcttttttgttgttgttgttgttgttttttgtttttcatggagtctcgctctgtcaccaggctggagggcagtggtgcgatctcggctcactgcaacctccgcctctgaagttcaagtgattctcctgcctcagccccccgagtagatgggactacaggcacgcaccaccatgcccagctaatttttgtattttttagtagagacgggatttcaccatgttagccaagatggtctcgatctcttgacctcgtgatctgcccgcctcagcctcccaaactgctgagattacaggcatgagtcaccacgcccggcctctttctttctttctttccctctttcacaaaatcttgctctgtcacccgggctgaaatgcagtggcacaatcacaactcactgcagcctccaccactggcactcaagcaatcctcccacctcggcctcctgaatagctgagactacaggcatgtgccaccacacccagctaaattatatatgtatattttaaagagatgtggttttgccatgttgcctaggctggtcttgaactcttgggcttcagcaatccacccacttcaacctcgcagagtgctgggattacaggcatgaaccaccatgcccagactcatgtttgaccacaattcttatggcctctttaccttcttcagagtttattgttaagacaagacagagagtaactttaggctacatttttttttagagaaacagttttagatttttctgtaaacagtacaggaataagctgaagtcctacggagtaagacacttatttcacttatttactgaaaaaaagttcacaagattcttctttgtatttcttttgtgttgcagatcctgtcaataaagtgttgataactagagaaggtaataggagacaatacatctgtaacctgtcactaacatggcaaggaaacagaccctcacactattgaaaagctaaaagagaacacccacagactattatgattgtatccagaagtcctgaagaaattgtttaaaaagcatcagaatgacatgggtagagacacaagattatgaaggaaattctggagtgtgggaaaggtcttaattcattgtatctgtagtgtagcttgacattagattagacactgagtcaatgtattcctacccttggactatagcaaaagacaaaaacaccagcatggagccatctatcagaatactttactgctaaaggcagaacagttctctggaactttcagggagcagaatactcaaaacttggaacagaccacatgatacaatccaagctggcttcagggagcaagactgccgttggtgaattctggattatgctgtatttttaaagttttattatttatttgtttgtttacttacttatttataatttaatgagttaatacactctttactatggactgaatgtgtatgtacccacaaaggtcatatgtataaacgtaattcccaatgtgatcgtattagaaggtgaggcctttgagaggttaattaggtcatgaggatggagccctcatgaatgggaatagagttcatagaagggactgaatcgactagagttctcttcttccaccatgtgagaggacagtgggccctcaccagacaccagatcttccagcactttgatcttggacttcccagcctccggcactgtgagaaatgaatttctgttgtttataaaccacccagttctaagttttttgttgtagcagcctgaagagacaaagaaagttttccacacagatatgtgtcttttgttaaaaaagaagaagagaagaagaatttaagatattgtggcaattttaaggcataggcacaaattccttggccctttgtccattgaaagatggggtttatgtcttcatcatctgaatctgggaggagctgcatctccatggataccactaccatccaggccactattattatctcacctgaaatatatcagtcacttcttactgggttgatctgctttcattctttcttcccctgtggtctatttttcttaccagataaaaaataatgtttaaatataagtcaaagtacactaattatatccttgcttaaaagtctctaatagcttcccactactcttgtctattatggagctttaaaatgcctacagaaactttgactttcatatatgtttggttttctgtcctagaattcttcattgcagtccttgcttcagggccttttcacctactcttccatctacctggaaaatttcccttttatctcctgcctcatacatctcaccaaaatcttcacatggatcaggtctttctcatcattcagatctcagcaagataactctgtctgtattccttgtgttctccactaaaatgtaagcctcataagaggttagacttgatccatctcatgccctgttgtaccttcaaaagttagaacagtcctattacagtgtaagcactttattatatttagtacataatttttttaaaaaaacacttgacgttgtctactatataactcattacccccgaagtatacgtactacatcctgaacattgatatatgggagatgaataaaccatcgtacaattcttagattgttgttactgtcattaaaagtacagctaccacaaataaatatcacttgtttgctgtttcacaaaaagcacaccaagatgttcaaatttcccataaatcattcacactcacacttggatagataccaaattgtttggaagtaaaacaatctcactcaagacaaaagaacgtttctttaaaatcttcagattaaaaaacacaatcaacataaagaaaatgctgtctctgcttattagttgggtgtccttgacaagaactttaacctgttattgggtttgttccaactaaaaaatagggaagttaatagtatttgactcagaacaaggttggtttctcttgtattattattattattattattattggtggtggtttgcaggaaaggtgctactggaaataagggaagaggctatagtttcccagagtgacctttccctcaccccagctattcttccttcttcctctactgccatgatctggacaacttcactttcaatccagatttgtaagatggtaaaatagtggtcactttttactttatcaggccattttacagctaaagggaaagtggatagggaacatactttgattaaaggtaggatacaacatagaaaatctagaattcataaatactagattctcatgaagtacacaaacattgttaacaataagataatcttataataaataagaaataaattactaattttattcaggcaaaccactttcagaacagaatagggttgtgatatatttaattgtgacagcatcttttcacataaaatataatcataatacacacacaagtcccttctcaaaaagaacaaaagaataatttaatcacaactttgcatatttctgttcatgtgaactggctattccatttttcataatctagtaagctcctgatagcaataaaggtttaaaactatgcaagaaacatgcagaattttaaaaaattgaatctgttaatttactatgtttttactgcaaattgagacacactgacattataccattttggtgatgaaacacaagtgcttacaggagcacagtttgggagtaacaacctgaattcaaagcttgacagatatgaaaatgctaaacagatctgtatgttagaatacagcaagaactggcaaaggagtgaggagaaggaaaaggtgagagtgatttctcaataaaggaagaaaataacatgtacacgtgtattagtccattatcacactactataaagaattacctgagactgggtaatttagagaggaaagtggtttaattgactcacagttaagcgtggctggggaggcctcaggaaatttaacaatcatggcagaaggcgaagcaaacatatccttctcacatggtggtacgagagagaagaatgagagccgagcaaaaggggaagtcccttataaagcatcagatctcaaaagaacttactatcatgagaacagcatgtaggaaaccacctccataattcaattacttcccactgagtccctcccatgacatgtgaggattatggaaactacaattcaagatgagatttgagtgaggacacagccaaaccatatcattccacccctggcctctctcaaatctcatgtcctcacatttcaaaacacaatcatgacttcccaacagtcccacaaagttttagctcattccagcattaacccaaaagtccaagtccaaagtcttatctgagacaaggcaagtcccttcctcctattagcctgtaaaatcaaatgcaagttaattacttcctagatacaaagagggtacagacattgggtaaatacaccagttccaaatgaaagaaattggccaagacaaacgggctacacacaccatgcaagttcaaaattcagtagggcaatcattaaaacttaaagttccaaaacaatctcctttgtctccatgtctcacatccagggcatgctgatgcaagaggtgggttcccacggccttgggcagttcagcccttgtggctttgcagggaacagatccctccaggctgctttcatgggctggtgttgagtggctgtggcttttccagaagcacggtgcaagctgttggtgaatctaccattcagggatctggaggatggtggccctcttctcacagctccactaggcagtgcccccatggagactctgtgtgggggctccaactccacatttcccttccacactggcctagcagaggttctccatgagggctctgcccctgcagccagcttctgcctagacattcaggcatttccatacatcctctgaaatctaggcagaggttgccaaacttcagttattttcctctgtatactcacaggttaaacagcacatgtaagctgccaaggcttggggcttgcaccttctgaagcaatggcccgagttgtacattcgcctcttttagccatggctggagctgaagcagctgggatgcagggcaccatgtcctgaggctgcatagagcaggggggccctgggcctgccccacacaaccatttttccctcctagccctccaggcctgtgatgggagaggctgccatgaaggtctctgacatgccctggagacatttcccccactgtcttggtgatcaacatttggttccttgttacttatgcaaatttctgcagctggcttgaatttctcctcagaaaattggtttttattttctatcacattgtcagggtgcaaattttccaaaattttatgctgtgtttcctcttgaatgctttgctgcttagaaatttcttccaccagataccctaaatcatctcactcacactcaaagtttcacagatctctagggcaggagcaaaatgccaccagtttctttgctaaagcatagcaagagttgcctctcctccagttcccaacaagttcctcatcttcatctgagatcacctcggactggacgtcattgtccttatcactatcagcattttggtcaaagccattcaagaagtctctaggatgtcccaaacttccctacatcttcctctcttctgagccctccaagtttctaggaagttccaatctttcccacattttcctacttattctgagccctccaaactgctacagtctctgcctgttatccagttccaattttcgggtattcttatagcagagccccattaccagtaccaatttactgtattagtccattctcacactgctataaagaactgcccaagactgggtaatttataaaggaaagaggcttgggtgggaggcctcaggaaacttacaatcatgatggaagaggaagcaaacatattcttcttcacatagcagcaggagagagaagaatgagagctgaacaaagggggaagtcccttgtaaagccataagatcttataaggatttactgactatcaggaaaatggcatgagcgaaacctcccccatgattcaattacctcccatcgggttccctcccaccacatgtggggattatgggaactacagttcaagatgacatttgggtggggacacaaccaaatcacattaacatgtgacatattacccattttaattttgcaagaaaacagaaaacagaattctgaaaggttgaagtatctaagacattaaagagattgtaaattgacaaagggaaaaaggatataccaaattttaggcaaagcgtggtagtatgaaggaaaacagtatctcagaggaagagcttggaatgggtttgactagacaaacaaccctccagggagtcacgggagatgaaagagtggtggcaggggactgactgtgtgccttacaggtagtgggatccaacaggtgcttttatgtaagatataacatgatcagatttgtgtgttcattgtaggtgttcagattcaggttgttaacacttagatttgtcccttggccctatgcctgcatcttcagaagcttttcaaaatttatatgcaactactttcttcacaggaagttttcctaggccctaacttctccctcctctttttaatcctcattttcttttcagcttccccaatttccataggatgaagtttcactgaaattaaatttttcatctttgccttgttacttaaaaatgataatttggtttaataggtgcattagcttttattctgtcaactgcttgtcatagtacctcatattttcacattccttggtcctacccaatgcagttctaacataaaataagcttccaggatattattcttatatctgagcagtgtaggcatgttagtcctgcttgtctggtaaatgagatcatagaataagtattactggaaaccagtattggcatatttgtatagtccaggtgttaactgatgttatcccatcttttgagacttttacataaaattaaattgacccatttcctgcatcttcccttcccctaccccactctctacatttagtgggaagtttgatgcccacctccagattcctacaaattcctcaaagtttgggttattttaatgggccttttttggttttaaatcaaatttctttttttttttttttctgaagccctgatcttatatctcactctgatggctattttattcaagccccacagcaacctataataccttcctttaaaactgacgtggccagggcatgattaacatggagtatgtgtgggagactactgaattttgggatggtttgagaaaggggctatgattacatcataggagtatcaatattaccaatcaaaaaataaaatattcaatatgcctgcccctaaatgtctttccgtcactttccttccactccagtcaggaatttatccacgagtgacactcaccaacagtaccctttgctcctatgaccctttctttctcctgtctcaccccatttctctgcctacatttctctggtcctccttacttgtagtagcagtacatttatccagtttatctatttgcttctttctttccaaacacagcatgcacggaagtatgcatcttgcacacttaaagaagatatgctaaacaaaatgtcatttctctggaaggaaattctgatactccattaggagaagaggtgattttacatagttgtgactttaaatataactttttccttctttattatagtttgattgagttggtttgtaatttggaaggaaatcgaataacactttttattaaatgtaacaaatcataaaatggtaatttaattaaaattagagccagaaagaaagagagaaagagagaaggaaggaagaaaggaaagaaggaaggaaggaagacaggaagacagagagggagagagaaaggaagaaagaaaagaaagaaaaaagaaggaaagaaagaaagaaaaagaaagaggaatgaaggaagtgaggaatggaagaaagggaaagaaaaaaagagaaaagaggggggacaagatgaaaaaggaaggggataggaatggggaaagaaaaggatatatacaggaacagttaggttaagagagcccaagtttgaaagttagcttagttgtgagtaacaacactactttgttgtggcttgcagtatttgtactcctctgttcaaagcactctaaatagcttcctggcttagaataaaagacaatgtcatttcaatagacaccatggctctgtgtttctgctccccttgcttgtcagatcttatctcctacactctcatagcccacaccagtcctctcacaatgacattttcctcggtaatatttgtgtgatctcacctcagagacctttcccttgctgttttctcttgttttgcctcggatatttacatgtgtcactcctttgcctcctttagatttttgctcaaatatcagcttcttacaaagattttcctaaacatttaattggatcttatttaccccttgacaacttcttccagctctctccacctactactcttatattttattatatatgtttattgtctgcatcccctcattagaatgttcatgaggacaggaattggcatcattttgttcataagtggtttgcctagaactgtgcctggcctatagaattactttaacgcaatttttgtaattattgaacacaaaaactattaataattttttaaactgactacataatttgattagtgaatcactttttatagtccaagaactctacccagaaagcgtcacttggcctgaaaagacaggaagaacagaggagtctgggcctcagaaagagaacctgaagacttaggtcagttctttccagagtgttttgtagcactggtctccacatacttcttgttcatattcctcctaggtgacttttgaaaaaacagatacttctcatgtatttttttattgacatctaatattattttcctaagttttaactagttgcaaagatgcattttagctattgagatttgaaagtaaaatggttacatcacctctttaaataggtccatggaatatacaatctgatactcaatatctttcactgaaaaatatgaaagcactgccttctttaatagaaatgctatgatatttctttttctccttgaatcattttccatgacacttttccccacagaattttatcttcatgtagtatgttcatttgctggaaaatcatttactaattatgatttcatattacatggtatattagactgtcctcatattgctacaaagaactacctgagattgggtaatttataaagaaaagaggtttaattggctaacagttctgcaggctgtacaggaagcatggctgcagaggctcaggaaacttacaatcatggtggaaggcggagaggaaggaggcatattttacatagccagagcaagaggaagagagtgaagggggagatgctacacacttttaaacaaccagatctgagaactcactcactatcacaagaacagcaaggaagaaactcgccccatgatcaaatcacttcccaccaagcccctcttccaacactggggattatattcgacaggagatttggatggggcacaaatccaaaccataatcacatgggaagtgggaaaatgtaggttttttgagactgagaatcttatcactaaaattatattagtacagacttgatttaaacaatataaatgtattatataatgtgaaaagtatttattggaaatgcatctgttaatcagatggatgaggctatttttttttctaataattcatgtacttggaagatcatcacttgttgctggaatggaacagagggttcagtatgctgcttatttttttttcatttttctaattaagaactgagaaatttgctcacataataagaatatggaaattttaattcctggaaattcttccaagctacaaaaagaatatacagtgccatactaaatcatcaaaaatggtttcccataacctgtcagctgaaactctattaggtatatcttcaattatgttgaaaacaaaaagaattgaaaaccaccttagtttcagaagaatctgatactcaaacctaaaagctattcactgttttctacaccaagaccaatttccatttgtttgtttagtgccctggagcgtttttgttgttgttttccaaggagtaatgtaccaataatatgattaaggttgctcagtatgtggatttttttctcttttataaagagataagagtgattataatgggtgggggaggagaacttaaatctcatcaaatctttctgaagcagattttaggaaactatacacatacaggttttgtagatatttaggttgattccttaaaaatatccttctacttgcatacccttgtttgaagcttgtactttaaaacaagcaaataaaaataaccaatcctataaataagtgtcctaaaatgtgtaccaaaaagatatgtttgagaaatgctacttttgcttttctccttaaaaaactcacaatgttcactgttggcatataatgaacatatgggtgttctttggtaaagaaacctgtttggcttgtttaacacaggctttctaaatcaaatttgaacacaggacacttttctcttgtgacattatttgacaacccacagtactagtattccattggtacacatgtagcactatactagatgtggctactgaaaagaatggcgatatataaaataggaactccgaagaaaagtggctttagaaaataagggctcaatgacactggttgctgaagtcataggaaagtgaattttgctaactatggaatctgagagagtagagagggacccaggggctgagcaggatgttgcacatttagaacagaaagagggctagttgaagaaatatgggggaagggagaagactcaatgttgccaccaagctattatataagagactttgacaagacgatctaacatctaggatatttcatacatattcaacagataagctgctgctgagaatattctttcattttgaagctgggggcggatggggagcctagacaaaaaataactctgcatctccagagatcaagggagttaagaaaattcattcagtctcaaatggtgctagatggaaaaatggtaatttagaggaggagaaaaaggatagcatggcccaaaatataagaatatgtgaaaaactgacctgcctggagaaaatgggtacaaagtccagatgagagcaatgaatctttaaattgatgcagatgaattaatatgtgaatgagggaaatttaacttgttttgtttttcgtatacagacagctttctctctgagataccctagcactataatcaaattttgtgtgctcaatgcagtgcatatattttggggaaaaaaggtgacataagagaagtgaaagacgacagtcaagctttaagcaggaggtggaatctttactgagcctctaaaggacacagaagtcacctaagatacagagctgataataaggtgtgtccagaaggtgtctctcttgaaaggctttctataatgtacctgttctcttctcagtacccacagtgtaatttttaaaggtttagaaacatcatagaaaaaattacaaagataagtaaaggagaaaaactgaacagcatagacaacaaccacagtgaaaaaatacaatttttgtctatatagtccctgtaatatttagatcagcatccttcttagagttctctgaacatacatttgacaggactggactgggtctgaacacattgtaagctgggagctgatactggatgtcactgaattgactcctcaatcaaacctacattttcaggatacctttgtaatatgtatcccctttgtacatagtacgttgtactatggtcagtccatagcattactaaagaatgcaactaccagcaaagatttaaatatggaatccaagagacagattatatttggctttaatatcagttactatgacaacaaatgggttatttaaagtggttagcattctagcccactgagttaataatatggacaagaatggcataaaagttgagcaaaagcaaattacctcaatgtcatatcacatagcaatgacaatgaaagctgtgtaggcttaagagggttcagagggtttggaaaaacatcgttaggaaggacaaatccatcaaaaaatataaacagttttatttataactagcagcacatttttgatgcctcctcaatatcatgttcttcaggctttttaaaattcaagccttcagatttaaaacaaaacaaaacaaaaagccaaattggaacagaaattggcatttagctagaatcttttacaactgcatgatctccatttactaattatcccctttccatctcaagcacatggtcaagagtgaaatgtgaaattagatcttggatatccagaagattttaacaaggaaaaaggtaatgcaataagtaagtaaggatcaagttttataagctgctgtttgaaagattcatctgctaaaagcagcaaagaatggcatatcataagatgttaaagcagatggcctaagtcacagtgctacattacacaagtatgaagactagaactgaaatagcctaagtaatatttttattaacaagatgccaagtacagcagcaaaaatacctttaggaagaaatctcacttcaagaaaggtttttcctctttacactttatgctattttctgaattactcttgttctgttgcatatgtttaagtgtctgggtgctcaccatgcccagatgaaagaagctaacctctttccttaaatgagggcctccttgtcttatgagcccacctgtgtgatggagataaatgagtgtaaactaaaccagcaacctaggaaagagtgcactatactgtatagtcttgcagataattttttgcacagtaaacaaggagagtgggggactcattggtctttgaattagttataaagaaagcaacactcattaagtctgtgatgacactaaatgttgctagagtgatcttaagattataaaggtaatgccaggtagtcacttccagaatccagacacacagtagtggctgtaaacagggagctgtgattacccacagacatttcaactacaaaaccaggctacgacaagcagatcagagagctgacactcagaaatgcaaaagactttttcaaatcagaaagaacaggctaaggctgaacaaatggattcacctatatagccctatcaatacatattgttcactaatatatgtgtattcattcatctatggattatatttagggaccactgtgggaatggtgtagtggttaaaagcatggaatttcaaatcagacaaccttgttttgaattttcagctcctccactctggatgagttaacatgacttaatcttggctttatttgtatttttctcacaaggctgtcccaaatatcaaatgtgtttaaagcccttagatcagcgactgacacaaaatttacaccatacactgtttgatgttattattaaatagtatgtgcattgtaaaatacatataaaatagaaaaatgatgcaaataggcaccagtggaaattctgatgtttttctcccttactccatgaatttgcttgggcaacaccatctaggccatcaatctgaagaatagaagttcaatagggaaagttttgagcaaagtacagtcaaaagacaaagatggcagaccttattcaaatacagaacaggaaagttaagaccaaaaggtcataatatttggcctgacaggccctggtatcttggacttcactttcatggagatgaagagcatagatttgaaagcttaatatcattatatgtgaatcctatatctatctctctttatgaaaatttggctttctttacagctttctaacaaggaaaaaatgtcatagccaaagaatgatactacctctttggcaggtaaatgtatcataatacataaattaatcatcattctgcttataaacttaacattattgtgagttttttcagcatgagtcagcctcccaagttcattgcaaagtgtgagttttagggcctatcgggctgtggggtagatcctgcacaaaggcaaatttagcagggtaattcttgcctttgcctgcctgccagtctggctgtattgtcctggtgacatccggcttctaagatgctactactttaagttttctaagttcaatctggcactgcatagttgggtcaataaattggaaatttctcctttatgttttcatgtctcacaatcttaagaacgtggatttagttaggcacgtggattcaaattataaattgttattttgtttccaccacccccaccactgccacccatcctccatccccaaaagccttatgatctcatcacctaagaaaagtattcaggacacaactaaatagtaatatgaagccatatttttcaagcttctcttagaaaatatgtgatttatattttctggctgaaggactgtcttttgaattagaaaagtctttgatctactactagttttttagtgtttcagtggagtcctcattaaaaaactgttatagggtagtacaactgatgatgttctttattttctgaccattactgtgattgtcatacatgcaaagagctagaaagttccaatagattaatctgcattggactttcttaggccaactctcaggcttcattccatggtggtgatcacatctgaatagcaaaagcatcacatttgcttgcatttggcagaagatgatttgccttgacaaatattcacttataagtcaacatttttagccattctttatatcaaaatgaaaaattaatttattaattttatcctaatttttaccatttgtcatttacaatttttaccattttcataaagaaaaataacaattgaactctaagttcaaaaactccaacaagcaccaaccaacctgtgaccacacttacatctatggagcagtacaagctttcaaagtcatgttccattttgtaacaggtttagccaaaatgatgatattcaaaccactttttatatcacagaatttaccccattaccatttctcgaacccatgaagaaagttaaagctatttaagtcagcgtgtccttgtgtaataatttaataactgcaattgttttcaagaagcagggaggcattagttttgaaatctgtcctatatttgtacttctgagacccatctataatgaactcactaataaatcacatactactgaaaatttcttcacaggtgtttctgctctaaaatctttggcaaatggaacatgtcattatagacatcatcagtaaaagataataaacaaaaaataatagagccaaactactaaaattcataattatttgctccaggtaggctaaaagtattgggttgactgcaatttttcaaccatttcttaaagcatatttttggaacacagtacaattagtcttctatggcattactcaaaaaggatacctttaaaaaagacagagtgaattggacatcgaaagtcttttttaaagggctgaactaagttttctacattccaagtcttaccttctaaggaagtgtcaaataatttaaaatattttcttagtaattagggcttttcactctgttgactctagtcaatatatttcacttcagttttaaaaaatatttgtgatttttttctttaaaaattttatgattttatttttattttattttatttttattgtggaatacatatgcagaatgtgcaggtttgttacataggtatacacgtgccatggtagtatacacgtgccatggtagtatacacttgccatgggtaaatgacccatcaactcgtcatttacattaggtatttctcctaatgctattccacccctagcctcccatccccagacaggcccccatgtgtgatgttcccctccctgtgtcagtgttttctcattgttcaactcccacttatgtgtgagaacatgattttattttttaatgttgctgtaaaaaggtacctatgttcagtgttatgctggtaaatgtttaacaagtagctctctaaacaaatgaaaccaagcaaaacaaaaagcttcgatttgtagcatttgccaatttctatgatgaaatattctcaacagggcagttttcaaattaccactataatggcattgaatgcagagttaggaagagatgcactgtacatcattacatagcatttccatcatatggattcagtagacataaataatttcaaaagcatttgtaatacagtaaaagaattatgaagtgattagttttgagtatgtattacatttggttttaatatatttaattgtaacaccgtgtcatttaatttgtaatggtcattgtgtttaagaataatctttcacaggccatgaagagatggctctagcacatcactccctatgttataaagttaatcaagatttaataatatatgtatctccatgatagcaaaattcatattttaaatatccatataaaaacattctagagagttttcattagttggtctattttctattcatgatagtttgagtatgttactatcttatttgctttgaagttcatggagaagaccctaaatgtaatggcataaacctgacattattgtggaagccagtgtttaacttcgttttgggaatgcattaaaaaaaaaaaaaactcattagcttatcataggataaaattattttatttaaaaactgactagccaaatctgaaaactcctagaggaatcacaactccactgtaaggagtggtgacattactataatcttatctcacattagaggccttccatgttaataccaaataaactaatgcgcccaagttcccaataacacagaagtttaaaattttccaatcaagctctcttcagacctttaaaaagcaaatcacaaatcacaacacctaccacataagatatacagaaatcataatctctggcctccacaaatctttactactattattacaactaatgctattgattgcaaacactatgagcaaggcatgggtctaggattaaatgaggtcacataatcctcatatgttacctcatttaatcctcacagcaaaatagggaggtacctctcatcttcaatgtataggtggacaaagagatgtagtttaaatagactaagtaactagcccaaattatcgcagggataaagctggaacccaaacccaggtctgcttaactcccaagcccattctttattccagaacatttattatcatattatctctactcacctgtcctctgtctacccagtgttcaaactagaaaccccagacttatttaattttgtctagtccttcactccctacatatattcaatcactaaatcccataggctatacttccaaaataagtctcagacacgttcatctccactgccactaccctggtcaggccactgtcatatctgaccaatgtaactacgagtcttctacttcgtctccttctcttccatcttgccactattccctgcctcctcatgctcaatcattctttagcatgtagctagaataatcttcctaaaattaaaatctgattctgtcaatatcttaattaaaatatttcagagaggactcaactccaaagtccttatgtagattttcctcagctcttcaggatctgttccctataatctcttcagtctctggaattgtattttcccctcttagagtgactgatttctggttctctgaaggtgtcaagctctcaccacttagctttctaacaagtaattttctctgcctgaggtgctaatcttctgctcctactcttctccaacacttccagtgtaatttgattaattattcaactttcaacttcactctttatgcatagcctttttgggctctcaaagtctaggagaggtgctctgccttcatgttatccagaacatccccattcaaaacacttagcacactaattcataattttcctgttctctgaagtcagaaactatgtctgtcttatttttgtctatatacctaactttgaatatagtggcttacatggtaatggtaatcaataaacatttgttgaatgaattgatgagtttattcagaggattaatgagggatgattgcatgaagtacctggtaacactgtccttgttaagaatctaaccatgtctatagatacaaaggtggaaaagggaaatgacacagtaaaagctattttgacctctccactttgatctcaaaatatgattctttttttggtaaatacacagtttttaatcataattatatgaatgtggaaatattctaagtgaaaaaaaacagtctttaaaattaagatcacaaaggcaatttaatgacttggaaaggaaatgaaatgattttaaattccattaaaattcattttattgaatgtttttatatgtattcatcataactaatgttaatgacataaaaaatttgactcattgatttaattttgtccatatccaatttttaattgttatttatgtcattttttttcttttccagtcactgtgactgttgattcctaatttctcaggtcacgaatggcaaatagaaactttgtcacaataatttaatttttccattattttctggaaataatggtttaagtgtatgcatatctgaacaatatctgttttataggttacttctaatgaacacacacataccaatttgaaaatcccatagaaaacacaatcttcctcaattgtttttttcttctacaaattttaaacttaaattttgtccactgtttgctttgtgttatttgtactggtattatttattatgaatgatataaatgattaataatttgatttatttttctgaacaaaatataaagcacttaaaataatttcaagccctttagtaagtcaaagttatagtttctaggtgctcaacattagggtcaaaatgttatggtttgattaacaaacatttattggtagtactgagcaacgttctttctgcccttcccttgagttttaaacattattttgtttatgggcttaagtacctaacacaataggacaaaggctacaatctactcatgcagcctcaaaacatcttatttccttttcttcttttttttttttttgagacagagtttcgttcttgttgcccaggctggagtgcaatggtgccatctcggctcactgcaacctccgcctccctggttcaagccattctcctgtctcagcctcctgagtagctggggttacaggcatgtgccactgcacctggctaatttttttgtatttttagtagagacggggtttcaccatgttggccaggatggtctcgaactcctgacctcatgtgatccacccgcctcggcctcccaaagtgctgggattataggcatgagccagtgcgccaggcccttatttcctttttatatacaggcaaattcattataaaaataattttgaaaaatttattttaaaaagaatgatactaaaagaacaaatggctggattctactgactatttaaaaaacagaaaagacaggaatacaaacaatagtcaggactagaattcagacacattccatcctgaaactctataataatgagaaagcaaggtgccaaatgcctctaaactctccatttctgaaaacttgaagtgttttactgtcatatgtctagatgcaattctgatctctttggtgccaaaaccttataattatgtaacctttagaaacaaagatgcagtttgggttgcacagttatgtctaccctgtgatgatctgatgatactatgaaactctactgcaaactatgtctgaaacattctctgcattaatgaagcatgaattaattctatgagtagataaattattggcaatgttaatggaaatcagtgtttaaggataaatgctgccatatgcaatagaataatagcaaaatatgatttaaataaatatgctttactttttctgtaagcatattaacactttgggattataaagttttcacagagtactgtgaagtaaggctcactgtgagctaagtcctacttgttaatacctgggtaaaactgaggaggagaaaaaaatctctgtggattgaggaaggctccaatggtaggacttggcatttaagtacagtagttaggtttagctgagggatatagtttaggaaaatattctgtcatccttaagatcactgcctagtactatacgtagtaggacttcatgggcccttccctaagcatttttttttggtgaagctatgtcatatatgtattcttataaaagggaagctataggccctttgaaacgatccatggtcatcattaactatattcatttataccattctgtacgtgaagaacataaagtcagttactttctcatgtaccaatttccttatccaaaaagtaaaaagactagacaggacagttttcatagaatgagtgtataatttgtatttctaaatcagaggactttgtgtcttcattgaaaatttaggagaccataattaatcaaagaagcagtagtaataactcattctaatcagcaagtagcattttttatgaaaattcctgaaacatcataaataaccaggttctgaaaaaaattcaagtaattgcaaactatagaacataaatatgctttgttgatccttgcttcattaaagtatcagtaaagtatatgacagactctagaatttggtaagttctaggctcttactcagagcataatgttttttcagattttaacataaaaatttcaagtttgtgacatctttgtgagtactgagatgagaaaaattcagtagaaataagcaagtgatatagcatcatctatgtaggcacctttgagggtctgttttcatctatattcttagattctttcaacatatgacaaaagagactgatgaaataaagtctggaaaaacaccaatattttttccccttgcaacccattacatcagccagcatttccctgtagttgtgattattacattatgacttgattactaactattactgccacagttggaaaagtgaaagcacagcgtggagccatttccattaaaggaatatgaaattccataacaagctctgaggctgcacggctgctgtggggttgatctcagaagtgcataactatctacttaagatgctgtttgaaggagcaccctaacttacatcattatttcatttagtttgaactgtaccatggatttttccattaagcaataccagacacttaaacactgttatttgtgttccaaaaaaggtaatgtgattttttttctacctactttccagagtaccagaattttctactgcgtgtatgtgcaatcctgattgtgtctaatagaacaggatcaagcggttccataaactagagactgccagtcatcttgaagtggcataactgagaagagaagcgttaatattcatgtgggtaatatttgtatatgccatgtaagaactcggagagaaagtagtttcagttgctatgatttaacagaagaacataaaataaaaagacccaaatatattcaaaacatatagattaatgttaatggggaaaaggaatggtaataccactttacatctcttcttggtttatgtgtggctcaaatgacaaggtggcatgagatgaggaggtgatgtgaggaagctcttttacggtgtttttaggacaaaatacagtgatggaaaaatacaaaaacttcttaaatattttataggagagtaatcatcactgtaagaaaactacaaatacattttaatttatgcttggaataggctgtatgtaagcgtgcactgtttgtgtgtgtgtgtgggcacgtgagcacacatgtgaatatgctctcaaaataatagaaagacgtagaaatatatgtcttcatttgactttcaaaacaaaagaggcttgtttactcatgtgatttcctctaaccgcaatcctgcagggaaaatctatacttagcaggattgaagatgtccctagaagctttccagggaaagttaaaaggaagtcactcctcctcttctgtctgtttgccattttctttcctgtgtaggattactaactttagtcttgaatgcatatgctctgcagtagaaaatgcaaggttttagggttttattatcagagagaggaacttaaaaatggttccagacctccatatctgcaccccaaacctttcctgcccccaaagtcttagctctacctgcctttgcattagtgctgctccaatactagcaacagcttcaccttcgaattccttctttttatttttaatattttaagcacaattaattgaaaatccctaatgcaattctgtcctatttccccacaactaattttgaacagaaaatacctacaaaagtacagtgcgagcaagtctgttggccaactaagagtttgcatgtgttttttctttttgaaaaagatgaaaataaagttgaaatgtaaaaatctaaaatgtggttccaggttctttcgcaaatattcactctgcagcagagaatgagaattgcgtataagtagaaccctgggaaaaacagactgatttgaaagatgctgggagtgctcattgccctggaaggagtcatcaaacagcagtaggaatgataaaagtcagagttcccgtcccattcctgtggctggctctgcacctcctgaccttgaataagtcatttaagctacagagaccattcttttctccctttagacataaaacatcaataatgttagaaaatagctaaaaaactttaaaaacttataaataattttatcagtaaaattttgtttataaataatttctcaaatatcaaatattcattccttattttcttctggatttctaaaataattttctttctcaattgtggtgaccaaattccagaaaaactgttttaatctaggacttcacccttgacaagtcacagtatgctgaaaatcacttttaagttgatagtttgctattgtgtacaccccagttttgacactctagatattcataaacaacgttttgcttttcctttacatgctattatttcatgaaagtatcctcaagccaaaaccttgacaaagtcaaatgaaaatgcttagcattttttttctttagttaagtataaataagaaatacaacacattaagtgttaaaatgaaatttaagggaagacgagggaaaggaaacaactaatgaaagagcaattgttaatttcgttgagacctaactacctgcccaggccctttgctaggtgctttctatgggctgcctcacttaccatcacacaaccccacgagggaggcatcatgattatctctattgcacagatgaagaaactgaagtcaaagctaaaggtcttactgaaggtttcattgtgggtgaatggccaagctatctctgataccagttatgtcacaccagaagaaaggagagagaacaagatagaaatagagattaaaatcatggtcaagagaagaagaagatgggagggggagttgaaagacgaagggaaggaaaagttctcacctatcctctgcccttctaggatggacctgttcactcccttcacccactcttaaactcatatccagggttagaagcaatccccatatcagctgtactccactttttccctagtactccagttgggcttttaatgaagaagaaaagggaatacagataatttgactatagaaatatcttcaagttttttcccaaggaaaccatttgcaaaaattgacactttaaatattattggtaacaaatttcatgcacctcattccatagctattttcatcacaccagtgtgttttcacggggttaacctattaacacctttccatttttaaaaagtctatagaacaatatacatatgaggtaggtgtttgctaatcagttagcgaaatgccattaaattagcttagctgaaggtaattggttactataaaaaaatacaactccttagatgcagggaaatgcataggcctactttccacttaactaaggcagtgattttttactctaaggagcctgaagcaatctttggaggtatcccaggggatgacgctggccacgggttggatctcttgaccccctttttagtccctgataagcagaacaactctgtccttctgacttatatactggattttgaataagattttggtggaacaaagagttcagtttaaaaaatcttgcaaatcactgaggtaagggactttctatttttctcaagcataattttgaacataaaatcaactcataattgttacttaaagccatcttcaaaattcgtgtcaaattatattctgatattattaatgaagccaggatgacagtggaatctttcagtaaaaccatatgataatatttgaataacaatattttagtggttcagtccagctcttttgctcaagtatactgaggcaaggaaaagtcagagcaaactcacaatgtttgaaaagcttaatggtgctttaacgaaagataaaatagtcataagggattttttgaattataagatccttataacaagaagaaagtaaaaggaagctgatctgatttttccttcataaaatcatattaatggcctggtacattttgtcactttcagtatgtaaatattgattgtcttctcttacaatttattgttatcattcacactttcaaggtgaaacctttgccttattaaaatttatatttattttcaaacatttagagagagatttttcctgtccataaaaactttgaatattaacatttttaaaaataatttcaaaagcctgtttgaatgtaaaggataatatagtgaagttcagttgtatgctccctatgcatgaagacctatgccagaccctggcaaaagtttagaaaaacaacaataataataaagaagaatttgtctccgatcatgaggaactttgagtttagctataaagattgacatatgaggaacttttatgtcaacataaatataagcacaagcaaccaaaagaaaggaaaatgagctcaaattgagtttcagataaattattctagaggctacactaagagtagggcttttatttttttaacggcttcactgcaatcactactgaaatttcattcataccatccaacctacccatttagagttttacaattcagtgtttaatatattcacgtggttgcgcaaccatcaccaaaatcagattttagaacattttggttccctctaaaagaaaccctgtagccattagttatcactcatcatctcttgccattgactctttccccaaccccaccagccctaaacgaccactatttactttatgtctgtatggattcacctattctggacattccatataaacagaagtatgcacgatgtttttttttatgactactttctttattaggataatgtttccaaggttcttcctttttgcgcatgtattattagttaatttatttttattgctgataacatttcattgcatagataggccacattttatttatccattcatcaactgacggatatttgggttgtttccactttttggtactatgagcactgttgtatgaacatttatgtgtacaagtttttgtgcgaaggtatgtttttatttctcaagtgtacgctaaggagtaaaactgctgggtcatattgtaactatgtttagctttttgaggaattctcaaatagttcttcaaggtggctgcatcattttttattactactggcaatgtataaggataccaattccccagcacttgttattgaccttatttttgttcataggcattttagtgaatataaagtggtgtctccttgtaggtttaatttgcatttccctaatgactaaagatgttgagcatgtattttacgcacttattgaacacttgcatatcttctttggggaaatctctattcagatcctttgcccattttaaaattgcattatttttctactattgagttgtaagagttctttataaactctctatacaagttcctgatcagatatatgatttacaaataccttctcccattctgtgaggtgttgcttcactttcttaatggtcccatttgcagcacaagcgtttctaattttgatttagtacaatttatctacttttgttgtgattattgcttgtgcttttggtgccatattaagaaatcacctcagcttaggtttgaatgatgagtaagaaggaacaaatcaagaatagtggaaccttattccagacagacgttagcgaacaagcaatgtcatgtaaacatgatatactgtgaattcctcttttgttagcttagaacagggtagagtcccacagagccatacctaacaactttggcataccattatatagattttctaatgtacgatgtggttcccagatggatattattcacactatgctattgctagttacaggttaagctcagttgaaagagtatatgtgctgaaagaaggccaatgtaatataaacatttaaaaaatatttatatttctttaaataattaaaataacaattacacaattaaaatatttatgcctctcatgtggaggccctaaggcaaagtccagtttaaatattttagttactatcctagatttaaactaaatctagataactgtcaaatatacctaaaaagctttatgtaatactataattccatgaaaaaagggggaaacatttaataatattgctaactatagcactcatgttaatattttttgctttagacaaatatttccagtttcatttttaaacatgaagtgttttgcttagtttttttagagtttagtacattgaactgaagcagagaagcgcccgatcatcttatcttacaggagagaaatacttcacttctgcatgagagcagcctgcgtaatgtaatgagccaaggtctaagagttgacacacagttcctgttcttccctgcattaactttgtgtcctctgaaacatcacttgccatctctacattcccattgtctcaagcgaaaaattcaagggtttgactagacagtcttttcaactgtgactttcctggatgaagtggccaagcagaaactactggtgaagccagtgataaacacctctgtcaaggcagtgtagacatgcagtggtagtagtttgtcacctatatgattttatttgagagtgccagttcagtctgtcagaagtatcttccagctattcatctcttaattaaacataatcaggcattggtttaaaaatgcataacactaccagagtccaaattataagttctaatccagtctatgaggtgaaagggaacctccttagatgaatgaggaaactaagtcttggaaatgataaattgattaaaaaacatgctactatttagccgtaatccctggtatctctccagattacttatcagaaaggaaataaatacttgtgcaaataccttattcttaaatctaaaatccagaaaaatgtgtatcaggcaataatagattaatatattaaggtggtcagataaaccaccaaatgttgatggaggtgttttgtttaattgagtaaaccacctttataaaaatgggtcatttttatttattctaagtaaaaagagataatgggtcatactataattccattttgtctccaatggaagttatctctgataaaaaaaattccaattaaaaaagacactagcaaagaaacaaattgtaattctgtaattgccaatgtctctgccaattaatacgtgatgactattctgtgccccagaaatgtgttatttggagtggtcaatgagtttggtcaacttggtctgaagtacacatcttttgttcttcctctgaattacaacagcaatttattttttcagctttcatcacgctcctcaatatcttcttctgactagagtctaagctccttgatattccctactagtttattttccattcatttctcttacaaatatatatttagcagtcctaggttactgtgtggagtacaaagtcagaaatccaagactaaaataccataccacaccactaccagcctgggaattctcttttctaggaacagggcctgaccacggcggacagggcagtggactcaaatctacaagggacagcgaagctctgagccataaagctcttatgaaggatcaggctgaagccattctctcagtgcctttgcctgagctcacacccttgttttgcttccttccctgctccatcctgctttcttcagaccctgccaatctcctgtgagcacttcccttaacaaatctctttcatgttaatcctcatctcagaaactgtttccaggaaacctgacctaagacttgcttatagaagataaacaattaaaaacatatatgcaatgtggataaacagtgaacaagacatccttctatttttcaagggaggcaggcttaaataattaattgcacatttagaccatttttatcaccttgatttaactagcaatgctctagcagatattccctaaatatgtgttgagtgaacaattataaatattaaattaagcaacaaatataaaatacatatattcattgtctaattcttatgcatttgattggacaatattgaccagagaaggacttcagagaagaaatttatttaattgaagatggaaagtaaaacagggttaatattaactatgagaaattgaaagcatcagttggggaaaagcatataggtcacttggacctaatctaccaaaactatgaaatgtttctccaaccaaaatgatagggctaagaaatacagtgggagttggactgagatgaattaaaatctcaggaaggctaaattgttcatgcatttctcttgaatgtcttggtaacaggactgaaacttgagagtacttactgacaattgcccaaccccgccagtttcctggaaatgctgatggctaggaacctcaccctaagtaagaatttctttaccatcattctgctctatgacaaagtgagcccagagatgaagaggaagcaaaaaacaggcaagggattccaggcatcagccagcagaggggaaaaagagttagggagggaaagcccaagtagctatagaggggagtaaaggatggaaaagagaaagaaaaacctctgaggtttaaaatttccatggctgcaagaatggatacacaattcaagttgaatgatgaagagtcaagataaataaataaattaattaaataaaaataaacgaatgaacacacaaaaaaatcagaaaagttactgcaataacagggatcaaattcaatacataaagtaagagtagtaaaaaggttactcttggagaatattttaaatttttttcaattttatttttaaattgacaaataataattttacatagtcatggggtccacaacgagattctgatacatacaatgtatagtgatcagatcagggtcatgaagccagaactcagactgtgaagctggctacagctctgggaaacactgccccctagaggtcctctgtgttttcagcgagaccagctttcaccataaactgtcaggagccaagccacagactcaggcacccgggatccccaggcagagacctcaaaccgggtccaaaattatggtccagtcatctaaagacctgtgttaagtatcagggcttagtgaaggatgtcagattagaatgagattatttttctttttctagtcctcaccaacctctcagtacttaaaaactgagtactattcaatttttaaatttaaggtatggaatagataatatacgcatatgacacacaattcaaaagaaacaagaaatgtatataataaaaagtaagtatctttcctcctcatcccctgtcccctacattattattagctttttgtatgttctttcaggattattccatgaatttttcatacacatgccagcactgtgtttccacttgccttgtcattttcccttctaatttaataatatatcttggggaaagtttgacatcagaatatataggaaggctttattatttttaaaaactgcatagtattctgctttttgattgatttatgtatctaattccctaaagtttgacaattaggttgctagtatataatgttgcaatgaaaacccttgttatacatgtacatagtataaatgacagtatacacatatatacatatgcaagtatgaatacactgaaatgaaattgtggtcaaaatctaggtgcattagtcttaatcgatatttccaaattgattaaaaatgtgtgcttccatcagcaaattttgagggtatgcatactgatagagtatattatcaattacttttttctctacaatgtaacatttttaagtctctattttccatttttatcaggcttattaataagtgttagattaagctagttttggtctaagagacacttgagtgtgtgtatttctgcctattcacattcttagaccatgtttctcttgcactgtactttttcttataatatgctgtgcttttcttttgttgaaaacattatctctttttcttggatataagctgtaaatattttatatattcttttccagtttgacatttgcctttaatgtaattcaggattttccctagacatattttgcattattattactacttaatgtattcaaacatactagttatttatggcttcagagtttcccgtcatccttaaaaaggcttccctatcctgtgattttttttaaaaaaaaatcatgttttcctctagtattttcattccttttttatgtttaactctagatctcttccaaacagacaaacacacccacacacctacccattcccctacacacacactttttcttttttaaaaaattcaaatgatatgttgcccccgccatcccctaaatatggctttattagacaactggtcctggtatttaactgctcacaattaaaaggactagagatgggatctcactttattttccaggctccagtctggagtgcagtggcacaatcatagctctctatcacctcgaattcctggactcaggagatcctgcctcagcctcctagtttttgattttttttttttaatagatattgtcaggccaggcacatggctcacgcctataatcccatctgagcacttctgggaggccgaggtgggcagatcacctgaggtagagaattcaagactagcctgaccaacatggagaaaccccgtctctattaaaaatacaaaattatctgggcgtggtggtacatgcctgtaatcccagctactcgggacgctgaggcaggagaatcacttgcacccgggaggcagaggttgcggtgcgccgagatcgcaccattgcactccagcctgggcaacaaaagtgaaactccatctcaaaaaaaaaaaaaaaaaaaaaaaaaaaaaagagagattgtcagacatcgatctatctcattactcaaacaaaaaagcaagttaattcttgtgtacaattcattaaatattgtataacccacgttatagtggctgtagcaggaagttactacattcaaggttaaactttttataggtgttttactatgattaaaaatatgattttctagatatttagcttgcaatgttttaaaatgttttccagactaaatctccaactgtggagatttgtggagagctctatgggacaggattctggatgctctatcacctgttcatctgcatgctacagccaatccaatgctactttttcatgttcatcatattatactaaaaaattgtaaaccgactcaaaagtaaaaaaatggtttagtaaggccatatatacttatcacacagcttcaacaaatgataatttgccatttatagttcccctatcctccctctcacctttaaataatttatttttattttattggtcttaaattcaagacatatcatattctctgtaaatacttcagtatgaatctctaacaaacacattttttaaaaccaccataatccatttttaaaccttgtaatataaacaaaataatataatatataaggtatatatgatataataaaatatataattaatatattatatatggtatataatatataataaaatatataattaatataatataaaattaacaagctgtgttcaattaatataatataaaataaaatataattaaatatgctatgaaataataatttaatgtaatatgaaataaccaatatagtttaatataaccaagttgtgttcctctattgtctcaaaatatctttttaagtatttttttttcaattagaatctggacaaggtctatccattgcataaggatgacatgaccattaagtatcttaattaatctataaaattcacccctctccccccatcccatgtcagctattaggtgatttgccttatagattttcatacattatgtattttagtgattatattttgatgccaattaatacatttctctatccaggtattttccagaatttgtaattcattctagaggcttaattgtgtttatttccatttttaaaatgtatttgataacagagcatgaataaatcatggatagcactgttagtgcttagtgcttatcaagaggcacgtagaggtatatactgtctggttgcaccattcttaggttaggacttatcagagaatctaggtattgtcatactgatccatccatttttaatttcctcaacatatttcaactaatgattttagcagtcattgatgatcacggcataaatccattattttttaggtgttgtaaaatgctgatttttgaattctgtaatttcttcagtatgtattaattgaaattcatctgtaaagaagacactttcggctaggcacagtgactcatgcctgtaatcccagcactttgggagaccgaggtgagccgatcacctgaggtcggaagctcgagaccaacctggccaacatggtgaaactccatctctactaaaaatacaaaaattagtcgggtgtggcggcgcgcctgttgtcccagctactcgggaggctgaggcacaagaatcgcttgaacccgggaggcggaggttgcagagccaagatcgcaccactgaactccagcctgggctgcagagctccgtctcgggaaaaaaaaaaaaaaaaagacactttcttcaacaattatttggataccttgaaatgatgtttgtatagaaaagtcaggaaaatgctagactctttattatcatttttctgaaaaacgaatatatgcataagcattctaaatgtggccattcattctttttgttgttgttgttgttttcatgggctggtgttattatatactaatagatactgatatatttgacattaatgcagtcacttgaggttcatgcaactttccatggaataatactaaataaatagttgacctgaagagctagaaattcccacttaaatgttcatggacagatgtttacaaaaattcaaacagggtagggtgtggtggctcacgcctgtaatcccagcactttgggaggctgaggcagacagttcacgaggtcaggagattgagaccatcctggctaacacggtgaaaccccgtctctattaaaaataaacacacacacacacacacacacaaattagccgggtgtggcggcaggcgccggtagtcccagctattcgggaggctgaggcaggagaatggagtgaaccagggaggtggagcttcagtgagccgagatagggccactgcactccagcctgggtgacagagcaagaatgtgtctcaaaaaaaaaaacaaaaaacaaaaaacaaaaaacaggtaatcagttctatacaacctgtcatctttttaaaaatgtaaaatacatgtgaatattaagaatggactagctgggtgtggtggcttgtgcctgtaatcccagctactcaggaggctaaggttaggaggattgcttgagcccaggagttgaggctgcaatgagctatgatcatgccaccgcactccagcctgagcgacagagaaaagatcctgtctttaataaataaataaataacatacattttttaaatggaaaggcagtgaaaatgtctattgttcaaatgtacactccaaaaatctctttagtgatgaagtcatcacatatcaaaggtctttgttacattattatgcttatggctattaattttgggcaaatattgaatgcttattttaaatgtatagattgtggtaacagagaaaggaaggagaagtgagggttagggaaagaaatagaaagcaaaagagaggaaaacatattgagggaaagggcaataagttggtagatgagggcaaaagttcacaaagaatgaatggaatttcaatcagtcctctaccttcaagaaaagtaaattaaaatgagatttggaaagggatagcatgaatactggtatgctcttctgagaagatgcttcactcaactctattttttgctatttaatgcaataaaatttaaaattttaatatttggtgatacggtacactttgtgtgtgttttgcatgtcacctagaacataaccttatacatatgtatacttcatgcatctacagtgcagttaggaagaaacattacatgaataccattttgttacatttgatgcaagttacaaaagcaaccaggtaaactgtaaataaaattccaaagagagaaacaattatgcattctgccataaatttaaatctttttgatgctcggtgcttgtcattgtcaaattctcaaaccccattttcaggagactatacttttgtttttgctttgtcttttaagaaatgatgataatcctgtagtgctatttttaaaaaataataacaaaaattaaccaccagctttcctttctatagtcgttttaataaataaacagcaagacagtggaaaagtcctggagttagttacattggctgtgcttttgatgggtgacgataataaaatctgaacaagtcaagtaagatcatttcaatctacaaagctggaaagtatgcaaatcctaaaaaggggacaaagtgtataaacgtgtgaagacatagagcagtagagtggaagcagcttgaagtcagcactttggtagcctctgtccccaacaatctaggtggccttggtcttgtcacttaatttttctagccttagtctgcatattcatgaaatgcaaaggaacaaataaggtaaaataaaagtttcatcaaaattttgtttttctaataaaatataagaagaagcacccatcccaaataacttaaaagagactatcctcagagagggcagttatgattaattaagtagaatttggaatagagacatgcaaagtcagcttaatgaagccaaattgttaacacatctctgggacttgagtgtaatgtgactgaatgtattaatattaatatggctaaagaaagaatgtgtcaatcaaaacagtaattggtcagccctgagaatggaaaaacaaacttgtgggtggacagcttggcaagtagtacctatttgagaactgtgtgagagagaaactctttgccattggactcaagcccatggtttcctactccatagtaggtaagatggccttcaggtaccccagccgaaagtttttgcttgtcaacctgatactatttggtttcttggttgacttgcatgcattctcattatttctcaaacataatgagaaatgtccccaacctgatttttggatcatttgtacatgtgtcagcctttatgagtctggaaaatgcaaacccatctctaatctactccattatactaacaaaaccatatttatgaacttgtaaaatgaatattagaacctggagtggccttattttaccaaggttaatgctctcctgtggtaagaaactgcctaagaagcaagccagcattacccagatgatatatctttgactgtctgcctgtacctaggcagctactgacttagcttatcggtatgtctaatagtatattaaatatagtttttagtttaatccatgaacataccaaatctctacagaggtggactagaatgcttagcaatgttcagactgctaaacataatgttacagagtgccatcacaatattggaacatttaccaactctattaactaacatattggccaagtcaatatgttgctctccagagaggggatccaaagatatattagagaagtttatacttcatagaatgtatgacttacggatcacccatgcatcctatttcatgcatccaaattctctctgcctctaaaggaattaaatttacccttgggctttctgttttgtgccagagacaatgttccctcaaagccttctagcaaaattaactatggctagttgtcagtatgaagttgaatgttttagcatacactttttgtaactctgttttattttctactaaattgattttttttccttttctaacaaaaaaagctttcatcatctctgtattattaagacacaggattataactttttagtttggtgtaagcaataaatcataagcagtaaatttagagatattgtctaaaaatttattactttgtgaatatgttccaatgacttgagatcccaatgtttcaccattacatctgtactttaaactgtgtgctgttgtcaaaagtaatgtagagggtttaaagctagaattttctctgactgaagggctttaatagcttcatattattgagtcccatttcccaagtgtctttaagtccaagctgggtagtaaaataagaagacaaattaagtcttctaagccatcaagggagcatttaatacattcctacaggcattgaggtatatggcttccaacagtacctcacggacataagtaaatcggaagatttccttattaaatgcttaattcttagaggtaaatagcagaagcacaggcaaatacaattcagtattttccaaaagcagcataattaattaaaatactaaattaaccaaattcacaggactagaaagtggagacattagattttaaaaccatgccatttgactgaaaagtaataatgcctgtcatattcactcattaaataaatatttgagacctactacgtgtgaagcttttatgtttagggtcctatattgtgtgtctgtgtgtgtgtgtgtgtttgcattgtgtgtgtgatatatatataacttttaattctttttaatttttatggatacctaatacttttacgtatttgtggagtacatgtgatgttttgatacaagcatacagtatgtaataatcaaagctgagtaattggaagtaacaatcacctcatttatcatttatttaagttaggaacattcccaatctacggtttgaattgttttgaaatgtagaaaaatttattgtgaacaatagtcaccctattgtgctaccaaacattagatcttattccttctatcaaactgtatgttttacacactaaccaaaccctctttatcccaccttccctattccccttcccaccctctggtaacctccattctattcactgcttccatgagattagtttatttgtagctcttacatgttagtgagaacatgtaacatctgtctttctgtgcctgttttatttcacttagcataatgccctccagttccatccatggtgtagcaaatgatgtgacttcattcttttttgtgtggtggaataacattccattgtgtgtttatacactacatgtccattatccattcatccaccggaggacatttcggttgattctgtatcttggctattgtgaatggtgctgcaatagatcccatatattttaccctccagagcaggacactttttgaaatagagagagaatgctattgaaaagtatagtggaacaacagccacaaaccaggactatctcaggcatatcattatatatatatatatatatatacatatatatatgtatatatatatatactttactatgatagaaaatgagaatgcaacatgaagtccctgttctctaagaatttgtagttcactgaaagacagaaaatttgaaaataatttgattattctcttttataattctacgataatcattattatccagagttttaagtctttccttgtgtgactttatttgatcattaaataactgtactatatacttactgtaactattcttatgttacacaagaggaaaacaagtaaaagagaggttaaataaattaactaaattcacagggctagaaagtggagacagtagaatttaaaaccatgctgtttgactccaaagcctataatctcattcactcccccaaacagcgtcctgtgatatatgccaagccttttaaaccaaccaaagcttttgggaagaggtgacaaataaggtgtttacttagttagcaaagaggaaggggtgggaacaagtagaagggaccacaaatatagtcagtaggaaaagcactgtcgcttccttcaatattaatgatgcataccagtcatatttatcatgttccacttattaatattttatcaacaaatagttgaaaaatatgaattatatatttatggtgtacaatgtgatgttttgatatatgtatacattgtaaagtggttaaatcaagttaattactatatccatagcttcacatagttttcatataagatctacctccttagcaattttcaagtatacaacatattattattaactatagtcacaatgctgtacaatagaccctttaaaggtagccttagaatttgttcagtaaaagtatggattatctaatttcaatgaataaataatatatgttacaggttgattatgtgcccctaaagcatacactgaagtcctaattcctagtacctcacaacgtgatgttactcggaaataaggtgttgcaggtataactagttgagatgaggatactggaatagagtgagcccttaatccaatccaccagtgtcgttacaagaagaggaaaaccccatgtgaagacaagcatgtgataacagaggcagagattggagtgatgaagctgaaagccatgggacacctaggattgccagctacccccagaagctgggaagaggcaaggaaggattctacccagaatctcagagggatgatggccctcctgacaccgtaatttcagaattctagcctccaaacggagagggaatacattcctgttttaagcactttctttgtgatactttcttatggaagcccaagggaagtaatacaaggcactatcacacaattcaggcacttgcccaattttggaatttgagaaccatttagactccacggatgttagcagatataaaatttacatatctcatgaaatatgtttacattcattctgtgcagtagcagacatcatgcttttgtgctatttcagaaaattcttttcaaaatgacctgtaagtttgactgactacagtacatcttcctgaagacatcacaaagagttattcaaaatggagagttgttctgattatgtatcgtatcaacacaaaaaattcacgtcaatttgataccatattgcagacccagatgcacaaaagttaatttttaaaaatacagaatttctatgaaatccaccagtgaaggcactaattaaccaaggatcatgttctgctcaagcttatccagcatcatttaatgatttctgccaaaggcgagtaagtaaacaagaaggggccaggttgtagaagataatgttttctcatgtaccacaagaagcagaaaaaggaagaaatcaatgtttgctgatggaaaaggataaaactgccaggaaaataaatgttatttttagtttttttgttaagaccttggcattaaaaggaagtcaaaataaaagattaacaattccttaaaaaaagaattgattgaatcattcttaataactgttttcttatttttcggttctggaaatacattttataggcactttccttgtgtagtataagttaactttttcagatcacagaaagattgttattccttactgattttgtttgaagcatcttgcagcttttcagaaaatggctgtgatgagcgtaatttagaataaatgtatcatgtttacaaccagcagttgtatagattattaattaccactgacggcatattccttagcatagaagcagataggcagtattttctatatttgtaagttattaaacttaagtctgaaacctcctttaaagtcattttaatgagtgtttcattagattagagatttgaaaactcaagtaaattaattgtcttaattggcatctttaatgtgctaaccaaaagtgaaaaggataaattgtgttcaataggaccacaagtagattgctactatatttatttcatgctacctttttaaaataataggggtggatataacaaataactcatactttctggacttacacacacacacacacacacacacacacacacacgcacacactctcatacttaaggcatatacataatacagactcatatactagatcaattaatttgattatcatttcatgattaaaaaagtctcttcaggctatgctgaagttggttaatctgaggaacaaaaacatattgtgaaatatctaccatttggtgatcttcctacttaaataatacatttctgaactatgtcaataagagtcttcaaataataaaaatacaaaatccaattcatcgatgttcatgtaactgttcagaatttccacattaaaaaaattacaactgttttccttaaaatgatatatttataactatgagcaatgcaatcaatagattttcaattctatgttgacagatggtatttctttcttcttgaaacgccctgataatcttcaaatacttatttcatatcaactcttgtagtaaaacaatggttctgaccttatccttctacctatataatatttttcattaaaatacatagatttcacagagagacatctaatttcaaattttcaactaagttgtatatctaattattttgattctgagttttcagatccattttctgagctcccacatgatccaattttgaccatcagaaaatgtgagtggcaaagttgttaggaccaaacaaatccttactttgcatttatatcataaatctctatcacacaaaattccttgtgcatgaacttgcaaacgtaaaatgcttagatttagttcaagtaaaagacattttttttaagagatgagaagaacaaacaaggaaaatatagccctatactgctatgctctgaatatgtgtccctccccagaattcattcatattttggaatcctaatccccagtaggatggtattagtagacggggcctatgggaggtgattaggtcacaagggtagagacctcatgaatgggattagtacccttaaaaaggagaccctagagagcttgtgcaccctttctgccatatgagattaaaataaaaaggagaacaagtatgagaaagcaagccctcatcatacatggaatctgcaggtgccttaatcttggatttctcagcccccaggactgtgaaaaataaatttctattgtttataagccacccagtttatgttattttgttatagcagtccagacagacttagaaatatattcatgctaattatgttacataaaggtcttaagaaataaaaacaaaatttcactaaacattataccctggctaatgacttatggcttttctttacaagtctataagaaaataaaagtacaataattctgaatcacagttaagcaacacaggtcagcagcaaagaagaagatactagggtcacatgtatggatacactcctcattgagcttgaaaattctataaaaaggagtttattttgggaaataatcccagggaaaccatgtagaggatttagaacagtgacacaaagaatgaaaaaaaaaaaacacaatataagaaagtgtgattcctctggtcattgcttagagtaacagactccattctactgtgaatctctgagaagacatgtagaatgtgcccagaactccctgaccaagggacaacaaagggagcatgtatcaactaaaacctacttttaattaaccaaacagaggcttttcaaacagcaattagtacttcgctgcagaaagcttagtcttgctccaaaatctaaagttctgtgctgtgattctcttctcaaacttactgaagaatctacacagcatctttatccaacatcaaagcagctagattgtattgcctgagcagtaaggcgattttcactgaaagctggacttgctgctgaacactttcttgctcttagccctactcgaaactgccagccttcaaaattaactgataaaatgacttggagaaatattttaaatgtagtatgtgcagcccatagaatccaaaggtctatcttattctgcaccccattcttagtgataggacttgtgaagagcaacaacttttaccaccttccgttatgcacacatcttactatggcatccacactactcgctgcttcctgttcactaggtaaaaaatgccatgatgtaatcaatgcaatggaccagtacagatgctccttaacttataatggggttatctcctgataaccccaacgcaacttgaaaatatcgtgagttgaaaatgcacttaatacatctaacctaccaaatgtcatagtgtagcctagcctatcttaaacatgcttagaacacttacattagcccacagttaggcaaaatcatctggatacacagtacgctgtagattatcagcattacgtggctgtctgagagctgaagctcgctgccactgcacctcatcacaagggaatatcgtactgcacatcactagcctgggaaacagtcaaatttcaaaattcaaagtaagatttctgctgaatgcttatgacttttgcaccattgtaaagttgaacaatcatgttaggagaccatcgtgtaatcatctctaggttaccaagacaatcaagttccttgtgcactgtaatattacagagagtgagcgttagccctgatctagggcagatatgtacatgtggattactgtctatcccacataagagcaaacttctaaattctctttcatgataagaattaaaaagcatgcatttgttagattactagctgcataccagctagtgccaggggtgtgattttgttccagtgaagataccacatctgatccagcagctgcgctgatttggttgtttaccataagctattatatatcataatccgcctgactttttagttgctttacatgtgaaatgaatagatgcatgatggagactatgactccttcactcttaaagctttgacggtagcatatagcctctgaagtttctcctgagaagcagtgttactgatgatttcatacatcggtttgggaagaacagttttataggattccactaggtcttttctactaaaatgattctgacttatttcacaggtcatataaccagtgtgaggatcctgcttgttgctaagtatgttggtcccaattatgtacttgggagtctggggaaataaccgtagatcaatccacttacccaggctagaactccatttatcgcttgtctttcataagcccccattagcattagaagtccattgatgtcagtgctagctcaggatctgtacctttaagagccctcaaaaggctttgctagttcactttttccagtgtaagctgctatgtaaaatggccataaatcctttgaaggaaggattgagacagcatttttgtgtaactttcagggatattgctaggtctttctttaagaaaacttggtttccctttcaaccagtaagagttggctccatgaagtagtttaaatttggaaactggatgaatgattgtgatcttccattatagcggaaaatgcctacttcctcaaggtgtcatttttgtctttttagataagtcaagtaccactctagtcagctacccttgtatttcatccctaaaaacactatgatatattatccattgtcataaacccttgttgataaacgaattctggttgctattctgaccttgttgctcttcacactattgatatctatattgagtctgttggtgaagtgttactactaaacttctgccatttctgaaaatggcagtcagaccattgagtttagagatccttgttctatggtagcatctcctactacaccctgggatacagaggacagtcaccctgagcttctcagagatgccagtgtccatctgactactgcatttctcacagtgaatgccttgggaaccctctaaaaatgagtctcatataataaatatgtgctaacattcccacctccctgagtcttctaagttttaatattctgtgaagatagctcctatatctctagctctcttactataagtcctcatgatgtttaaatttcaaagaactatcataacggcatattaggactagctccaggtattcttactcataattaacccaagtcatggaagagtactttattcttaaattagtcctagcccagtatcgtcacactctagacccacattacctctactcaaagtccaggagccaaatccaggcatagagaagagacaaatttcaatgggacaggcaagaatactccacctactttgttgagttaaatgtaagtatatagtgataagagtaatagcttataattattaagtttgtaaataaattattatttagtatcaacgactcaatcacaaatacgattatcatttactaagcatttatgttgtgcttggcactctgttaaatgatctaatattttttgagatagtatctggaatgaatgagatgttttagattgttcataaaattaaacaaaagatgaattctgagagaatagtagataggtaaatatgatgaacaaaaataacttttcttgagaattttaataaaatttctaaaaatctttggttgatgctgatacactgagagtaaaaagtattagcaatttaggagtatgttaaagtgttgaccccaaaaagcctttcttattctatataaaaatcaatggaaacaaaactatttgaagactataaggaagactgtaagtgtttcctcctaaacaagctatgctaatacatttattcatgtaaccatgaacttaataaagatgtacatcacctggagatgggactaagtacatgaggtagaggcagggattgtgaaagcagccattgatatggcaatctttttttttttttttttttttttgagacaggcttttgctctttcgcccaggcaagatcagggctcagtgcagccttgacctccccaggctcaagcaatcctcccacctcagcatcccgactagctggaactacaggcaaatgtcaccacacctggctaatttttttatttctttgtaaaaacaaggtttcgtcatgttgcccaggctggtctcgaactcctgagctcaagcaatctgctgacctcgggcctcccaaagtcctgggattacatgagtgagccactgcacccagctgatgtggaatttttttaaaaataaatgtttggatgcttatcctaaacattttccacatcttatccaaagattatttgaaaaagtattagttattttagttggaaactctctaacatgatatagcagacagattcagtctagatatgtttatcacagacgaaaaaaagcaaattatattaattttataaaacacaaaaaagaattaatataatatttgattatagtagaacctaaacctgcccacattaattggagataaatccaaaaatctagtatgtttcttattcaagtgcatgcactctcattttgtaaaaaatttaatagactaaatcagaaaaaagtataggaatatgaatcaagatatataaaatatctgcaaagaacaatacatgtagcactaatggtttcaaactgaagaactggctactaatgtttgctaagatttttatcatggtaagattaccatttgagaatctgcatagaagattaacaaggacaaaagcatcaataactctgcaacagccttggtagttaaaaatgcatttatacaacaatcaaatgactgaatacaattctattataaaattgaaaaatggcctagccaaatttttttatgcaaaaagcaaatgctcactaaggttaaggtgtaataaactactagacaattttaatgcttcctagtgttttggatttacataattatttttaaagagtggctttcaaaaatattttagtgatgaaaaatattattcaaatgaaatcttacccagaaagccagcatataaaaagaagaaaagcagagctgctttgattgatgcacattctttctttgttttatttttgaacggagaaggtcagtatcttccaaccttgcaaacaggcatacctatgtttattattaaaagaaattcaaagacccacacattatactggttacaattaaattgtattgctatctgagaagtctgaaatattaagagttcaaatgttcagtattcctactgagaacttccttttaaaaaccggtcatactttctacatatgacctcattgcaagaataaagcaatgtaactaaaatctcaacatttatttgggtggagaacatgaaaatcatattttctaattcatagggtagataaaaaatgtttgaggtcaactgaggaaatattttaaaacaactataaaggaatgacctgctcatttatatatcaaaatgtattataggccgggcgcagtggctcacaactgtaatcctagcactttgggaggctgaggtgggcgaatcacccgaggtcaggagtttgagaccagcctggcctacatggggaaactgggtctttattaaaaatacaaaaattattagggggtagtggtacgtgcctgtaatcccagctactcagtagactgaggtgggagaatcacttgaacccaagaggcggaggttgcagttagccgagattgtgccacttgcactcaagcctggacgacagagtgagactctgtctaaaaatatacatatatagatagatgataagatagatagatagatagatagatagatagatagatagatagatagatatagtaaagctgtagaagttaaaatggaattggtacagaaaagaataacagtaaggtgcagactaatgtaattttgctaatgctaaaaatatcattttgaagctgtgcagtggaatattgaccatcttgtttgtataagggcaagagggaaagagagagaagaaaaagacaaagagaacactagactaacacttcatactaaggacaaaatgatttcctgatgattaaattgtcaaatacataaatgactttaagctgttagaaaaaaaaatggatataaggagatcttgctaaagtagctacaaaactcagaagccaaaaacaattcatcttttaaaaacaaaaacttgagaacaaaagtatcttaaacaatcttaaaacacaagtaacacactgggaggtgcaattggcaacatgtttatcagcaattgaatttatttacgtagtatatttgtcgtcacaagtctacaagaagataagcagcaaactagtaagaaaagagaagataaacagcaaccagtaaatagagatgtacaagtgactgataaacatgtgggaaaatgttcaaattggctagtgatttaaaatgcaaatttaaactacaatagagtgtaatttactttcttgaatcaaattgacaaaaataaaaaaaatacactgccgttgagaaagcaagtaacaggtccctttcaactttggctaaataattccattttgaggaaggaaactatgctacagcaatgctaccatacatttcacaaagatgtacatacaggcaacacaaacatataccctacaagtattcattggattgtttataacagtgaccatctgtaagtaatttcatgatgaaggacacagcagcaattatacacatttgagagtactcacagcaaaactcagtgcacccatacaaagaactattcagcctgagtgaagacaatgatccaggccactggttcaaactttagtggacatcagattcacttggagggcttgctaaaacatgaattgctggccccaatgcaggggtttctaatgtgaagggatctgagaatcttcatttttaatcaattatctccagaaaccacatattaagaactaccagccttgacccatacttggtgttttggacacatggccaagtgaaaaattctagtcatagaataatacttttcattatctcacttattaaaaatggaacatgaacataaataattacatttaaggaaatgcaacgaacgagaactgaaaggtgatatgccaaactatttaatatctactgctgggaaggagggcaggtaggagtgagaagagaaacatttatgttaaatatcctactgtttaagtcatttacaagaagactatatttataatgtatttaaattattgacgtgacaattttgagagagaaagaagaaagaggaagggaggggaggagaggggagtggaggggagtgaagggaagggaaggggagtggaggggagtgaagggaaggggagtggaggggtgtgaagggaagggaagggaagggaaggggcagggaggttaggaggggggcagggaaggaaagaaaaagggtagctgaatcctgaagctgtagacatctagagtttgtactagattgttagatttactggcaaacccttactttctttctttcttacttcttcatgcatctttgtaataaaccctcattaaacgaggtagtctgaacatagttctattccttgcaagctaaaaaggctaattaacagagatgtaaaggctatgcagagcaataaaacacaacaaatactgaaattgatttaaatgcatgtaatttaaagcaggatataggaatgctaaaaccatttttaaaatctacttattttcatacctacacatccaaatctagatcttagagctgatggtcctaaattactgaaaaataataaagccaacatatgtttctattacatgctgacataatgcttatgtaccaagaatgtatagttgtatttgtatgtgtgtgtttgtatatatatgaatatgtgtatatatacacacacagaatatatgtgtgtatatatatccataatataaatttaactctcaaaaggattctatgatataagatagttattatcatccctaatatataaaaaagaaaactgaggcacagaaagctgggagattacggaacttttccaaggtcacactgttagtcctggtggagccagggttacatccagacaatctgattccagcatcatgctcttaaccattgcatcgtactgacctctccttcacttgtttcattttctttggatacatcaatactctcaggccactacccatcactaaacaatataccataaaaaaaattaaagaggctagaaaaaatgctgtttacaatacttttggaaataaacaatctttatgactcttactgctacaagaataggcagcagattaagaaatctgctgatgagtgaatgaggaacctctctcttccactgcatttccaactattattatactcagattagaccaagcgagaaagtcattccagctttctcatatcagccaagaaaaatcatcctcaggaccagctgccaacagcattgccctttagactttggccgggatgccagggcccaggtgttctgtcagctttccttatacagtttgttgacaatgaagaggcccacttaatttttctttttttttttttttttttgagacagagtctcgttctgtcgcccaggctggagtgcagtggcacgatctcggctcactgcaagctccgcctcccaggttcacgccattctcctgcctcagcctcctgagtagctgggactacaggcacccgcgaccacgtccggctaattttttttgcatttttagtagagacagggtttcaccacgttagccaggatggtctcgatctcctgacctcgtgatccgcccgccttggcctcctaaagtgctgggattacaggcgtgagccaccgcgcccagccgcccagttaatttttcaatgggcaatataagctgaaactgattcacctgcaaacaccttaattacttctaggaataaaaaaatattgataccaaaacaatacatttttcttaggatcaaaacaccttgaaatgtttccaaaaaatggaattgcttaggaaaaaaataaaaatgcatgatctactttgtttcagaacctaatctggtttgtctagaggtcaaagtttgtactcctgattgtgaatgataaaaagggaaaatgtatggataaaatgggaaatttctaatattaaggggacaggaggatggagagagaggcagcagagcaacacctggggtatgttagaaacagagataagaagttgcattttaaaatataatttggagttcagaaggtgtaaatttagtacactctttgtgggactaatgggaacctcaatgagtcttctcttgccataaactgcctctcataaagctcttcaaggcttcttttggatgtgtttagaccctcctgtttagatcccaacttttgattctgaaatttctattccatgtctacaaaacaaaaaatataatcaaattataacaacactatattttccttgagttaatattatcttgaattaagtctatcattgtttaaatttttggtaacattattttcactggacttcattgttttctgtataaattttaaaatgaaaatgtttcacatatccatttccttgtttcaatttttaacaattatcagtcatcagtctgtccttgtatgttgtcttttggaatcttttttttctatcaagcgtaattatcctggctcaaattgtgtttctctaaatttcattatgacaattttattctttaatccattttcagttaatagcaaatgttatactttgaaattttagttatcgtgagttttcctttttcaacatttttaataattattctttcagattacttttgttctttttcattttaccaacagcatgagttttattaaacatattttaccatttctgttttagccatagtcttatctatttaatgcttcattctgtgatgctttatatgcctatttttatcatttcagagtcaaaatggtaaataaaaagatacttaaggatccgtcagtaagagttaagaatggcagaagttaaaaacagggttaaaatggtgagttcataaaatctccacattacttttcgcttttccctctgtagctttgttagctggatttcttttttcctgtaacacaaatacttaaaatatgtaattttgtctactgagtgaaactatttttcctaccatagtgcttgtgttgattacaaatgtgaattttgagctagtaaggtcattgacaataagaattatcaattattgagtaaaacatcctcaatattctgcatctaaattagattgttgcatcatatatatataacctaaacatattatcttctatataactgtttcttttgttcctacaaattttttattcttttttttttggctgttgtttgtttgagaaagggtctctctctgttgcccagactggagtgtggtggtacaatcatgacaacctgcagccttgacctcctgggcttaagtgatcctcccacgtcagcctccagagtagctgagactacgggtgtgcaacaccaggcccagataattttttaatttttttttttttttgtagagacacagtctccttttgttgcccaggctggtcgccaacttctggcctcaaatgatccccttgcctcagcctcacaaagtgctgaggttgtaagcgtgagccaccacacctgggctttgcctttgcatattgtaattttagtgccctttaaaagtctccatttttattgcttctattaaattagtttaagaaagctgtggatgacgattctgaaggcctgagtgcatacagtatctgcaactgtttgtttttcaaggttttctatgaataaaatgacaaggagtaagaaaagtatgtgtgacctcatgcttcacattcttcagaacaaatacctctcggttgcaattatgtcatcatgaaatcatgttccacgttttaaaataaactcattgccatatgaattgttatcctactgagatatttttgtagttgtctgtttaacagcttccttagaagtgtcttctacatttcccacaataccaaaacaaaaatttcttttttcatcttatacaaaagaatagctcaagtttgaatgttccgaaatccacactcttgtcctgcgttgcacatatacttgcacttgagttacacacacacacacccacacccacccacacacacacacacacacacacacagttttagctaaatattctaaaatatacactttttgacttctgagaaaagtcagagaatgttttctccagtgtcacagttcgggactcacctgtggacgtggatgtcctgtgactagacaagtcaactcaagggtttctccttcccggatagtgtagaccctttcggagtagcgctcctcttcaatgttacaggccaagcctgagtgcacaatacgaaccgtgggaggagctgtcgagtcaggaagaagagagacaagatacatgaaaaggtaagtcagtgatcttctcatgaaccatcttgactataaaagcaattcttattagacttcaccatagtcagattagtcagattcatcagtcttaacacctccccaaggcattaaagattttgctggaagaaatcttcaaatttatctaacagtgaccaacacatttccaggggaacaaggtagtggaagaacctcaggaaatcaccatcaatacaagaccacaagataaaatttgattgttaaaatgtgagaaggtcccttcctttctgagttcaaattttaacatagtaaggaatattgcaccaaaaatatgtagtgcaaaagaaagaagacaattggaggagaaaagggaatttgaatggaagacattgacatttgtctgttaattatttaagtcatgtagcgcgcaagttaataagctcacgaataagatgatttggttttcaggaagtgaaaaccaacttaatttaccatacttatagacatctgtattgatgtaaacaaagtatgattcttgattaagccatggaagaagacaatataccattgtcgcctgagtctaaaattctgattcaaaagaaacttcattagcataaagctgcccaaatttctaaatataattttctcctacttcagtgccaaggggccagtaaaatttaactaacactccttgacttacacatcgttggggacaactacatggaaactttctgtgagtcatgagagaagtacttagctaataagatatgctgcttgccatcaagtaaattattgacagctactagcttcaaattggagatcaattccttttgtgaactaagcatttttgtttgtcatacatttgggagtgaaagagaatgatcatttcagttaaaggcaagtggaaaggttatatcttcatgtaaaggacagtgatctcaagaatttcctgatagatatcttcaacctaaacagtagtattactagcagaggttgtgattgcttaaaaattaacgccagtgccagcatattaggaatgttttatctaacattaaagacaatgaatcttatagaattttaaaataaatttggtgattctatggaagaaaaaaagattataaggccaactcatgaaaaaaatcattctgggaaaagctgtgttctgaaagtaaaatagaatagttttcaatatctactattttgttttatataacataaatgcacagtctacccatagagcttaataattgacatcaggttgtatttcattatctttctcaatttcaggcagaaactggaagatggaaaagaccgcttatgattaataaaacaactggttatgtccagctctttctaggtaccaaagcataatcctgttactcaaccttgaaactcagaaccctgctttccaatatccatcatcaaaatgatgggtaaaagtttccaatagtagaataagaacaaaacagtacttctagaaaagtggtcttgacattaaatacgcataataaacacccctcaagaacttgttaaaaatacaaatttcaaaggtgttcagagacctgatatatctgcaggaatccccaggaatctgcatttttaccaaacactcagatagctgcaatgacagagctagttagactaggttctgggtattatattcgttggctaaagaaaaatactccaaggaataaaatatccttttcctttgtctttttaaagtaactaaactttctgctatgcatcattttatctgatttgaaaaattaaatgatgcttaagtcaaatgtccagcttggtctataaaaccaatttattaaaaattttccatcatgtctctggactctgtctagacattgtaataattcgtttggttttatgacattagaaatccttatctttggtgtttctcttagtgctctgatatgtttcacaccacatttcctacaaatcatttcaggcagtgatcaaatttggacttcaatttagataagtaatactagtgaagtacttatttttaggcatctgtctaatatagtcatatccatattatagaggttaacgaattgatgaaaatctataaatgcttgcaaaataaaataaaataaatgttcaatagaaaatacagatctattatcttaaaatatatttccatgctaactttagcttcatatgtgatagtgatagcccacgtttattaatatatctaattatatagtgacatgacatcctttccagactaatttacacttgttatttttgttttaatttcaaatcaatgcttagtattgttatttttaaggtatatctttcaaaaacatcattatgcaaataagtagctttatttaaaccacttaaattatacagtaagcacactgtgacatttacaagggttaattttctgctatttttcttctatattataacacattcttggaaaaggtaattgcctgcatactgcagtcatcatgaacctaccacctatcctgtaggagggtggaatatttcatcaaattttaagtgtggaagttgtcttccttttagtattcatcaaaatatgtgctcaatattttagctgctcaacgataatgagagtattttggaagcttcccttaattcttttatgtgcacaaagctcacttgaaaggaccttagagttcatataggtcagcactcttatttcccgattaggaaagaaaagcctgaggacatcaaatgactttgtcacaatcctgtggctagttgtggctaaacgagaccaaagccactggcctattgttcttttcattacttgatgctgtctatttaaactatgtctgtcatagttaaattagtgttctaaataactcccaaactagacccagacctagactaggctaggggtataaaaaactattgagaaaccattaataaagcagttagagcaccataaactagattaagaatgtaagtagcagaattgctccaaacttaaccaaacttcacaatagaatgttgtcccagttcatcatcctacctccagtacctgccaaatccatgacatttcacaatgatcaaaatagtattttgaaatttctatttacattatgttgtttctctgcttaagaacctacaatatctccctatgacatttcatagagtcctaatcgctgtgcatgggtggcatttaggccctctgtcaagggtcctcatgcttaccatccaactaaaagtcccatttctctgtaatatcaggctatcctcagtgagaatgcaaagaaccctgagattttaagtgtctttgcttataatgttctcccatctaagattcccataccaataattggacccatgttcctgataccttcttggattacttataaatgattatcttctcttttcttccatgaggtatgtatttattgctttgtgattttcctttctctccacattcaaacacgatagtaagcatctcagtgccagactgagcatcatttttggcatcatccccatatcacataattcacagcacagaggaggtatttatttactaattgagttttagtttctattttagcaactatcactataatgacatcaacttcttactttagcaaaatatcaactattatggcagtgcatttgcttactttaaatataaatgcaatttgcagttttatacctgaagcaagacatctctgatcctctgccttgttggtaaaaaacctcaattcatcatccttaaattggactaagggttaagatctcctttgccctgtagagtcagcaatgaattacaatgttaaaatattgcatgagactcatattcatccaaattttcttgaagtaaaccaaatttcattatgtaaaatctttcctaacactaatcatatcaactgtcttaatccgaggacattttggctttgggttgaagaggtcagcctaaaagggcaaaagagagacattcttttatcttgttagaatatacttttgaaagttaaaccaaattcactctggagaaatagtacaaataaattattctacaatggcaacaaccaggggcattttaatcctttcacctcatatatagactttcaagcgtatatttattgagcagctgctatagcaggcatgagactctgtgctggggatatgatgattaatgccatgagctgcacctgctaaaggcttacagcctactgggtttgtctaaattatttaaaattatatgataattgaataggatagacactctaacagaagaaaatgaaaagtactaaacaaagacaaagcagacgatagctaaatctgcctgggggagtctaacaagtttcgcaaagtcagtgacatttaacctaagtttggagagatgctcttgggagcaaaagaggaaggagatttcagagagagaaaacagtgtgctcaaaggcaaatctgaaatatgcctttgtaatatgccagtgtctattgtgtttctgaaataaccatgtaaaaatgtatcccctgtagtttatcatttactccataccttgccactgtacagccttatcagcttgccactatgtctcagacataggagagacactggagaggcctgggaatggataatggaggagagatgcattttagaggtcttgttagaaaggacatgacaattaactgaatctgagggtgagggaaagagttaagatgacactgaagtttataccctgactaggtgaaagatgacaattttttattttaataggagatagtttcttgatcgccatggaactcacattacccaccgttgggggaatcttgagatgaggggccctaagcccaattcattgggggtggagggttgttggcatgagggcttagatgagaaatgtttctgatgaagaaacttttttcagtaatggcgatgcttcctgaaaaacgtgctgctaatcaggcatttatggttttatttatggttttggtacaaggagcttcctctctgctaagagcttcaagtaagagcctggttttttagttaaatctctcaaatccctcacgcagctattctctgggaattcaagttgccactggcatgttgctactcttccacactaggtcaatgtaacttatgttcttggttaaggtaacagatctgtttagttaagtagtgtggagagaaggatgttcactggtccctctcctagaacctctagtgaacagctcagcaaaccatgctgtgccagcattactcatgtactattgatattttgaagacagacagagagatagagagacagagaaagagaaagagggagagagagagagagagagagagagaggcagatagacagatagagacagacagacagcctataccttactgttctcacatggccaagagtcagtatgtattacttataccattctcttagctgtcattctgttttgcttgtaaagcaaacataacaataatcaaactttcttcccagctttctattgatttaagtgatcatacgctttcataaaacacttctcagttttctacaacatgttacatttagctaatcagcattgtcaatgattggtttcttctgtttatctcaaaatgttcaatgtagcacgtgtatagtacttcaaggatatggtggcttccattcttttctttcctatctgagtttctggtttaatatattacatgagatctcccccacctccctttttcacaatgatattctaaactgatttttatatattttttgtgcatacagtcctagtccatattactcctgttgttgacaactccattgcctaacatcttcctcattagcctagttacattacatgttttattatcaaaaaatttgacagggccagctgtggtggcttatgcctgtaatcccaggactttgggagtccgaggcaggcagatcacctgaggtcaggagtttgagaccagcctggctaacatggtgaaacccagtctctactggaaatacaaaaattagccaggtgtggtggtgggtgcctgtagtcctagctacttgggaggctgaagcaggagaattgcttgaacccaggaggcggaggttgcagtgagacaagatccgagatcttgtcactgcactccagcctaggtgacagagagatactctgtgggggggaaaaaaaaaggcaggaaaaaaatatgaagatttgaagaagaaggtggagaattcagttttggatgctgatggtgagttcaccaatagttgacaagttgttgctggacattaagttttagagctttcaatggtagttgatgctacatagaatagaggagagttctataggagagcatgtagagtgagaataagttatgatagaaccatgataaatatgtattcttaactagagaagctaaagaaagagacttagtgcgattataaagtcagagaggtagaaggagaacaaagaaaatgaggtgctttagaagttacataagtagacagccgagcacagtggactgtccaaaaatattacataccatggagttgtcagttaggagcagcacagacaaaaggtcattgcctttgggaattaaggcagcattagtgaattttgactgagcaatggctgcagagaattggagtcaaaagatgaacgatgtgtggtttgactgaggaaaaagatctcagtaggtcaaatcaagcttgaagcaaatagtaaaaccgctatttaggcttactcatatgtaaaaaggagtgataagtgaaaaactgaatatttcaacaatattgtaccagcattttaggactgcaaagaataattactttaatcataagaaacaacaactcatcatgtttgtacttctagcacaactgcaactttttgccactacaatattattttctagtatccttccacattcttaaaaaataaatttctctaaaaggccactttctttcttttcttttttccctctctttctgttagttttttttttttttttttttacaaattcaactctgtcaacttcaggaccacatatgagggaatctctcaaagctgtttaatatcttctgtaaaacaatcaaggctaatcctcacagcatttaaatatgctacagcatataaataagcttagtgtgtcccattaaaaaaaaaaacagagacaaaagagcaacatttatcctcccatcaacaggactcctcttgtctttcctttactgtctagtgattagaaataatgataacacattcacagccatccttggcatgtgctttgccctcctctgtctactacagtctggctctgcctatcatttgtatttctaaaagaacagggcaggaaaatagaagaccactttggtaaatcgctatttctttttttggtcattattgtgatcatttgctctccttcagccttagcttacttgcttttacttctatgcaaagatctttgaaattacatacttgtcctatactataacacaataaagactattcttttatcccactgccatactccctgcacccatgaacataaacacatatccaaacatgcacataagctaaatgttcaacttgtatatctattcaataatttcttcaaaaaatggttaaaatctttctgtaattgtcatttatgtaatcccaaatagaaaaatattctgatacataaacaacatatatattattttaagtcagactgcagatcattttatttgtttgattccattggttattttaaactaactacaatatccacatcaatgtaaacttatttctgcactccctctaccaacctcccaccgccatgtttggttaacattgtattcctgtccactagagataaatatttttttgtccttaatttgatgagttgtaaagtgaaagtagtaagatcctattgatatactggatttaatcaagagaaggttatatctttctcatatgactttagttgaaaggccttgattattaaaggtttttaatattttgtattatttccttagtacatgttgggtagcattgttataaagtaactgaaccactctaagagactttacaaagcccaaagtaaggcaattaaattaaatccagaagcttctggcttcagatggcaattattaacgtttgctaaataataaaagttgacataattttttaggttgatgttaaccaagaatttaaagaaaaaactttaaacatttaatttaagttaaattttaatttaatttgttatttaaagtcaaattacttgtttatgtgcagtatatggtatactattttgaaagacagatgaaagtttgtcatcaaaagagagcaatgacattcaataacaatttaaacttacattaaatgtacattaaattttaatggtaaacaaaaaataaattatgtaatttaaattctaatggtaagacaatgataaaaagcaatcatattttctgtgtaaaaactatcttgtttgacaagtattaactttataaaaaattgaatacaaaattgcaaaatattattctgaattatcttccacaaaacaacaagtgtcctattttttaaaacaaagcaatatcaattctaaaaatgttatttcatgaagatttacacattggcagcttcagatttcatcaggattacctttatttgttttcacctagaagagttccctattagcatctaagcctaaaacttcaaaaacccttgcatgttttagagatgaaaaaaaaagttacactgaatctaaggttcataacattcttttcaaatacagcatttgacaacttctgacaagtatgccagagaagaaccatgggccatcaagtctaggcagtcacgcatagccatcggtcatccatgttccctgtctctacctggctgttcccgccctaagtccctcactatgttcttcccagtagatttgacctgaacctgggagatatttgaaaatccatcaaatatctaactaatctcatgttgctcaaacgacttgtataaactaagtggaataccccaacttgaaggtaaatattgtagggaactaagctttcctcttctttggtatgaatgtaacatcacataatgaatatatatatatatgttcctttttttatattggatcctatgctacatcctgaattgtctcccactaaaggttaaattagatatttaccaaatcagtaaattttagaccaaaaaccccataaatattccagaaatcttggcaactaggtcatagagtataaaacaaacaaacaaacaagaaagctgagataaaaacaatggagcttacctcttgcctttatggtaccactttttataggttttgaaatttgtacaagaatatagtaaaagtgggagagaagctattataacactgcaggaaaggatggcatttaatccttaaaatctttgatcaggtctttccctccaaatcaaacttgtgaaatggcatcctgttaatagtgtcagaagccatatatcatgtgggcaatgaactcttcaaggttctttgaaccaaatcttccttgcctcttataaattatcacagcaccttaagagatcaggactcctaaaggcagaggtactaatgacatcatttttaatctctgtagactgaaatgtatacttaaatccttctctaaaattaagggctcttcagttttcttggaaacatccacaaagccccagcaaatactaaccaaaatgaaattagtcttatcattgtgctccaaccttaagcataaattgggtaattagagagagacgttatttcttccagcctaactcatcaagaaaacaaataaaatttactgtgaaatatgacaacaatgaaaacttcaatttgcttttccaagagtagcaatagtaggcagagaattgtgaggatctggcctgccaatgtccccactgtttctctccattgagaaatcactgccactgcctgtgactagccccatggacaagtttcttagcctgtcaaaaaaaaacatcttggatcccaggagacagagatcagtgagataatggaacataccccaagtctggctcttttctccttctacaaaaggcagaagaacagtttaccacaaggtagaaatgattcagactccactggggcaataccctcatggactgtaaacttagtaaatatcaagcacctgtgtaattcatgttattttttgatgatctatagtcctctctaaaaccctgaagatcatgtgttttttatttccatttgaacaaaattaatatccccagtgaaggtttgtgaattgccaaagcttagttttgatgccaattctgccttatgctagaaacacattttgtgattttttatatatattataatttcattttaccctgctgcattcccatttttaaaagtctagacattcctttgtgtctttggggatttggggagcaagaatagaatacagaaaaagaaatataaataatttatactctgataaaaaagatactcttattaagttaattggtgccatgagaatctaaagtaaaaacatttgtctaaaccatacaatgtgaaacataagcaattattagtacatattacaattcagctcctaatttttaaaatattaggctttgacaatctcatagatttatatataggagctgaattatccaaaatttctgctcaaacaattcaattttcatttatttgaggatggagttctgaaattcgctctgtaagtatgtatctcagtgattcacatatgtggcaatgtggcatggtacttcccaggaaccttcttatatctgccatcttccagattacctgtaacctcaggctcccagggctgagcctcacactctggcctctccacaagcacttttaccattttggcttgccatagagcaagaccctactttcagtggtaaagagaatatacttcattctcctgaataaattaataaacacctcttctaagaagtgtcattaataatgttagagtttgttaataaaataaacaatataggaaatttgcattgtcatgacagtcctttttgttttttaaggcagtggcaccatcacaaatcaccgtaacctgtaaccttctgagctgaaaggatcttcccatctcaacctcctgagcagctaggactacaaggtcatgccaccatgcccagctagtttttagttttttttttgttttgttttgttttttttttttgtagagatagggtatttccatgctgcccaggctggtcttgaactcctagcctcatatgatcctcccacctctgcctcctgaaatgctggaatttcaggcatgagccaccatgcctggcctatcacagaaccttagaatcttaataataatggaaaatcaaatggatgactcacaacacttaaatatacaagatttttaaatttaattatatatatacatatatatatatataaacctattttctctaatacaaactgctaattaatatttccctgccgtttttaaactaatgaagaaatattaatacataaaaagtaactaagcattatttgtagccatactctctcattgttaaatgtaaaattattttgcttagattctcacaccaaaatttgcacaactttaattttaaatgttatcttggaaattattctattttaaccccgaagaagtgatgagatcatgtttttgttagatgtcaaaccaaataagctatttagactttaactaatctaagctgtaaaacacatggatcggtgcctttcaaaatgtactttctttttattttactttttaaaataaggtaaggtctggctctgtcactcaggctggaatggagtgacactaccttggctcactgcagacttaacctcccaggctcaagcaatcctcccgcctcagcctcccaagtagctgaggacacaggcacaagccactatgactggctaatttcttcttcctcttttgttttgttttgttttgttttgtagagatggggtctcattgttattacccaggctggtctcaaacacttgggctcaagcaactctcctgcctctgcctccccatatactgggattataggcatgagccaccatgcccaactcaaaatgtactttcaaaaacaagtggtctatacatgttcaatgttgttctatctaaattattttaaaagaaatttacataattcaataatttgtttttgcctgagatattagtaaatgtaataagtaaaataatgaattggttaccctaaagctggagtaagtgtgaagaaatatatacctccatacttactggatggagtcagtacagttgtggggggaagcagtttgtcaatgttgatccaaatatgaaatatacttaacttttggtccatctctaaaaaaattactgtaagacgacaaattgccaaaagatacatatacaagtatgcccaccataatatttatattgggagaaactgtcaataacagcatatatggaaaaatatacacttgtaactccaaatattacattggcatggaaaaatattgacattatttgatttttaaaaacacagtttgagaagagtgtgaagtgtatagagattgagtaagcactgtggtttttcagcaagagctctaaacttaactgtgtcacactgggcaaatggtttgacctttctgtgcctctgtttctgtatctgtaaagctgattaataatttaaccttccacaaaagattttatgaggatgtgatcattaatgcttaatggaaccatgtcccacccatagtgtgctggccgcaggtgtacaccattaatattttctagtttatgtgtaaacttagtacatacacagatagtatgtacacataagagttctctaaaaagatgttctcaaaatttttttcttaaaacataatttttcaggcacagtggctcacgcctgtaatctcgcacttttggaagctgaggcaggaggataacttaaagccaggagtttgagacaaccctgcacaatatagcaggaccttatctcgacaaaagaaaaataaattagctgggcttggtggcatgagcctgtatccctagctacttgtgaggcttaggtgggagggtcccttgagtccaggaggtcgaggcagcagtgagctataattgcaccattacactccaacttgggtgacagcaagattctgtctcaaaaaaaaaagtgataacagagataatcatacaagagggaaaagatatgaacaagtataatcattaaagtggttttattttttaaatgattggtaaaattataaatatcaagccataaagcattggattaataaagtgtgaaaaatccataaatagattacaatatgaccaatacaaaaatggtatagtttattgacatgacgagaaatccataatatattgctaagaataatgtgcatagtatgaccccattaatgtactattgcatattgtgtacctagagacttgtctagagggacgttaactagaatgttaacaatgatgatgcttggaaaagttaattttctgatatctttgctttttgcttaatatggtactgtatttttcaatttttttgtacaatgagcacattttttcccccagagctaatataatgattctgtagtttatttctaagtttatttctaagctaagctctatctccctgactataatactttttctacttctactttacagttaccctggttctcttaatccagatggataaaggaaacacttatctatctggatccactatatttttctctgtgaacttccagacattttttattgacttagaatcttctgacttgtcttaaattttgtttctggccttcagaaagctcaccctcttctttgccctaccaagtctgcctgaagcaaaaccaacacctctatttataacttctaaaaagtttgcctttttcacttattgtgttactgtaagtgactttcttggcagggtctcagtaggcatcacgtggtataaatcttgggtcatcattggagcataacaagtatttgtcattttccaagatgccagtgtagatttttgcttttcctcctcccacattccttaatgaaactcaacagcttcttgcactcttccaatctcatttgaattcttttcaattcatttgtgtagcaaataagacaatacataaaaatccaaggaatgaccaagctcattaaggtttaggtcaccgtctctgtcaacttggcaaggccacttttagtggcccactgtcctaaggatttatctcccaaataccaacattacaattttacaatatcaacataatttagagcagtaactaaaacagtcaaaatttaaagcaaagaaaaaaaagcaatgttattctttcaataataattttctgccacaagtttttttttttcacatctgcctaatggtattggcaaaaaaacaaaacaaaacaaaacaaaaaacaaacaaaaaaaactttcctctagttataaagtctccaatgataaaagagttaaatcttcccaatgttgctaatttattgtgatgtgtgtgaagttggatttgctgagttggaaatgctagcataatctaaggtaatctccttttcctcatttatataatggggatgatatggctttctacctcatactgttgtagcactcatgttatataattcatatctaggacttaccatactttctggctcatggcattaaccattcaaatttttagtttttgttgagagtctgaaatctccatgtatggagcaaacatgtgaaaagtaatattattgctcattactaaaaaacattacattttcttctcaataatttctacaaaatccaaagaaaccaaaaataagtacatttgtaaaaataaaccgcaactttatgtatattgcccatgtaaagaaatgatcaaaattgtcaacaaatctaaagttctctttttgaggtcagttcatcaaataaatgaaggaaaattattgctgaaaatttcaactgaaactgggcttttcaaaaataaacatggaaaataacttgtttaattaagtactatttcatttacttaatatcacaaacaacttaaatatataaaaataaggaaatatctaataactaactagcaggcttatcaagagagaagcaattctggtaggcttctgtctaatcaatcactagaatcagcatttttagaaataacattttaatatttagaatgcaaagtatgtatttgattccctattataatctcaaaaggagccaaatatttgtagaaaattaaaagaaatatccaaacaagctattataaaatggcattttccatactgaaatttcaatacctaaaatgaatagtcaaaaagtgacataaaccagaaatgtcattatgcagatgaagcctctattttaattaatggttgagaatgagagaactgagggtctaattccagagctattttgacatatatcaaacttcccttaatttacactgaaaggcctttttgacaagttctcatgtcgataagctcctattagctaccagtaccttaaagtggtgttttgtcactgacctacattagtatatcaaactatgacagcaaattaatggttacacatgatcctaattcagattacagtctctagccaaacatttagaagagcacctcagtaacaatgaaatacaaatatttctgcgcctacattactcatttgataagtgacactaaagaaaagataaatacaataataaatagctgtacaggtactcaaaatctttttttagttaggatttagtgcaaagatcacataattcaattctggaaataaacttcctctttaaataaacagagaagtaatcattaattttgagaaacctaaggactgtcttgcacatgatatatgtgtgtatatttatgaaaacctcaaatcaaaaatacttacttatgtcatgatatttgttttgaattattttgtatcttcttgagatggagactgctgacaatgtgctgtgaagctaagggcatttataccttttttttggaagagtttacctaaagctctgattatatcttttcaagaaaagcttcctgtaatgctagtcaacactaaataagccttcccctagaaagatcatgttctcccattagtgatttatatggggagaggacctagggctcatcccaatttggttgtatagggaaaagagtaaaaaaccacaagactgtccctatgctgctctagctttttctcatccattcttacctggagaacacatacatcacgtttagaatggcccagttaccatctatatggcccacaaatttatattttccacacagactttgccctgtcttctaggcccctgtgcccagctgtctacttgacagtttctcttgatgtcttaaatatatcccaatatatccaattgaattcacgttcaacacctctcttctctcaaaaaaggtgtcttttttcagcctttcctacatcattgaatggcaataccatcggaaatgtttcatataccacaaacataagaacttgcccttttaatctgtccatttcctccatctttgccattctcatgccaatgcaagccactatcatctctcactccaaccactgcaaaagcagtctgatggtacctatcccattgaatctccagggagaacactagtgatcttttcaaaatgaccatattaatcccttactcaagaatcttcaatggttttctaacactttaaaagtaaaattgtcattaacatgaccttaaaaacgctggaaattcttcttctgcttcctcagggtattcaaactcgtttctctctctttccggtctttctaacttgctctgtttaatcctggcccaaggcctttgcatgcatgttgttctccctagtttcgaagtcctttccactaatctaattgcttacctaaaactcagctccagtgtcccctcctcatggacacattccttgacccctgtgaacaaatccaatcattcatttatgggtactcagagctccataaaccagctcttcatactacttaacgtgatacagttttacacacatatctgtgattgttaaagtcagtcagtcaccttctgttaaaaataaactccttacaagcaagaacggcacctgattttattggcattttatcccaaggaccaagcaatgtgaccagcacattgtgttgttcattcaacgcttaccgaatgaattaattaatgcagcagaaaaaaatggcctatctagatctgtagtagaatgaaaaggagggaggaagggagaaaggaggggaggggggaaagggaggaaagaaggaaggaaggaaggaaggaaatagagaagttaaacataattcttgaatatgtgcaaacactaactctaattttacaaattacttgcagttgtatttctaaattctatcttttcctaactgattgtcacttgatcaaatgaaactaattcaggtcaatatctcttatggtaagataagttatgtcatactttcctttaacctgaggagtaaagactaattgcctttcctatgttctatttattatgtggtaacttttacatataaaaatgtctgaaagtgtgctgcttaaaatgcacattatgattgtattacaatattttcccgaggtgtcatattataatattcttactggttggtggatcgtcaatcacctcctattattctggactggaacagtagactatctgctttatgtaggcaagtcacagatactgacatttgtaaataacatccttgagtttgaacaaattcaaacaaatcttctcttctgtgagtgtacatttctgatttgcaggcaagttgtaaaacgtctattataatctgcaaaattatatttgttttccaaataatgaaattgtttttacccatttctagacctttattcatcttaaagtattaaatatatgttcctcctattacatcaacaccttgtaaactaaatgattaaaagcatatcccattttcagctaacacatgctactaaactccaacctatagaaagaaggtgccaagggtatttaatctcttcaggctcatctccatattttctatagacctgataaaaattatcaaagctttattttccatgatagagatacttcctaatagatatttcatctactattttttcatgggaagaaagtacactatgctctactaccttgaatcttttgtttgtttgtcttatggcagcaataggagaaacatactttaaagattaactttttttctgtaatattaccaaaaaaggacatgtcatttattatagatggaatgtgttcccccaaaagagaaatgctggagtctcaacctccattaattcaaaatgtgagtttatttagagttaggatcttgacaagggtaatcaagttgaattgaaatctttagagtgggccctaatacatatacagatgttcttgtataagggggaaatttggacacagacaagcacacaagaagaatgccatataagcattaaagcagagacggatgcgttgcatctccaaggaccaccaaaagctaggggagaggtttgaagcagattcttccttacagccctcagaagaaaccaaccctgtggacaccttgatcttggacttagagtctctagaactgtgagacaataaatgtgttaaagccatccagtttgcagtactttgttgcagctgccctagcaaacaaatacactattaaacaatttgtggctgggtgtggtgacttatgcctgtaatcttaacccattgggaagccaaggcaggaggatcgattgagcccaggagttcaaggctgcagtgagctacgatcgtgccactgcaactccagcctgggtgacagagatactgtctcaaaaacaaaaacaaaaactctgtgagaaagatgggatgcttacagtttggcatttctccctgattatatgagaatatagttaccaaacctgtaggtgagtaggaatgatagcatccgatacatctacctatccttccttccttcatgctcccttccattttcctctctctaccactttcttttccttcaatatttttctctcctcttttcctccatccctccatcctgtctcctcccttcctttcttcctttgaatagtgtgatgaataatgatgctctcaaccttccaaatactaataaagagaaacttgaattttccaagtgaagaagcccaattttattgtaccttaaacttacatatagtaaacttaagtgaaggatggttataaaatctgaatttatatcaataatctcctctatttttcctggaggggaagagcctcggttaaagagatttaagaatgctttgagtacttgtgtttgccctaaagttaggggaaatctatcaatctctgccatttacccaaaaaacattgtaccccagattaaactgaaccaaaatcttataagagattatgggtaaagaagacatgagcaagggcttcatcggcagaggagtttcaaggacatcctatcgtatattatggcaaggatatgaccgttctaggaaacacatgtaaagcatataggtgactacacaggacatatttgaaggtgaatgaaggcagacagagtagattgtgtcctgaatgattagctgtctgctctgtcttagcttgagagtggaaacacacatgcacacacacaaaagtgactctgtactcagttctgggtaaccctatgcatttgctcttgagattctcttatgtggcagacctgaccttggtcactggattaagaaaagagcttggttggtatttttccttgcctttcaattaatagctttttgacacagctggtgtttaatagagcatcgttaacatcacaaaaaaatagttcctgcagattttatcaaatgaaatgtcttgactaaaagatgcattctatttttgactatcaaacattgattgccctaaaggctggtaattgaaacctaacctctacctgctcagcttgtcaacattcaatgccagttgtctcccaccagagaatgagattaccatctgctattctgtggtttcttctgtgctacaaacagatttagtaggaactattaaagctaattaacagtcacagactaccctgtgatactcaacttactgcaattttatctgagccagagaaaaaagaaaaactacaacactgttcataagtgattgtttagttatacaagttaaagacgcttacaaaccaagagcagtgcaatgaccttaataagaatgtagtcacattgcattactaaatttccataaactttttgtctggaaaattgctatgcctttacttccatcttctctctccttaataactactaattggtaacattcaaaaaaagaatgtttctttaataattcatttttaataatttatattgagaaagtccctttcagttctggagcttactattttacaactgtataaaacattccacttagaaataaatagctagtttatttgtcattaaaatgctaagaatggctcttctttaaaaatactcaacttcaaacgtaagaggaaactgagtggagagaaagagagagacagagacagagcgattcccagatattccatagaaaaagtacttcctgttaacagtgttatatttggatttgatttcctatcagtggagaaacagactaacagacatgggccatatgtcacagagcatacatttttaaaccttagcagaaataacttaaacagcagagtaaacagttgtaaagcagggaagctgaagatttccacatataaaataacattttctcttctttaataggtattctactgacaagctttaaagtgtgaaaattaggttatcctctgacaacagtcttgggaagtaattttgtgctatatttcatttcgtgctttattattattattattttaatatcagtgctttctagcaagaaaataaggaagcctaaaaaataaaaattactgctaagttttttgaactcaaacaatctgacgaggagatacagaccctggaagaacagagctcaatcagattttatccttcaggagcagtgctagacagagcaggcaggacttttaatatgacacgacccagaaaacgcaacctgcacgtaagtaacgtaacttctgtggtatatccacatctcagattctatttaccatgtgtggatattcagattctcagttcgggttcagacagtgtaataattctagcttctatgaagagtagcctgttgttattactattctttaaagtttatttatctgaagtctgaatatttttttcaaaatcataaagccaaaatacaaatgcaggaaatattttatcagcattggattgcatctgctaacgtaaacctccctctcccttccaaccataactggaatcgccactaccatattctcttacacacacatacatcctcctcctttggacagctgcatggtattaatagaaattctgtagttgccatacataatgaaggagagatggtgcctaaggctctttcagagaagcagagccacaaattccaaagtggaactcttctccccattttaaagactaaccacccattttcctggaatgaactttgttatgtgttgaataagccccagagaaaaaagagtcatggatatatatatatatatatatatatatatatatatatatatatatggtatatagttacagatgacatttcggtgactgtatgtaaaactgctaataaaaggctcaagtacaggtattttttaaatgacttgtggcttgacttgattagtagatgtgatgaaattgatggttcatttcctacataaaagacaaacagtccaggtgcagtggctcacacctgtaatctcagcatactgggaggccgaggcaggaagatcactagaggtcaggagttcgagactagcctggccaatatggagaaatcctgtctctactaaaaaacaaatttaaaaaattagccaggcatggtggtgcaggcctgtaatcccagctactaaggaggctgaggcatgagaatctcttgagcctgggaggtggaggttacagtgtgccaaggtcacgccactgcactccaggctgggcaacagagtaagactccatctcaaaaaacaaaacaaaacaaaacaaaaaacaacatgacagagaaaataaaactgtctttaactatagaacagttactaaacattttcaactggaatgacgtcttcagttagaattagtttgcaatagaactttgaaactggaagctggcaaaagcacaagagggaaaagaacttaaactagaaaggaatttgataattatgaaagcatgaaatagcatggaagaaatcggtatgagaaaaaacaaatcttaagtaactaaatttaattcaatttgatgaatatttaattgagtagctactctatacaaaatggtgtattaagatctctgagtgggccaggcgtggtggctcacgcctgtaatcccagctctttgggaggccgaggcgtgagaatcatgaggtcaggagactgagaccatcctggctaacacagtgaaaccctgtctccactaaaaatataaaaaattagccaggcgtggtggcaggcacctgtagtcccagctactagggaggctgaggcaagagaatggcgtgaacccaggaggcgaagcttgcagtgagctgagatcacaccattgcgctccagcctgggtgacagagtgagactccatctcaaaaggaaaaaaaaagatctctgagtgatgcaaaagtataaaaaacagtttttatttcttcctaaagtgcaaagtataattaggagagtcagatacattggtgttacccatgagccaaatgcaccagaatcactggaaatatagatgtgaaaaaatgcacatttgattaatcaggctgaaaatatcaaagttaccttccatttagagaaactcagaacttttttttctttggtaaaatttcatccagactctggagttctctgtgtatctttctagtcgcagaaccatcgagccaactcactgttttatcaatattatcacaagagtattcttttcatatttatttcccatcttagtttccttgaaaaatgtgatgaaaatgcaaagatcacaaattcatgcatttttttttgactatgaacctttgtctatgtgttaatagttcaggttctagtatcagttgatttatcttttataaatggttttaaaatttaaacatgcaagaggttttcttgatttctattagtgattatctcaccctcgtgaaacagaaaaaagtgttgtaaatgttgtaattcagtattgtatacacagagagagagagagagaaagagagagagagagagagataaggcagttttcagagtaattaaatcaaaaagctgtaggctccatatatgacatagcaaaatggggaaagattgatcaagggaaaataggcccatatatctgaataaaaagtagaagaacggtgctataataaaagtaaaaaacaggacatgattattgtgttgtagcacaactttaggagtaaaagttgataagcgtaggagaaagagaaaaaaaactagaactagtgtgtaatagagaagtgggaaatagcattgaagatatgggtatgaaaagtggtatattctgattgttttggttgggtattcagtatctgactgatctctcaactaaactatgaaactgaaatagaaaattcagcaacactgaagtcattcatcaaatgtaacggggatgattgcctccatccatttatcccataggagatatcacaaccatgagggaataataactttataccaagaggagacaccataggcatgtagataagtagtgtcaatcattttctctttgactattgattgtcagaaaataagcttctgcattaaaacctgaagacctaatggatcagaatctcttgggtcagggtacccaaggagctgcattaatgatattcacaatataatctgaggatctcttttttaatacaaaaatactttgaaaagtactataatagatcatcacttaatatgacacgaggacatgagggattgatagaacacaactaagatcagaagaaggaatcaaaaattgaatgtgacctgagctttgcaagatgattagaagtttactaggcatgtgcaggagagaagtatatatgccaggtatagggaataaattttaacaaggctcagaaatatctgataatggagtacagtgaagaaataaagcaatatataataggtgggccaaacgagcaagaactttgaattgtagattattctggaaataccagagagccatagttggttttagataaaattatagagaggccactttgggtaggatgaactgaaagaaagatgcattggatcattacggaggactctactagggataacgggaccaaattaagacagttattgcggaagatgcccagaattcacttgagattccatgcaaaggggtttatttgagcatgttgaggatgacaatattagacattaatctaagatgacagcaatgtgaatttgaggaaaaatatgtgcatgtaattaacagaaaaacttgaagatctgaacttcctactaaattacctacttcagtgaatggtaccaaaaaaatcacacactgtcacatcctatatctgcaagtcatttagacatgttctctctgccaacatctttccacatccataaatatactgctaataagatttaaaatatatattatattatgcttaaaatgtgccaagaactattctatgcactttactcataccaatttaatccaaacaaacactctatgagataggtactattctcctgagtttgaagaggtgaagaatgagactcagaaaggttaaataacttgcccagggtcacaaagggagtaagaatctgagcattcttaagcattgtactatagcacccctcaaatagctttccaattattcctctctagtacaactttcctcctactgatctagttaaagttactttcacctcttatctaaatttcaaaggtctccaaatgaatgtttctgccttcagttttattccttctcaagtcactctcctttatgttgttgccccagtcattctaaaatgcaagtcacatcatccctctaccctgaagccagtaagatagtatacacacacacacacacacacaattgtatcatttttctaaactcttaatcacacacacagagagaaattcagggaaattggttatggcttgtcttggctttagaaacggagacattaattgctattgatccctggagttaaataatgtattgttccttcctctctacagagaaatcattaattttatttcattgaagcttttttcatcagtcaaagccctgtcgggaatcagatagcacactcaaaatcatgattgaagagatattaacaaagaggctgcttaccaaggagaggatggagttgagaaacagcgaggagtgtgaaagactctggaactaggagggctagaagccccttccccacctgggcctgaacagacaagaagtctggatctgcccagacatttagctgatgagggcctccaggcaggagccattacttggacagaggaacacagccattgacaaactgtggctccctaaaagaggaagttagagcaataaacccccaacctcttctcttcctagaaatcaatctcttccccctttgttccattggcctaatccaatgagagctcagctgagtcagcccatcaaggaacaaagccaggtagacagggttagagagtgagtatggaagcaccaatcggaaacatccagcgcatttgtgtgcctttatatataacagttttgtctttgacattaaattgtatgaattcaggcctacatgagtgtaagaaacaaggatatcatctgattctccataacaagaaggcttctgggcttccatttcccactgccttattgcaaggattttgacaggtggagacatgaataaatccttactgctgataaatcctaatggaaagcaagaccagattattgcactcgtcttccagaaataacagtttatttcatcttcctggctcttagaattgcttctcattatgatttattcacatcgtataatgcaaattactacacaaattataaatttaacatacacacatgttatgcatatacagtacaaacatttatatgtgtgtatttccatgattttaaatatactgggctctttgttgtgtgtttcacataaagttactcatttaaagttcaacaacctaggatacttgtctcatcatcatttacatagaagaatcctaaagcttagagaaagtaagtgaataccaagagttcacatattaaggaaaaggtggaagctagaatgcaagttacaggaatctaaaagtgtctcactctcagtgacaaagttttcctgcctacaattgctgaatgacgtagagtaatgtactcttacacattttctttgtgtaatgtcgagtaatgtactattacacattgtgtttgtgagaaacaaacagaaacactgttcttcctatgataatcttaacaaagtcactctctttctgaagcttcttcatgatcaaaagattgaggtgattttttaaccatcacttgacatcacataattttatggtctgagcactccatatcgggcagagggggataaactaaatcactggaagacaaatgtggatttagacacaaattcctgaagaaacagaaagggaaagattttctccacacagtatttgtcaactgctatgaaatcctatatttctactaactcagggaaactttaatgatcagctggagcaagtacaaaaaagaagtgtttggagaagaaaactacatattaaagaacctattcttcttctttcagggcatacaaccaaaatttaagctaatatcatgctgcattttaaagatcctaagtaatacaaacctatttttacaatttgcacgttttatgcattcttggaagaaacttcattcacactgtacgtgctcacagcctgtactcttggaactaattggcaagtgtgaattcgtaagtctgtctgaaagaactgtgtccctgtgtacatatccaactgttttgaatttttttaaatttatttctgtttttacttttccaggtatctaatgtgagaggtaagaacaaccttcagagaaaaagcctttcactgaaggaaattcacattataaatatgagacaacgaagagaagcaagcaaactgagtgattttaaaatataagttgtggattctttttaggacctgctgcccaataagccaattaagattgcggagaatataagtgttttggaaggcactgcatccccaaataaaaaagataagaatcatagcaacatttggttgctctcacattgtggatacagtaaatagagcaggagtcacaaaatttttaactagttcttgcttttaaacttaattgcctatttaataaataccatatatgtgaaagcacataaagctaattcatattttaaaacaatgtgtttgttataaactagggggaaaattcaaatatatacatatatatagtagagatggggtttcaccatgttgcccaggttggtcttgaaatcctggactcaagtgatcttcctgccttggcccctcaaagtgttgagattacacgtgtgagccatcatgctcagcccgtagtctctattatgttgaagaactatctaaagacaaacaatgtagcttagcttgttagactagatatttattttcttaaacatgtcttatttgtaaaaaagaaaaaaagacaaaaggaagaagggaagtgaagaaaataaaagaaagaaaagaaaagaatatgagagggtatcactctaatagggagggcccaagtgaaccttagtagttcctagcatagaacgataggtgctctgcctgagtttctcaaagttgatattcttcaaaagcttctcacttcccattaatgagcatatcgcttttctgtaagattccagtgtggtttattttcttccagaaacaaaagtaaagttgattatgatcatttaataaattctttttttctttatcttctgctctccaagaaattttttaaactatatatcatgaatacttggaaagtctcaaatttttataataaaaatgccaggtgttgactatagtgaactaattattgctagttaatatatacaatttgacacgaacagatagtgaaaaatacatacaaaaatcaataatcacagaactctaggtaatctagcaatcattttataatgagaaaactaaagaaaaattaagtgatttacccaaaagccacacctttagacgtcaacattaaaatttagcccaaatcatagaatagaaagtggggaaaaaatcctctatatttagaaagagagaaagaaagcaaataatttcaatgaaccaatcaggtgttttaataatattcaaactgatgtttattttcttaaaatagctgcagggaaaccacttgggctggaaatattaaggcataacaatttaaaaggaagaactgcaaaatcacttgtatctacacctatatgtatatttcacaagtagcaattttaaaggttacatttctctaatttttatgagtgaattacaggtcacttaatataaattttaatttatatcaggtattttgtatgtcaatttgatttatttgtatatacctagatctaaagctgatacacatttcaagaattattattcctttatatattttagatatattaacctataacaaaatttctacttgagatatcaaatgccatagtttgtgctatgtgtctgtgctttaaataactgggatatacaaagaaatgcagagaaagaaggacatatatttcaaacagtatttatatgacatggctcataattcaatgcaccattagaggaaataatctacaaatatttggtaaattttaagccaggaaagcagaactctgatagtaaagtgaaactgtgtcttcaaaaagagaggtttaaatatacagaggatatgtctttgtctctgatgagcataaccagtataacttgtattcccaagtcaatttcaatcatgacaggtagcatactacagtaaatattataataaagctatatcataatgattctcatctttctacagccaccaaaaaaaaagaaatcaaagatatgagatacttaggctcaaaaacctaagcaaatgatttaaccacaaaggccatttcctttttgacagctgaaatacatatgagtaaaatgaagaatccatttaaacagctgcattccataatatttttcagatcctttgtctatctaaatttgtgtgtttcaataaagtcaaaaggtagtttctatgaaaaaattagacattaatagactgtgttatctctatgtttctgtgatgtctagagctgtggaacttggacactattaatgaaattcagactgagtaggctgcttttatcagtgtttaaaaatccaattcttcttaggtttactaaaccagcaacttttttataatgaaaattttgtaaattgctgtaccattccattaagaattttattagagatcaatgaaaagttaagtttaaagataaattcatatatctacataaacatacataaattccccaaaatattgaaaaacaacactacttccaacattaggggaaaacgtacttttatgacaaaatacttttttataaactggtaggtgacataattcttcaatcaaatgctgagattagaaagaaaaatataatttcctgtatttagccttgagcactttggtatgaagcaagaaagaaaaatcaacagaaatattactgtagatgtcattatgccaataggaaggtactcaaataaaatttatactgtagaaactagtattttaatctatatgtagttagtttagcttatacacatagacatctgaaaaagttcctttcacaatgcttctgttgacgcagattctttactgactctcccactctttcataccacatttcatgcagacatatttcctctctttttctcaaatgacttgatatttttcctggttattttaatacttgtctggaaagctacttagcattgcttggtttttgcttccaaactagcctatcaggactaagggaaagagaagcttattagattatataataggattaataaagaccaattgccttattttgcactcacttattagtttaactagatcagggacacctttgctgtcagtaattaaatttatgtattagtgaattttcatttctaaatctcaaacatttcaaaaacagtccttttcgataattgtccacttgcatgtttttctaaaaggaaatcaaataaaacaactctcatttagcacgtacgaacattttggcataaagaagtcaaacaatttaaccaaggatacagaaaaatggaagaataggaaattatatccagttattcgcatgtctagtcataataaaaacttgcagaatgattcaggatatgtctatgcacacaaaataataatattgagttttactacatgaactgttacttttatcccattaagtcctggatcaaatctaaacttctttaactctctgtgtaattccatacaaggtgatcatattcattgtctcagctttctcagctggaaagctgaaagacagtcatttatgaagtttccctcaagctctcaaattctgttaactagtgactggtttgcattcagaaactggccaagtgaccacactggccttactccagtcacttttggcaacagcatgttagcacaacattggcagaattcagacatgctgttgaatccaaacaacattaaaacaatggcaacaagaaaaaattaaacagccaatttgagttaatacacaaaactataaccctatcagaaaaaaaagaatagcacatgtctgcctatgcagctgagagggaactttggtcatcatcaagtcctattgaaagaaaaagatgtaaagcacttaaaaaaaattcaaaactaaacactaagttaactcactgttaatgtaaaacatctttcagaaaataattctagtttcatattttaaaacaaaaattaaataacaattttttaaatttgtaaaatgtaaggggtacaagtgcagttttgttacatgggtatattgctaatggtgaagtctgggcttttaacgtaaccattaccaaaatcgtgcacattgtactcattaagtaatttctcagccctcgccccctcccaacctcctaccatttgagtttccaataactattattttatgctctatgtccatgtgtacacattatttagcttccactaataagtgagaacatgtggtactgtttctgagctgtttcacttaagataatagcctctagttccatccatgttgctgcaaaagacatgatttgattatttttaaagctgaatagtattccattgtatctctatgccacattttctttatccagtcatctgttgatgggcatttaggttgattccatctttgctgttgtgaatattgctgcgataaacataccaaatgcaggtaactttttgatataatgatttcctttgcatatataaccactagggggattgctagattaaatggtagttctatttttaattatttgagaaatctccatactgtttttcatagaggctgtactaatttacatttcccaccaacaatgtaaaagcgttcccctttctttgcagcctcatcgacctctgtcattttttgtctttttaataatagccaacctgactggtgtatgatgatttttccacaaactatcacaatagtagaaaatccatgtttccaattattttgaatgcagttacattctaatgtgtagtcacagtagatgaacagtgtgtaaagattaatattttatcccaaattaccaaaaatatgaaaatctttattttggctatgaagtcttgatcactataatccaaatgatcagacaatttttatttgtttcataatattattttttgttagtaatataatacagaaataatttttaaagttataaatttaatcacagttccactatcaacaataggccacacaacacaaataagtctttctcctttatttctcccaatttccactctcaaccttcatactcacacaaatttaataagtcatcatttaataaaataagataatttcacagataaaaatgatctcaaatctattttactaagtaatgtatgttgatataaaattctattttgacttgacagatgagaaacaaaaatactctgtgcctacattttaaaatatatttgtagtagtagttttattaaaatgatttctcagtttcaagtgataaacaataatatttctggatccctatatattgtaaatatggttcagatatttcctctaggaaaatgttggcattcagaatttggaggaaatatagctctcaacagggatgataatgacaaactaaaaataagtctataatggaattaggactcatcacactcaaaaggtgatatatagaatatttgaaatcttcaaatgacatataaaaacaaaaacaaagcaaaaaaccttcttggcttttttgtggtgctctacagcacagacttagtacagaaaaagcaaaaattaaaaaaaatatctagagttgagatatatcagacctgttttcaaaccttatgtcttgtgattttgactcaccacaatgaaacacaattatacattcattattaaaaatccttttcgtaggaaatctgcattttcagtggatcatgtctgttttgtgtggtgttattttttaaaagcaagtttctggagtaaggtagcatagcttttagttcatactttatttactacttgcacgatcacaggcaaatcactgaacctccggaagcatcagttttctcagttgtaacgggattataatacatccacaggattgttcagaccattagtgggataatttctttaaaccacatgcagtgaataaatagtggttatatctaaatttttatttaaatatattgctcttaatatctttaattctttcaagttatacacaaatgaaaattagattatgtgagttgttaatcttttcttgacaattctgtaagcaaagtaaagatgttattgatatctctctggccagattttcagtattgtaaagatgcaggctgtggcatgactgataattcaaatagaataaaatacaagcaactgtgactgctcagaaagtttatctaatgtggtggaaggatccctgaggtggaggtccagatcagctctgtctttacactgaatgggcaatatctgttgaattagcacttaaaatctttgagctttggctttccagataaaacaatgggaatgtgaattgcataactgctaaggtaatctggagtagctttgaaattgggtggtttgtaagatagcagtaaaattattatttgttgcaggctatccatgaaccaacagcatgcactttatgtatctttccttatttaatttcattaatttaaagctattactgaatacctactaaatgctagccccttactctttagaatgatgaggttcagcagtgaaaaagcaaacaaaattcttgcctttgtaattcatatattgtagcagccaagacagatacaacttaaataaaatgtaagcaacattatttggtgatcagtactacacagaaaaaaaaaaagtatatggtaaaaaaaaaaaaaaaaaaaggtttccgtaggttgaggggttgcaattttaaatagattgggtcagggaatactttcctgaaaagaagacattggagcaaagccttgatgtagacgagggaatgagccatatggatatgtaggcgaaaagccttccaagttttggaagcaataatgcaaagatcctgagagggagggatcctgagatggagctcagagaatcatgcagactgaggggacagtcatggcaaataaggtcaacagttacaggagatcagattgtgtagggcttttaatctctgtgtttacactgagtaaggtaggaagtcatctgatgattttaaacaatgaaataatgtaatcttacataaatacatataggtgtgtacagatgtatgtatttgtgtcagattatatgtatatgttacacatacacatgcacacatatattttatatatatatatacatacatacatacaggatcactctggctgttgtgttgaaaatacactaaagagagacaaaatttgaagcaggaaggccagttaggatgctttcagtttaactcaggagaaagtggacttcaggactcaaatgtagggtataggagagaaatgggcaggagagctacatttgtgggttctagtgaagacagaaaaatgatgtaggatcccttgttcaaatttcaatacaaatttaggaatttcagtagagtgatagtggagcaataaaccaagcacagaacttttctgagtgtgaagccctagaaagaattcgataaagactttaagttttttacctgaatggagtgatggagctgcccctaactcatacaagaaaaagtgtaggagtggaaggtttgaggctcaggaaaaggtcaggaattgtaaatatcaacatttaggagatgtcttgtagacttcatgtatctttacctttaacaacacacaagtcatcactgaccacaacagaagagttttggtggacagagtgatgggaagcagggcagcggggagactctagtaattctgaggaagaatggaatgagagattagccccagcaagtacccagccatctcaagaatttagctgagaaagaaagaaagaaatggagactggcattaaggagaaaatagaactgagaagatatgtttaagaggaagaaatacttgcatcctcctaataattctttgaagttggcattatttttcttatttttgacgtataagtaacttgccctagatcacaaaactagtaaggtgcaatagtatgtaaccacaaattattttgtttaaattaaagtacccactttgagtcactacattagattaattatttagagtcttagcatcttagggtttgaggaaagagcttttacattaataatgcagtaagatctcagcttaaatttcacctccctcaaagaaaagtaggccccctcaagatctccatcatatcacatggtatgcttctttaatagtgctcaaaagaagtagttaattatatttatttatttattttttatttacttttttagtttcctgagtgtaaaagagttcaggcatcttttttgacttgttcaccattttttccacagtacccagcacagtgcccattgtagtacatgttcaatgtatgcttaataattatctgttgaatgaatgactaccattctttcatttcttcttttcacattcatgccaatgtggaaaacataaatatgtatctgtacctgccttcttgaatattgttacatcttgccaacaacaaaactacaaatattcattagttctcttttcaaatctgattccacttacatttcaaccctaatactaactataactgtaatttacattaaattatagtgataccgtttttatataaactgtattctttactcagtttctcatagaaattaccaatgacataaagtaataaattcaaggaaggtaaaatctgtaagtatgttaaaaattctatatgttcaaaattgtttgtaaagacccttcagtaacagcacagctgcaagaggtgatgtgggtgccactgacagatcaaaagcctaagattaagagaaaagtgggcaccaacttgccttactggctattcttctttctgagaaatgttgatacaaatctgtttataaattagagctcccgtctatctgactaatttggcaagaacaacaaggcttttgtgtcaattgaattaaaagagaaaaagataaaaaatgtagatataaggtaaagaatgagaaagaggagaggcactttaaaatttctcagatataaatactactagagactgacagcacagtgatgttttttagaaatagagctgtaaaaataaaatcaaaagaaatcagatatttgataaaggaggagaaagagacaataaagagaaaatgggggggataagttgttcaaatgatggctattaataatttttacccttagtttcataatgtatgatatgatattaagcatttagaattatacagtattcaatatcacatgaccagactgtgtatgttaatgtatgtttacattagaggaaacatcaagaaaaaaactacatgtcacacctgcattgcccactttgtttagtgtaagctagtctatgaataccccttattttgaaaatatcttgtttcccatgatatgttgttttgaattacacacacaccagaacactgcactgcagttgctactacatagtctgattttccctttgagagtttttaaataattgtatggtgcaacagaacgattttgttctgaaagtatctaaaaataatctgtatgtttactttattctttctactaatctaggtgagacaagcctggttttcaatagctgttataccttaattgtgtatttgttctttttaattagcatgccatcaaactagatcatgaggattagagtgaatgagatttcattttatttgatatggtctgctttaaacagcttgtgcatgtttatggaaatcattttactgtctagataggatatattaaatatgtagcctctgaagaactctattatgccacgggagagaagaaacatgatgctaaaaacacaaaaggtctatctggatagactacatatcttgctagtatcatgggctataatgtcctcatatatatatatatgaaatatatatagatatgtttatttttgagagacatgaatattagtctcttttaaaaggcacattatcaatccagctgtatgtttggaatcataaccaaaggcagagttcacataatacctaaataagcacttctaagaaaatagttgttcaagtaggttggtgaagagtggtagccattttagtcaatccgtcaagttaagaattctgcaaagatgtagtggtaggttcatggacacctcaacattctactcacaacacaacaattgctttctttggaaataaaaggtatctatagattcagataaggctatttcacagaaggcatgttttcgagctatgagatattatgattcatttcttcaactctgaaatatttgcaagtatgtcaaacccagtagtgaatattttcactcctgaaacttgatgttaagcaacattaaggatacgtagtgttgttcatatgatgtacagtcctttctaactggctcacaaaatcctaatttaattatcacagtactattagccattaccttcatcaggagctgctcattttgaaattttctatgggcctattaagtatttagaaagaaaaaaatgtgtctattttatactgattgaaattaatcactaataataaatttgtatcttttacagggagtctatttaaaatggactatcatgtcttcatttataatcatatactcttcaaagtacaagggtgtgtatgtcatatttaggggtataaaagaatgagggaactggcattagtatttagaaaatgaaacactattttttgcatggctttatttaatattagtaatattttatttgcaattacaaataatacaaaaagagattttatttttctcaagaaaagagaacataattaataaaagtttaaaaatagtattctgtaaattatactgctatagtttggatatggttggtttgacccctccaaatctcatgtaggaatttaatccccagtgtggtggtattgtggtcagtgagatctagtgggaggtgtttgggtcatgggggcagattccctcatgaatggcttagtgtcttcctggatgtaatgagtgagttcttggtctgtgtgcctgtgaaatctggttgttataataaaaagaactaggcatcacctccaacttgctcatgcttcctctctcaccatgtaatcactgcacatgctggctccccttcctctttcaccatgagtggaaacagcctgaagccctcaccagaggcaattgctggcaccatgtttcttgtacagcttgcggaacaatgagccaaataaacctctttactttctgaattacagagcctcggggattcctgtatagcaacacaaacagactaagacatacttaaaaattttataacagaaagcatgatttctgtggctaacttacatttacataagcatatgtatatatacattatataatcatgagtttgtatccacacaggtgttttccctagtaatgccagtcctattctgaattttcaacaaattcagacttacatagtcctaaaaaataataatagaatttatcaaatatgtatgctctaaagatagatatatgagtaagaaattgcttttgatcttagactcatattagaattagaagaagaaaggaaaaatagcattgcagtgctgttggctggctactcggagaggccttccagagacaatcttgatagtcataatttaggggtcctcagtttcacaggtaatcatttaattttctcagcacaaccagagatcacagcaggatatactcaattggaatgattctggctagctaaactctccagacatcaatgcataaaccaatttataaatagaattcctacttgtcaatttataatgaaaaataggagtgccaaacaagccaaacatcctttatcactgtggtctttcccagtcagtaaaccaaaatgaaaaataaaaaatagccaaaatactaatttttactcataatttcaggatccagggtaattatatagaatacatcaataacgagtgccatctagttatcctactctggagaatctatctcaatcacagagatataatttccagatgggtctctgatactggtggcactgtcacttgttagtgccaaaaccaaaccaacaattcatttcaaaattgtcttaaaaattcttactgacctcttagggtttgtgaatgtagccttttatgagacagagtaacaagagcatcagcaaagagtttgctgccatttcttaatgcaatagcatggcaaatgtcaattaagttcctcttttctcataaatctggactcagtcttcaactcattctcagaccaggcaatcactacacgttgattataattgacattttaaatgaaatttgtttatttcagagatagaattaagtttcagtcatgttatatattcaaacactcaagatccaatgtcataaaattcatcccgctttgttatgctgtttctgtgattttagacccaacacttaagagaatattgattcaggttggttgcttgtactgatgattggtcccaccctctatatttaatttcctataatttcattctgaatgaaggccttatcttcacattttaacagcagcttgttgttgctttctatataagaaactgcattcagtttcatctgctatcttataatgtggctaacttacatttccctccacattgatcttactctaaacagtccttttaaggaagattgcagttagtaacatgcaaagaaacagttgaatttcacataatagtgttggctgggaaactatttcttaagaaaatgcaagtgaaattaataatattcgccataagaaaatccaaggattctgggcttcctgatgcaatggtatgtggccaaataagctgattttacacatgtcatagagtgaagtgactaaatctggattactcttttcaacactgatgacgataaagtgtaaaatgaaaactatttaaagtgtaagaaatatctgctctttggtacgtaatttcttaatttggagtaaattctaagtccaggttttgttctttaatgcaaaaataaaacaaatacactcagttgttcaagaaaatctgaaaataggaagttacttcaatgcaaataatattttctttgataatacatatttgactaagacaaatccattttaaaatttaaaaatgatctctgtaagtttttatgttccttggaagaaaagtgttatgtgttttcctttccctagaagtaattgaaatatttttgtgcagttatctgtgttattttggcggcagctatttgcaaaagacagagggctgaagtggagaaaacagcagcatggtattgtgggagagggtgtgcctagaacctgaacctggcttctttctttgtcttttatttcaagacagactctcgctctgtggcctaggctggagtgcagtggtctgattttagctcactgaaacctctgacctcccgggttcaggcaattctcctgcctcagcctcccaagtagctgggattacaggccagcaccaccaggcccggataatttttgtatttttagtagagacaggtagtagagacaggtgcaccatattggccaggctgttctcaaactcctgacctcaagggatccgcctgcctcatcctcccaaagtgttggggttacaggcgtgagccactgcgcctggcctggcttatttccattcataagctaggcctatgagttcctacatcgggattttatttatttaaacttgctaacagttactgaaaatttatgtccagcacaaaatgtttatatatatatatatatatatatataaaatatgttatatatataaatatgtgtgtatatatatttatataacatatataaatatgtgtgtatatatatcttctacaatttctatatgaaatgaacaataattattcccactctacagatgagaaaacagaggttcatagctagtgaatggtggaactgagattcaaacgttagtatctcttatttcacaacccacgttcttatattctttactaccttccacttaaaaacctagaactaggaaaatatactcctttcagaatattgttttcttatatctgtggaagcagtagctagttttctgtgataggagtagaaaatgcagctatatattttactaagaagaattccagcacagcatagaaataatgcgtagtcttgtgaagatgttgacccggaaaaacggagaaatgtttttcaggtaggcctacagtctggagaatgggtgctcaattgaggatattcttagaggagataaattgtcctagatttaggcagataaaacacttacaaaagtagcagcaaattcttctccatgttgtacttctattaaacaaagaaaacttccttaaacacttaaaggctaggttccgtgtgggggaaaaaagaggaaaggaactcatttcatacttgggataaattagggaaaaccataccttctgaagtcacagtagtaggaggaaggaaaggcagctttgcctggcagaatgctacctcaggggagtcagccacagagtgggagaagcaggcagcactaccgtgagtcctgcggcagatcccaagggattcatacttgaacatggaagcctcaccttgaataaccagatgctcgaggcacacaataatgaaacagctgaggttactttgaggactaatttccacttatcattctggtacaggctcaagctattaaaaggaatggtgattttttttgtttgtttgtttttttcaggaacgattatcgaattccgggcattgtattacatcaggaaggcaatgttaactaagttctaagtagtaatgagacgctgtgagtctattatgaactgaatactcccacagctcaaaggaggacagaaagtggtgtgaaaagcctaactttgaaccaaacataaatatatgtttgtgttctttgtatcatgtcactacatttcacttatcagtctcatgtataggcagccattccatttttccattcattttgtcatttttcccttaatggttttcacgatggcttctttttagctttatcttcagttgatatagcataattaactgccacagagtaaaaatattttctctaacaaaaaggaagacccaaaggaacaaagatgccattttcattaattatctaaataaaatgacataaagatacaaaggaaagttatttatctccttaaaaagttttcatttagttaattataatttcatattgctctgttaattgatttcttaaagctttccctagtgctctaggccttttttttcttctgtattcaaacattcacaattatatgagctctatcattttaaaatgcattaaaaaaagaaaacagttaaggtaatatgcattaattcagaataaaatagccatatgtccctgaaaaccaacaaagctattcactattcaattcaacaacggaatctactactttaaggctcactgatttatcctgactcttggaaaagagtgtatacctccgcgcatctagaaataactgaactgtcattcttgcccctctgagtgcaaacagctgatcactgtttaccacacaatcactctcaactactcagttgtttccctcattttctttacaatttccttctgccttctttattcttggcatttatcaaaaacatttcttttgagggtgaagagatttatttatttatttcctaaagaggaaagaatctttagttttggcatgtgcataagtcaaatatttttcacaatgctgtattgtcaggacaaatgttttgcctctcatcctgttgttaaagactggccagggtggggcctactgacattcctttgtattaaaacctcccttccataattcacaaacaaacagttttgatgtaatattttgccaggcaaaccagagccaattattaaaatagttgattcttcccttaaacactagtttgctgtcccagaatgattattattaaagaatgtgagcttctcaaattttttacaagatgtatgatggctaataacaataagctgtaaatagagtttggtatttgggtaggttctaaataaacagaaatataacaaatctctgttgttattttctttgtttttgtttgtttgtttgttttgattttggtatactggtcccttggctccatgagagaagacattcattaattaatatctgtggatagaatattaatatttattaacctatataaaaatattttgtttgtttcttttttcgcatgtaaatgatgatgagttacatgcaaaaaaaaatactttcccaagagctggcgaaatagtataatttaacaattttattacattatcataaaattgcaacttaatatgtgactacagacaggggtgtctctgtgtgtgtatgagagtgtgtgtgtgtgtgtttatgacatacacaaaatcaatgaattggtaatcattatttaataacaacttctaaaaaaacttacaggagagacatagaaatgaaagtagaaatgtctgggcatatttgatgttaatatttcaaccaaatgttttgtgaatgaaaatgaaaaataaatgtctacattttttttctcacatttctctccttagggaatatacaacctctgccagaagagttcaaaaccaataaaaaaaggaagcaaaccccatttaatatatatttttagctaggacttggcaaactcagatgccaggagtagttctacagttctgaatactaaatgttcaacagatggctctccttcgattttatccaatctggaaatgccccaaccggaaacaaagatggtcttcagcctgtcccctttataataaaatatacttcccacacatgctataaataggaaggtaagaattacaatctggttttataaaataatgaaagttaaaggactgcaccaatattctttatgcaaataaatatctccccaaacaagttttcatatccatttgcaagtgaagtatcaagagaataaaagatgaagaaaaaaatgaactcaaagatgtttttaaattcctacttttagcaatttctgggtgacaactctcaactatctagtgcctgtacaatttgaaaatttatatccatacccccacccctacttccaactctcaaaaaaagctacttggttaaacaataaaaccacagaaatctgacaatttccacagcatgaggatttctccactgtaagactgaagatgaattacaatgaagcttaaagaatagtcataaattagctaactgaaatactagacatttcatattcacagaagtgtagcatgtgtttactgttttcattataaacacaaatacatttggggatagtatctaagtgagtggagtcaaaagtagctcttttcaaatagtcaagttttttagctaaaaaagttgatctcatagaagtaaaaagtagaacagaggacactaaaggttgggaagggaagagggaagggaggaatgcagagagatttcttcaaggatgcaaaattataactagataggaggaatgcattctagtgatctgttccaccgtaaaatgactatagttaacaataatatattatatattttctaatagctagaaggatgatattgaatgttcccaacacaaagaaataatgaatgtataaggtgacggatatgctaattatcctgatctgatcactattatatgtattgaaaccactatgtgccccaaaaatatgtacaatgattatgtcaatttgaaaactaaaaattaaaaatttaaaaacaaaacaaatagtcaagctaacaacagttaacggacagctagtaagtaacatagcaaacatccaataagcggtaactattattcttgttttattgttagttgtaatctgctaggcatcatataatcttgtgtctgattaaaaaatatgcaaattttatacttcagcactttaaaattttagccagtgtgggacagaaaaagcaaaactgaagcagaggttagaggttatcctaattgcatttttaaaaatccctttctttctgaccttggacaaatcccaaactttctgttttggttctttcatgcataaaacaatagtccttcctactcagagagttgttcttagtattgcataacatgtttatgagaatactttacatattagatattaatattccctccaactggagtaaatattcttaattatagttttcttatggcacacatcctatttttgttaattcactcaagaaacatttatttaccatttattgtgcctgccagcattccaagtactgggaatacaataatagataaaattgataagatttctgcccttgcaaagcatataatccatgaacaatataattcatggcagataaagatagaaaagcaggcaattacaaagcagtaagattttagatggtgaagtatacagagtgggaacggttcagtgtgtctttttaagaaaggctgaaaaaaacttggtacctatctgaaaatggaaagatgagactaatggaaggacaactgggacgggggagtgcaccacaaacacaaccactgtgtttaaggaagtgaaactcttgcatggctgcttctaaagtatataaaacaaggattgagaaatgatcagacgtaagtaggggaccaactaaacagaggtctgcagccacattaaaaagcctgaactttgatttatgaacaatgaattttaagcaggcaagcgacatggccagattttatttttaaaagtcattctaaaagcaatcacacgtaacggtttcaatagggaagaacgtgttaagaatggattaagaatgggtaccttgaggagactgaggcaataatgcccgtatttgagagtggtatgtactttagaaaaaggcagaaaacatggcaatgagaatggataaaggtgataaatgtaacatgttttgatggtagaattttaaaaacgtggcattttatttgccagtgagtaataacgggcataaaggaatggaaagaattggtaactagtctaatagacaagatgactctaaggtatctgtctcgaacttccaggtggttgctattgtcattcactgtgctagagaagacaagaggaaatatgggttttggaaaattgtttgttcagatttcaacatgttaagtttgaaatgtttggagcactgcaacatgaaacacaggatagagatatggaatggagataaagatttgggaatcatcagcatacagtggaaattagtcatgggaattttgataatccaatgtaagtgtaggaagcagcagaagaaagtgtgaaggacatcattacgatgtccaatatgtaaaaatggacaaattccacaaaaatgactgacatgaaatgacctgacatattggtatataatgggaaaagtgcaatgttataaaagccaaaatataaggaaatgttcaataacatcaagtgctaggaaaaggtcaagcaaaatcagaattgagaaaggtcccaggaagaagacaagagtgaagttttaggtggagaaggccgactgaattcagagatgagaaaataaagtcaggagtataaactttttcataaaaagcctgtctataaagagaaaagtttagctgcagtagctggaggaatacttagaattgaagaaaataattgtattgtgctctgtctctctctctctctctctctctgtatatgtgtgtgtgtgtgtgtgtgtgtgtgtgcttaaaataggaaaatccttaaattttttttttttttttaagatacagtctcactctggagcccaggctggagtgcactggtgtgatctcactgcaacccctgcctcccaggttcaagcgattctcatgcctcaggctccagagtagctgagattacaggcgtgtgacaccacgcccagctaatttttgtatttttagtagagatgggatttcaccatgttggccaggctggtctggaactcctgacttcaggtgatccgcccacctcagcctcccaaaatgctgggagtataggcatgagctaccgcatcaggccccttaacatatttaaatgcttatggtaaattcatgagaattagaaattaaatataattgcttgagagagggggatagtttctcgagaaggcaaaaagggatgaaatcctttgcacattggagggatgtgacttagaaaggaacagaatacctccttaactgtagcagaaagacccagaaacagagatggagacagagagacaaaggcagagtggaaaaaaatgagtgcagaagcaaaaatctttgtagaaattggtggcaagaacttaagaaaattttattttagcggcttctgttaatctaaaagtcattgctgaatttttgagtagaagagggagttagtttgcaagtggagaaaagttgaattttaaaacatctcccaagaagaaatggagagagaattactgagaaacatgaaatatttcctatgtactgagaatccagtggagattgaaaggatggaaaaaataaacttatagtgaaatcaatctttttgtttatttggacttctttggcagtatacagaatttgtggtgtaggagtaaagaaaataaacagttgaattgatacaaatattgacaagcaactgtaacagagagacaaaagggaactggaattgaaagtattccctagagcctacttgaagtgatgaacgaagaaatacaacgtgatagggagacaagtgctaatagaaaaggtctgtcagagggcagtaaagtttaccggcactggattgccctagacatgagtccaaatgcctctttttcgtttcttaaatgtttaacctgggctgagtcattcaaagagatcaaatgggtttaacctcttcaggtaacagttatgcacttatcatataataaatactcaacaaatgataaccatcattattgctattgacaaagtcaaatatttatagttaagataaaatgtttaatagataccacataatacatatcttcaaatgcaaattagttaggttgaaataagcttccctatttacaaaattatatgtgacttttcaaagcaactatactatctccttaaaataataaacttatctttctttggcacaaagccttttttaggagtatgttggcatttttgttttcattttaaattgtctttgaaaacattcattttttaaaaaaaacatgaattagttttcaaaaagaaaagatcttaccttctaataatagattctgaaatgtttagagataaaaggcaatcgatactagagtcagtcctttctgttcttctctgagctgcaaattaactgctgacctttccaggtccattctctcttcttctcattcttttacccccagaaggttgatccttaaagtcatgcattaacctggccctcctttgcctgctgccttccatgtggctccagccagtgagaggcactggcaggagatgagagggcaagagctatcacatcagatacatccatttctcgaaggcaggacctgccctggcttaagcttcatttcaggaaataggacggggaccttataaccctgaagtcagcatatgactgactgtgtccatttagatctctgtatattgcttggaattcgattccctatcatgctccaacgatgttctggaaatctttttgttaactttactactcccccaggacagaatctgccttcttttaaacagtcacctgtaactaaccccactttataccatgatctgcaactgtattgtgtgtaagttcacccaagggcactagcgcatttcctggcccagtggaaaagtaagagttctatatgctgctctcattttctgggtggagtaatattaaagtaaaataatacagggcattttcaagggtggagaactgtccagttaagctacagcatagacagggatatggaaatagcaggtagaaagattaggactctaagtgggagccaaaacattgggggcatatctgaataataccgttacctatttaaacataaatgttgtatatgaaattctaaatatacaaaatacagcatgttcaaaatgaattggtcatttttgtaacagacatcgtgtgtgtgtgcacgcgtgtgtgtgtgtgcgcgcacacgtgggagtgtaagacaatataaataattgaagccttcattcaaaaaacttctgaaataatttctaaaatctagaattccactgggagaatgtatcttagaggcagagacaagtaaccctagcattttaataaatttccatttcaatagctctcaagtacctaagtaattttggtagctagatccagggagcatgaagagatttcaatacaaagtttcaataaaagacaagggagttctgagtgcagtgggaaaaggatagtcaaaggaagaagagtggttgcctgtgcaggtggatttctattatgtgatcaaatattgttattatttatttagagacggagtctcgctgcaacacccaggctggaacgcaatggcacaatctcggctcactgcaacctcggcttcctggattcaaacgattctcctgcctcagcctcccgagtagctgggactacaggtcagtgccaccaggcccggctaatttttttttttttttttgaaacgaagtgttgctcttgtccccctggctggagtgcaatggcacgatcttgtctcacccccgcaacctctgcctcccgggttcaagcgattttcctgcctcagcctcccgagtagctgggattacaggcgcctgccaccatgccccgctaatttttatatttttagtagagacggggcttcaccatgttggccaggctggtctcggactcctgacctcaagtgatctgccggcctcagccgcccaaagtgctgggattacaggcatgagccaccgcacctggactgatcacatcttgaatttcatgatgggcaccaaactgacagctgccaaaaatatcaataattataactatatttttatcctttaccctttagcaaactgtaaactcaagggccaggattcaacatctttaagattataactattcttggttaaggctcaataagcacttgctaaatgagatacagggtctgaaaatcgtctatctggactcttagcctttaatgagtttcttgtatatccattgccccaccttattcactgaaaaggtctgcatcaattatgctattccattataagtttcatgttaatacctaagaaaataagccaatcatccttttaattattatgatttgctaatggatatggagcagaaatcgtttcacagatgatttcagtgaaaccagaaaaagtacctcaaatacttgaagttacaaataataagaataattagtaaagcctcactatatcttcagcagaatttcattctaggacttatagatgttatatgctctctaaattaaacacacacacacacacacacacacacacacacacacaaacatatatatatacacatatgcatatataattccatgagacttatcatgaaaggatcttttaagaaagaaattagtttcctattctatcctgagttttggtttcctcttatataaagtaggcaaaaggagttatcaggattcattgaaataacatttataaaacacctggcacatgattatttcaaaaattaaatgcaatttgttcttgaccctgacacccatcagcctcagcaacttacctgggctgtactgctgcaaggcttcacggacagcccccattactttagtcaagcccaaatttcttcctcatcggttacctatctcagcataattcttcatgaaaacacacgtgctctccctgctgatcgtgtctggttaatctcccaaactccaaccccttccacaaaataacaactgctttccttcctaggcatggttaggtacttctgcctttggatacctagttttaaccatcctgactaaaccattgtataaactcacaaaagcaaacctagctgactctctttttggactcagcccaccggcactcaggtgattaaaaagctttattgctcacacaaagcctgtttggtggtctcttcacatggacgcaactgacagttcttacatttagtatgacttgctcacctaatctcattttttccttgcaagattattgtgagaaaaaacatggcataatatttgcaaaaggtttttgtaaatcataagttactaaacagatagtaatgactattttcagtaaagttactacaatactattccctacatttcaatatctcccattttgtcattaatcttttttttgtggtgattatttcgagagcatttgaggaggggacatgctttactttacaatgcttcatgctttagtgaatagtctggaaatgttgatggctgttgtgatacctcggttcttttctttttggcttaaaagaatttaaatgagacacacagcaaaggagatgcagtatagaataattcactgcaaaagaaaaagaatattttgaaagttaggtgcagaatagacagtacaccctgaaagagaggattcagggtgagcagcttgtaaggatgaggcaacattaattattgcttgagaaactccctttattggagttttacatgattattcaagaggaggtggcaagaggtgttactagcaagcatgttctgggtggtcttctgggtgcacatgcacagtagctgtacatgcttgctcatacatggcatatttcattagcatcttaaatctccacccaggggtgtgtcttttactattacaatgagcaaaaggaaaggtgaaatgaaaatgcatatactttctagaagggaaagtccctactgaagatagctttgcttgaatgagctcaattacaatgagaatgctaaggtttattgtgtcggatgtatggtcactacagttgctgctgccaggaaacatgatcatttccttgactacctctcctgcctcagtaagtcatgtgttacaagctacattgtgttctctcaaaatttgtatgttgaagtcctaatcctagttcctcaaaatataatcacatttcgagaaaagatcttttaggaggtgattaagttaaaacgagattgtacgaaggaatctgaatccaatctgcctggtgtacttataagaagaaacagaaagcctgagtagaccaataacaacaacaacaaaagaaaccgtagcagtaaacagcttgcaacaaagaaaagtccagaaccagaaagctgcatggctgaattctgccaaacatttaaagaactagaatcaatccttctcaaactcttccaaagaactgaagaggtgggaatactaactcattttacaaggccatcattaccatgataccaaagccagaaaaatacgctacatgaaaagaaaactacaggccaatattactaatgaataaaggtacaaaaatcctcaacagaatactagcaaattattttcaactgtaaattaaaaagatctttcaccacaattaagtgggatatatccctggaatacaaggatggttcaacttacccaaatcaataactgtgattcactacattaatggaataaaggacaaaaactatatgatcatctcaatagatatagaaaaagcatttgacaaaattcaacatcctatcatgagaaaaattctcaacaaattaggtatagaaggaaaatttcctcacaggccatttatgaaaagcccgcagctaacatcataatcaatagtgaatatttgaaaatttttcttctaagattcagtgcaagacaaggatgcccattctcacctcttctattcaacatataacccatagtctgtgggttttggggtacacactgtgaaaaagtacctacctgcaaccactgcacattgagttcttgttgtttcaaaaagttctaggaagaagctcagccccagaacaacaaaaaacagtcagatccagagatgcctgatttggagataaactttggcaaattctcaccaccaaacatgctaaaaaccccacccagggaggagtttattgtccatttttatacatgtgacatatgaaaaagcatgatcagcaactgtgcctgtgctgccgctactccacctctaaatgcaatgactctgataaccagcctcatgaaaggctcttttcacctctcttcggggaggcactgctttgagaactatccccaacattttctttacttgttgcaaataataaaaccccttgttaaatccaccttggttgtggtcattagactgtcacccaagcgatcaaacaaaccctgtctttggctggttggtgccctgggggattgagagacatatcccttgtggtcactggtaatctagatctggctaacaaacagtgaaattaactgtgaagataattttttttttccaaaaagatgggtttaaggtctttaggtgtgtgtggtgggcgagacatttcccaaaaccagaagggacccaagtatgcccagaaaccctcaaccttgacaggctgggaaaattttaacttaggagaagaggctcttactacctgggtacattctgggtatgttttcagatatgtttttaaaagaaggggcagctactgtgcccgatgcctgggtaggtaggcagcacagttggagtttgtggggagcatgcagggctgcattagggccccaccagcttaccctcgcacatctgcttatttttcttttacacatcagagaagtaatgatcgcatatcagtatagccaatacctttttacttaaaccccttgggacctatgatcagccctgaatgaggacccaaaggtatcaggaacccaacctctctcccggagaaaggcccattagggtgcattcgctaacgctggaagatctttgggtattccccaatgactgaaaagcagatgattttcttctgcaatacagcctggctgtagtgggccctagcaaggaaccatggtggaatatcaggtcatttaattaccatatcattctacagctagatcttttctgtaagggataagagaaatgggatgtgataccctatgtccagtgttttatggccctgtaccagaaaaggaccctatagatatagtgcaggctttgcactctctaggtgggaccacccagatctcccactaaactgccagagaaagtgctcccaatcctagagagccccccagatgaggaggacttcctctgctccataaacctcaggaaacaagaggacagagagaggacggctgtcatcccaaccacctgggccttccccacctctacaagagaagtcacttccacagccaaagtaccaggggcttcctattcccactcccagcatcaatcctcctctcccagttagcgtaaccctgagtgggaactctcagaagctaggaggcagatgcttctcttttgacagtttctgaatgggaatgcacatttcatctgagtgcatgtgtcttttctgctctcaaccattaaggcaaccgcagtctcccaaaccccactgaggtaagcttgacctgtacaagccaagagactgggtatacatcaagaactgaaagactggcctcaccctggaccagctcagcctgcatggacaaggcctggccaaatgcttctaggtattcattcttcccttaaactccagagggtaacaccttggattcatcactcacgagagaagaaagcccaggagcccctagaggacccctccccagcacacacttgtgaacctgtcagagatatcaaattggttttcagaagaaaaggctcatataactaaaatgtgcccttgccattctctcaacatactaggcatctttctcacccttgtaggaacccctatgcttatcgccctctttcactctgttaggtcctcaattgatagtaaagccctccatatgacaccttaaaatgaaccctgtcttttccttatgcttcttgggcctcttagttcccgtggccagtggtctctgggaggccagtgcaatagtaaacttctcccatgttatagctggtagagataatctgtctgaatgttgaatatgccatgcgtatccccagactcagatggagtggcctgttgcttaccctttgcaggggaacattaacaacatggtggaaagaaggggatccaaaatactgcctgaacctatctcagcataaaggggcccttccctgtctgtgggttgtgtggacctcacccctaagggcaatgtcaccatgaaagtagacctcatttatttaaattgttcagaaaaaagagaaaagcaccaaatgcattcagaacaagaaggtaacggaggcaagtctgatgtctaccctccttgcctttgacctcactaaactttgcattctaaacaccacccattggtgtgccctcacagacagctatggggactcgatagaccctaacaccaaatgtcacaatcaatgtaaaatttggtaagagataaacaaccccctgcatattgcagactatcatatagcactcctcgagctgtgggaagagctccattggaaaaataaatcttaacggagattttacttttacttagcggagatttgtggagaatccttatcttctcagtgttatgagactacttctcccctttggggtccctaattacttggttggttaaaccgtttcctcccctccacaacttgcagtggattactctgttgtacataatgtaatatacctaggacagtgcactgagagcctacaggggctcatctggataatagtccataacgaaaccaaccactataatagacccaaaaggactattggactaatcttgtcagacaccagacttgctgtagggctggctgccccttggggggtttgcatgccatgagatcaccctaaaaaaatttcaccctatcatccaacactttggcagctaacacagggaggctctcgaaaatgtgcatatttctccaaattcactagacagtgtagggttggacaatcaattggccttagactatttactagcagaacagggaggggtatatgcagtcaccagtaccttctgttgcacctgggtaagcacctctgggaaaacagaggttaacgtaaaagaaatattcagatacacagaatggctgcattccttcaaccagaagggtagctcaagcaacaaggtttgcaagacagtcaagtccactatacctcacctcacctgggttcttcctctgttggggatactagtgaccactgttcccctgttactttttggtctttgaatatttaaagtgatagcaaactttgtgtcttccagacttcaacagtttcatctctagcttgtattacaacaaaaatatcggcccctttgaacaactccaggtgaccccaaaacttacttgaactcagtagcgcaagagtttcactcttctaactttagggggactcaatgcccctggtctacatgaagtagttacagaccaatgacctccagctctaagaatgaggagtagaatgtctcagagggggatttgtaacccatagtccctgggttttctggtacacactgtggaaaaagtgcctacttgcaactgttgcaccttgaggtcttgtttcaaaaaattccaggaagaagctctgccccagaaaaccagttggatccatacatgcctgaattggggatgaactttggtgacctctcctcattagtatactaaaaacctcacccagagaggtgtctattcaccattttctacgcatagatgtggaagcatgatcagcaactgctcctgtgctgcctttactccacctctgtatgcaatgactcagctaatcagcctaataaaagccctgttttcatctttctttggagagtcactgctttgggaacttccctagtggtctctgtacttgttaaaagtaataaaatccccttgttaaacctttcttggttgtggtcattagactgtcacctgccaagcaatcaaacccacccgttgtgcgggtatcaaatatagtactgaaagtactagcaagagcgatcagacggtaaaaagaaacaaagggtattcaaatcggaaaataagtaaaattatccctatttgcagaagacatgatcctatacgtagaaaaccctaaagacagcaccaaaaccttaagaatgaattaatgagttcagtcaagttgcaggatgaaaaatcaacatacaaaaatcagttgcatgtctttacgtcaataaagacttatgcaaaaaataagtcaagaaaacaatcccatttatgacagcattagaaataataaactacttaggaatacatttcatcaaggagttgaagaatctttacactgaaaactgtaaaacattgatgaaagaaattggagaagacacaaatatgtgggaagatactccatgcccatggattcggaaaactaatattgttaaaatgtccatactatctaaagtggtatacagattcagtgcaatctctataaaaattccaatggcatttttcacttaaacaaacaaacaaaaaaactctaaaatttgcagggaaccacaaaagacttcaagtagccaaagcaatattgataaagaaaaacaaagttgaagacatcatatgtcctaattttaaattatattactggccaggcacggtggctcacgcctgtaatcccagcactttgggaggccaaggcaggtggatcacgaggtcaggagatcaagactatcctagccaacacggtgaaaccctgtctctactaaaaatgcaaaaattagctgggcgtggtggcacgcacctgtagtcccagctactcaggagactgaggcaggagaatcgcttgaacccgggaggtgaaggctgcagtgaactgagatcacaccactgcactccaacctggtgacatagcgagactctgtctcaaaaacaaacaaacaagcaaacaaacaaacaaaaaacattatgttacaaagatatagtaaacaaagcactattgtgctgccataaaaaccaacacacagactaacacaaccgaataaagggcccagaaacaaactcaagcatatatggttaactaattttcaacaagggcaccaataatgcacaatgaggaatggatagtttctccagtgctgttgggaaaactggatatccacaggcaaaagaatgaatttaagaactttatctttcaccatacataaaaaaagctactctggaggctgaggcaggagaatcacttgaacctgagaggtggaggttgcagtgagccaagattgcgccactgcactccagcctggactgcagagcaagactgtctcaaaaaaaaaaaaaaaaaagaaaagaaaaaaaaacatgatgaaagaaaagtctctttataccatccttagcaatggttttttgggtatcacaccaaaagttcatgcaacaaaagcaaaaataaacatgtagggatatatcaaactaaaaggcttctgcacatcaaaagagacaacaaaatgaaaactcaacttatagattaagaaaaagtatttgtgaaccatatagctgataaagggttaataaccaaaatatgtaagaaattcacacaactcagtagaaaaaaataaaacacaaataacttgattaaaagatgtgcaaagggccgggtgcagtggctcatgcctgtaatcccagcactttgggaggctgaggtgggcggatcacctgaggtatggagttcgagaccagtctgaccaacatggagaaaccccatctctactaaaaatacaaaattagccggatgtggtggtgcatgcctgtagtcccagctactcgggaggctgaggcaggagaattgcttcaacctgggaggcggaggttgcggtgagccaagatcgtgccattgcactccagcctgggcaacaggagtgagagtccatctcaaaaaataaataaataaataaataaataaataaataaataaaataaaataaaaaattaaaagatgtgcaaaggatctgaatagacatttctccaaggaagacataaaaatgggcaacgggtatatgaaaaggtgctttcccaatgagagaaatgcaaattaaaacaacaatgaaatttcactttacatctgtcaggaatattatcaaaagacaagagataacaagtattgacaagggtatcgagaaaaggaaacctttgtatactgttggtgggaatgaaaattagtatattcattatggaaaacagtatggaggtttttcaaaactttaaaaacagggttttcatttgacccagcaatccctctgtagatatatacccaaaggaaatgaaatcagcaccttgtagagatatctgtgctgccatgttcattgcagcattactcacaacagcacagaaatgaaaacaacttaagtgtcaggtggatgaacctgaaagacatgagactaagtaaaataaatcagatacagaaaggaaaaggttgaatgcataaaaacagagtaacaagtagttaccagggatgatgggggaaatgggaagatgtaggtcaaagggtgcaaagttgtagttatgtgggactaataagtctagagatctaatgtacaacataaaatctatagtcaatcattgcataataaaaatttgctaggagagtagattataggtgctcttgccacaccaaaaaattgtataataactatgtgaatgaatatgttaatttgcttgccagtagtaatcatttcactatgtatatgtatttcaaaatgtcatgttgtactctctctctctctctctctctatatatatatatatatatatggcagtagtaattacaacacacaaataaacatcagagtgcttgtgtgcgcagaggtacaaccatgtgaagagtcatcaggagggtgaccatctgcaagcgaaggagagaggcctcagaagaaagcaaccctgccagcaccttgatcttggacttccagctccagaatggtgagaaaataaatttctgatgttgaagccatccagtctgtggtattttgtcgtggcagctccagcaaactactataccatgcctaaatgcagagaaaactttagggttatttaaaactcttagtgctgtctctgatttctggttgttttttttaaagtatgttgctttcacccccaaataactaactctgcttctcccctatgccttcagatttaaagcatgattattatccagtgccttctaatgggcttcagaatgtgggtttccttacccttaaaaataagagattggaccagatgagttcttggactgcttacataggattccattcttgaatcctttgggtttgaactgaggactcagttgtttggttgatcattgatctgcatacctgggcagtttatgagaaagttttcaccagaatataggaaaattagaatcatataaggatatcagagtatgattttcaaaaagctggaattacctaattcgaagcactcttcttcattctgtgttactatccttcacttttattttgattttctggtggtaaaatatgtccttcctttaaatggaaatgatagtgggttttgttttaacattatactttgcaaaatagaaagtttgtaacctccaatgagacagcatacatctatttgcatatatatcactcttccatttgatttaggagtcctgaatcttgaactagaagcctggcttggccttctatcccaagtggccttggatttcattctttctcactcaaatgaatttgcattactgattgaatctcataaagggaatatagacatcttcatggattttgaagtaccttcattttccctttgtttcaaagaagactcctctccacatacatattaaaatgaagttataaatactcagactctaaaaataataaaaatcaaataattttgaaggtattgagtgtgtatatctacagtaacacatcaatttactcaattttcaattaattgggttatcatttatataatgtttattggctttaaaatgcatggatttgctataagtattctgccaaataaatggaaatttgaggtattgatatttttaatgtgcttaatattatccagctatttgctgcgttggttgcatttacttttctttcttttgtgccttatatatattttcaccacattgcatttttttctaaaaagattactctgaatatataagattataaagttattaggtaaaaactaaaagtcatcagtttctatgttttcccaatcattttgaagaaatatttcatcatatttaacacaacatttcaaatttggctatgtttttatcagtctgatattttgcttgctattactacactcaagatggaagctttctcaccagttttgacaataggtattattttattgtacttatcctgaattacttcaaaacaaatgcatcaaaaactaccatattagtgtattgaacactgtcagtaaaatctcattccgtaggagcacttagaactagaaatgcttgatagtttttgttttgaattgaatatatgcatccttgatgcaaaagcaattagtaaagcttttgaaaatagtcaataatttggtcatactaacacaattttctatccttgcaaaagcagcctcttttctttcccttatgaatagctgaagatattaatgtctctgtttatcatcttggtaatgatataaatatctagtgaggatgtcttccttcacttttataatccttattttaatatattttatacatactattagacttcctaacttattaagaaatgcttgactatctgggttgtatcaaattatttatttatttatgtgtttaatttatttatttttatttttattttttgagacggagtcttgctctgtcgtccaggctgaagtgcagtggcacgatctcagctcactgcaacctctgcctcccgggttcaagcaattctcctgcctgagcctcctgagtagctgggattacaggcacacaccaacatacccggctactttttgtatttttagtagaggtggggtttcaccatgttggccaggctggtcatgaactccggacctcaagtgattcgcacacctcagcctcccaaagtactgagattacaggagtgagtcaccatacctggcctgtatcaaatttatatacacaccaaatactgacacaaatttcaaacagcttctgctcattgaattataataaaaagtcacacagcatggtaaatggattggtaatcatttactttcttttataaacaagggctagaagaagaaagagacaaagagggaaaggaaggaaccggaggaagagaaagcaaataaggaagggaagagaaggcaggaagaaggaagggaaggagagagaaatgaggagagagaaagagagaaagagaaagccaaaatagatgagtgcaaagagtatttctagatagcatctaatttactgtagaatgtatgtatttaaatacatattgcatgtctaacatgtatgcttttactttgcattttaaaaaatttgaactatataccttaaagtgttcataaatgtatagatagtaactgtctaaataaaaatgagcttattaaaagttatgtgttaaaggacaaaaataaaagaggacctacaccaaattacatgattatagatgaaccacagatagaatctggacagtctcaagtgtggcttcaccatctttatttcaggtaatcatttcagtgatttcctctgagtttattgtttctacttttaataatatctatgagtcatatctaaagagtaagtatacatgtaatgacacaatactgaatatgctaatttgttaatccagaattatattatatttatttatttattttgagatggagtctccctctggagcacaggctagagtgcagggacgccatctctgctcactgcaagctctgcctcccgggttcacgtcattctcctgcctcagcctcccaagtagctgggactacaggtgcccaacaccacgcccagctaattttttgtatttttagtagagacggggtttcaccgtgttagccagaatggtctcgatctcctgacattgtgatccacccgcctcggcctcccaacgtgctgggattacaggcgtgagccaccgcgccggccccagaattaaattaaatgatagagcacagctctcctgttgaatgataaccaaataagcaccaaataaagtcttttctttaaagcaaatgcagatatactcactttgttttgttggtgttattttaaataaaaatggtatatgtttaaacaacaaactaaaaaacaaaagcaaatacagatagttaaaagtgagtgatgctaatctgcattgtacagatttccactgagggaatttgtcctccaggagtatgtcctcttgatattttaagttgaagcttagagttcattttcccccataaacaacatgaggagagttgcctagtagagccaaaatggaattattagtagtttataggtaaaatagaatttcatggtctcatctaaatttgaattacccaatataacattgccttcatgatatagtatgtatgaattccaagaaacaatttaagtcaatttgaagaaaacccaactgtacaaaataaagttcctttggggaaatttgtagtttgttttctacacccttcaatgggattggggaactaaacagttgcccaagcgtattatcatataaatcaaataatactttcatctccatccgcctctcaatagtatattatttctgaaagacttaagatggggttcgtttttcttccccttctggattagaaggaagacatgcctttctgagcacagctggaaaatgtgcatcttgggggcccacccctgcctttcccttctgttaaggttctcccgtggaagctgaagcttgcagtatgcacagctgctaaggcggagataactcttcccacaataaatgaagggagctcttcactgcatggaacacaaagagttcattgtactgggatgggcagaattactgcagctatgctgctggcagcgcaacccattgccattcgtaagctactcagtggccacgagcagtactggtagacagaaacctaggaaaggcctagacagctcagaaacattgcacgacatttctcaaactgataaggaaataatattctcattttattctcctttttttccccacattaagcagtatgaggcattcaggtgttctagatagtaaatggtaactaattctgtttccaagtaaaggtgtggccaacatatttagagaggaaatccagaaggaaggacattaatacgcagtcttagccttctcttccttgcataacatactgcttcattggaccatttaaataatttttcctcctccttctgtttacaaatatttatagctatagtatggcaacatgtcctcatttaatgccatgccaaggcatattcattcttttaatatttcctcatacatcaatacttctaactctttcgtcatttttgtggcttttctcggaagctcttttaatttatctaaatcttttttagagctaaggtgccaagaactcaatcacaaagacaatctcaataaccatgtatgaaggaaaaagaaaaggcggaaaatcctagctccaaagcacttttataggtcatacttccagtaactgcagttctgactacaaggtctattcttcccacagggcaagaaaaattcaagcgttctttcacatagctcaaacttccccagatggagggctttggacttttgttgttggagggaggtcaggaaggctattggaagagtgctgaattagaaagtcccaaataccaatccccttttacataatagtgtcttttctgcagaaagagtaggaagaattttaaaatgtaaatcccctaaggacatctggctctgatgtattagtctgaaaaaaaaaaatacaaggaaaagggggctgttctagaatttccttagagagttgattattctttctagtcctttcgggatgagccagggtgaactaggcctcttttccatgatctctattagcaagagccaaaataaaagccaaatgaggatgcctacctgattattttcttcgcccttcacctggctacttttaccaggaggttatagttcagtaagtgctctactaatcactcaataaaagggacagtataacatattcgtctgttacaaaaaatatgtactatatttttaaagtatataatactaaattttgtcttctggctctttattataaatcagtacagattgagtacagtttttattattgttattattatttgcctttttcaagtgaatttattatttctttagaagcacttaaaatattacatgaacttcaagtcacgtaacagtacttatctccaagcagatttaaataccttaaagattatgtttgatactatgttttactaaaagttagatataatgaaattacttttagtttgactttggcctactagttttgcatacaacaaaaaaatagaatttgtatgtgaaaataaaaagtaatgagcagaaaccttaatctacattgttagaactaataatgtgttccatagactaatcatctgtcatcaagtaaaagactgacagtagtgaataaaatctgagttcattagccaaccactgttaacattggcagagtaatgcaaatataactgagctatcttaattattctttattttatgataaacagttaaaatatactgggattaagtaatccattaactcttatgagtaatttcacaggaagttgtattctttgtctttgcaagagcaatcatccatcttgtttcagggtatgataagtttttggaattttctaaacaatttaaatctttcctatagattgctatccctaaaaatatttgtctctggctgtaccaaaaaagagtatgaaaccaattaagagttcatgtaaccaaaatgctcaaaaaagactaacgtacaacaaacccttcaatagcatccaggaaatatctttaaagtcataatttgtttctattttcctataaagtaataataaatttgatgtcacaacgaccaaaaatactgtttcgcaggtaaccaaatgccaattttctaattttgagtaacactatcacaaaataaaactatagaatgataggccataaactaccagaggtttccatgggcaagccattctaaaaactgtactattctttttcttccacaatttgccaaaatcaaaacaaatctcatctacacaagagcaacaattaccaacatacgtttcttgacctcctacctcccttctgaaattcagttttctctgctttcgttaatttccttacttggctaatatctcttttgcctttctccaaaccttacttcaggtgactctaaataagattatctattactaaagcgatgttctttgtatctatctgggtaagtaaaaatgtatttttccaaaggcaaagtgttcttgaagtatagattttattatttttccctaaaaatatcaaagtaaagtaccctatgttagccacacactttctaaaaagaaagatatggccgggcgtggtggctcacgtctgtaatcccagcactttgggaggctgaggagggtggatctcctgaggtcaggagttcgagatcagcctggccaacatggtgaaaccccgtctgtactaaaaatacaaaaaaattagccgggagtggtggctcatgcctgtaatcccagctactcaggaggctgaggcaggagaatcgcttgaacccagaagccagaggttgcagtgagctgagaccacaccattacactctagcctgggcaacagaaccaaactctgtctaaacaaaacaaaacaaataataaaaattaaaaaaaagaaagttatgctacatgaatctggaactgaaagaaataaatgattgtatagacccagtaaacactaactttaacaaaatatatttacaaattaaatatttctactaccatctagattagagaatagaattgaataatcatacagtgtaataaaattggatcactttgcctatagttgaaagcaagagagaattaaaattctgcattagtcttgtgcttgcaaggttatgctttgcgggggcaagaacatgaaatactgctagtcgatggcaattttatgtcacttgttattaggatgtaagatatataactccatttattgtatctaattttcataaatagtatctaaatgacaccatctgttctaaagaatactatcacattttatatttattcaggttttacgttgtcattagtgtaaaactttgagttcagaatgaaagagttttactagaaagcgcataattagagagttcatataataataacatatgcttggagaaaagtcatgttaacttgctttctgactttaaaaaatttaacctaaatttataccttaaaaaatcagcaagtgacttccaccattttttatgccatacatgcactcctaaacacattgcatgaattttaaatacttattacttcttttctagattataagcataataatataaaatgcagaacaattttgatactacaaaaattacaaaataaatgttaaaattaatgaataataacattattagagataaacactactatacaatttggagttttatgcctagatagatatctatttacatacgtagatagaaaacatgctggatatatagttttgcaatacagcttttcccccttagtgatatatcattaaatatttccaatgacagtaaaaatcctctgataacttcaatttaaaacaatgacatatccatattatgatgatatcatttatttaattccactccaaattttaaacaatttttagaactttaggaacaaaaaataatacagagatgaagatctttgtacatataattttgtccacttctctgaaaacttccttaaaaaaagttctggaaatggaagtacttaaagagaaagaatagtttttaagattgacactatttcctaatggcttttcaaaaatgtagtaatcattataactccttctcacagcaatgtatgagaactcagggttttcatcctcttaccaccaccctccaccctgcagtcctccagccatctccccggtcccgacaccaccagccaacaaaaagatgttctcatagtgtcatagtgacagatgaaaaatgatgctcactagcattttattttgcatttcatttaattataaataaaatatgattttttcccatcaatatagtggtcatctgcttttcttttaggaagtttaataacttttttagattaatcatttttaaatgattaatcattaaaaagttgaatatttttcatcatgatttgtgagctaattttatattaagaatattatcccatttatatatttgtagcatataactaggcacttagtttttaataggtttataatatttttgtatatacaagcttttagacatttaggtaatcatttcaatagaactttctttgtgacattttctattatttaatgcctaaaatgttattccttattcagccatctttttaaaaaataaatcttcaataattctgacatttatgttgaaatatgaaggcaaaagacatattcttttttcgtttttttctcaaatggtaaccttactttttcaacatcattcaataaataatgaattcaatcattcaataatgcattcaacagttactcattcttgccatgagcttaatattattatgagtgatataatccagtggtgaaacaaagactttactcttagaaaatttgcattccaggggaagagaaaataacaaataattacataacttactgtgtactgcagaaaaacaatgctttgaataaaaaaaaaagcagattaagagaaagagaggactaaatgtttgtgaatggagggagagatttaacataggttacaaaaccctctcttatgaaaagaaagttcatcagagacctgtatctgaatatctgaattactattttctaggtctacttactgttttttttttttttttttttttttttttttgtgtgtgtgtgtgtgtgtgtgtgtgtgtttaagatttttatgtttgggcattcaaagagaaatttagaaagttagacttttctattttaaacagtatccacatgtaagaatgtgttgtttattgaaatagttttgtttatattgtatataattcaaattcattaaacttccttctagcacagcttatatttatttcttttctctttttgctctgtcagtatcctctctgtaaaccaccccttatgtaaacaaataaataatacaaatcatacacttgctttaggtgtccaatgactttcaaacttcaaataatacatcctcttctgtattcccattttgtttagttgatactgcactacctaaccacttcttaaattttgtcttatatttttctgattaatactgtcctgaatgtacattttatgtctcgaaccttattacaaattcatcaaaagcagggaatatattctacacctagttgatagcacaaaaggaattttaaaatatcctttgacttgaaaaacttctttaaaaacatactaataaaacgaggtgaaaaaggagttctataagataataataattttacaaattgaaatacacttgaaaaataaatgatacttttatttttctctcaaactttaaaactgcaagccaggattccctgctaggacatgcgattttgttataggaagttttgttgaagacagtttattattaagcaacaattatgatatttttaaaaataaacataagccattttcaaatgctgatctttctaatgcaccgaaagaatttttaagttttagtgtaaaattttaaaacctaaagtactacttaaagtctcaaatacagactcaagttatttggaagtatcaatctcttttagtcatctaaattaatgtactgactctccagtcatgaactatattcaagacatgatttaatatattttctcataaaatattaacattataataattaatctccttaccccaggcacatttttatattctgaataagagtaagggaagcacagaaccagttaaatagtttgaggatggtaaggcaaaaagtagttccctgtatggaatatctctgaaattctctcacccccaaaatgtagtaattaagaagtattatatgaattttaaattttccatagtcatagtgattttccaactgtaagaataagagattctcattattactgaaagggaaccagaaaataagaaacaccaagatagtttctgtattgatttataaattctaagtttctaggtttataaattgagatgatttatgttataacatcatacaaatcagtattcctacctttttgataaaaatatctattagcattatttttcatttcatatctgataacattataactaaccttttttgaagaaaacatttacaacatatactgtaatctttcaattattattttgaaatatgtttacaaaaataaaatgtatataatttcattttataaaatactctcaaattatataaagcatctgatatttagaaaaggaactaagcaaaaaatgttggatattgcattaacatcaggaatattactgaataccttagaaacattatgtcctttgtataaacatagtattagttgaaatgcacttaagaaatgctttaaaaatcatatgaaaatattctaccaccagcaggcagaaaaagtgtttctgagcaaaccacaatgactgggggaaaaaagaatagatatatttgcatacattataaacaataatggcaaaaaacaaaaaaaagtcaaaaatcaagtgataaaatatttgcagcacaaatgataagcaaatgttaatattcctaatatgtaaagagctccaataaattgtaggaagaaaacaaacaaatttgatagaaaaagggcaaaggaaaagaattagcaattcacagaagaggaaatttaaattgctaatcaacatatgaaaagatattccctctcatttgtagtcagagaaatgcaaattaaatcaacaacgaaatacacataaaattggcaaacttaaaaagatttactacatccagtgctggtggagagactgaaacagttactctcctgaattattggttagagtatgaattgctacccaccattgtgaaaatgaatttagcaatatatagtaaatttaagaattactattgattcagtcatcctaatttggggaatctagcctatagaaattattgtattacttataaaaacatatgtaaaaaatgattatcgtagctttgtagctgcaaaaaaactggagggaaaataattaaatttgactatccaatgataggcaaatgttcatatacattttattatactttttattataattttatggaatgctgtgtcactaggaagaatgagtcagagctatctcttttggcctagaggaaaactcatggtatgtttttaaatgataaaaaaaatttgtattgtagaacaatgcaaataccagtattatcccatttttaaaaatcatataacaaacctcatatgtgtatatgatacattttgcacttgtataagtttgtatatgtgttttatatgtttataagcattcaagaacagtatagaatatggaatgacataaactaggctattatctttgatcatttggagagttttgaaaagaagaaggggtgggagagatttttaattgttttatttaaatatagcaacactaattcattcaattagctttgggaaaaattgtgacaattaagatcagtaaaggataaagtatataaatcccaatatatcactttaaaaatatctgtgatcctaggtatatatccaagagaaatgaaagcatatatgcatacataaactcattaacaaacattcatatcatcactatttataccacctaaaaggtgaaaaaaaatctattaacttaaaatgtggcatatccatataatgaaatatttttggtaataaaaaggaatgaactactaatacatgatacagcatcagtgaaccttgaaagtattaagctaaatgaaagaagcaagtcacaaaagaccacatagtatatggttacgttcatatagacctccagaaaaaggaggcctatagagacagtaagtcaggggttggctagggctgggctgtggggctgtcaagaggaagatggtgagtgactgctaatggatagggggtttctttttggaggggacaggaggtgaaaatgttctaaaattagatttcggtcatagctgcacaactttgtgaatctactaaataacattcaatgttggcctgaaatgggtgaattgtatggcataagaataatactcgatgtagctgaaagaaaacctatgaccaattttttcaacatgataactgtttcttaacaaattcatttttaaatattatactcattaactaaaaaccttataataagccatcaaaggataataaggtattccatataaataaaatttcctgttagtgaagaattcccacttaaaatgtcaacactttctcttaattttacatatttgggatgagaaaatatctttgttataaacctacttggctttttaagcagtgtctaataataatatgccatatttttcttgaaaataggtgtcaataataggaacatcatctttaatgttatgactatgtagtttaaatataatacaccaacatttcccccaggatttcccactaattacctttgatggtaaagatcattaaatatacatctaaataagagtgaaagaataaatctcatttaagagaagtcctgagttctcatgaataatgtacctgaccttaaatgcttacatattgtgagataaattttggccattcagatcttttccctcgatttctggttattcactctgttctatataagcaagattgccagaccgtaagacacatgtgatattaatatctcaattttaaatctaggcagggctcctgatactcttggatgctcaaattattaagattttcatatctatttttatcctgttggtgatttaaatcacagcatgaatatctttttttcagtacagagtttgccaaacgctgttgtcatcaatgaaggcagccactaacattttgaaatgaaacatcaaaatggtttcaaattctgtgacagatcaatttaggagtattatacaagagcaagaaaaacacagactggatttgcttctgtggttttctgtacatttctttctcaaacggatgaatgttattatttagaattagaaatatgtgatcctttctgttccaatctagtatttgtaatggtatgccttctaaaatttataaccaaactaacttattagatgttaagagagtttaaatataaaactcattacttatccaagtgtgagctttgactcgattttctttaaacctgaccttatccctacaactaatcatttacttatatttcaaagatttttttcagtgtgttatagtggtaagagctttaattttgaagtcaaatatagggcttatcttaaattctggcttaatttatttctaagcatttacttggttacttaacctttcaaaacctgttttttttaatttttttaaaattttttagaaaactataaaaatagtatctacttcctagttcttcagagggttcaactagtcatcattaataaaaagactttcatatacagtgcctcttaggaaaaaaaaaaacatttagtaacagttaattttctttttcgtaactgcttagcctacaacttccatcttaatcaaagcccttatcactttgtttgatctctatacagaatactgctgccagctttatcttcctaaaacccacttaacgtcttcactccttaaaaatcttcaatggcaggtgatgggaataacttgccaaataaactcaaaatgctttagcttgacctttaaaatcctccttaatctggcctcatctttcttctattccaaactgatgtactcatgatattttaaataacttgctttccctaaatctgccattttctaatgtcagaccttaaaaaaaagaatattaacttttaactcatttttctgattctataactacattttacagtttccttttccattaaaccatctaatgacatcttactcgtccaatcctcgcaactatccagatctcaatttttagttacctcataaaacttttcctgattattctaattacaattcacatctaccattttctaacctctagaacaatggatttagagtttacaatgtaactattttgtgtttctatgaaatgttcaggaattatttgctgtgatttatcatttatgtgtaatttatgtgtacaacataagtaaagttatattttacccacagctgcccctcccaaaagaacctggcccacagtgggtaatctattacctattaccatgtggaaaacttgatttgctcttatttagtttccacccaatcagccaatgatactctatttacctatatttacaagattattccatgtaatgcatgtttctgaaacatcaggaaaattaactcccactgtatttacttcaaaactataaacaatattttgtagcatattcctttaaacagaaaacacaatttatttcaatgtctctgtcccaaagcatgttcatcagtctttattttatacctactacattttaatcagcttgggatttttgatcatttaattttgaaaacctgtgtgaatagttctaagagttactgcaaaacagtgtgcctgatgctggagctcatcttctgcaaatgagccaaatattttacacatacttattctatacttgtttttctggaaaatatcattagtatccatatttacatgcccagtatacatacaggccaatatatctaacaaaaagaaaaattaaattgtataatccaactattattggtcaatctcagatctaggtttgttgtcttattcaagttgtaaaaaaacaaaaacaacataaatttctacaagcataactttatttttagaacaattttcatttaatgctaactttaaaccttatcttctgtgcctttagttctcacctcagtaggggattaaaatctgataaatacttgctgattttcttcaacccctttgattttgagttatcgttcttactctccattttcctgtcttctttgtgtatctaaaaactgacatacaacctcatgcctcataggtatcatgccatttcagcaaaacaatgtaattagttacattgcaaaagtttactgagcagtcattttgtacagggaactaagacactgtagaaaaaatgcaggaaaaaatgcatagccttgaggggtttcaaaatctgctggaggtaggaaagggggggcacaaactttccaaaagattaattacaaacaattgaaaagattgacatgctatctactccacatgtaaagtaacaataagagtgctggtggactatagaaaaaataaagaacttgttaaagaaaaggttaaattctttggatttgaagtaggcaagttttagagtagtaagccttggatgtaataaaaatgaaattaacattaaaaagctgtggttttctgtggagaggagaaatgggtacttagaatgagatgatatataaagtggcaaagaggtagattatcaaaaattgaaatttagggtataatccattgatgaaacagaggattcataagattaaatgtgataaagctgaagaaaaatatactggattacagtcattccaagatggccaaatagaaacagctccagtctacagctcccagcatgagtgatgcagaagacgggtgatttctgcattgctaactgaggtaccgggttcatctcgctgggtcttgtcagacagtgggtgcagcccacagagtgtgagccgaagcagggtggggcatcgcctcatccgggaagtgtaaggggttggggaattccctttcccaaccaagggaagcagtgacaaaatggtacctggaaaatcgggacactcccaccctaatactgtgcttttccaacagtcttagcaaacggcacaccaggagattatatcccatgcatggctttgagggtcccatgcccacggagccttgctcactgctagcacagcagtctgagatggaactccaaggtggcagtgaggctgggagaggggcatctgtcattgctgaggcttgagtaggtaaacaaagcaaccaggaagctccaactgggtggagcccacagcagctcaaggaggtatgcccgcctctgtagactctagatctgggggcagggcatagctgaacaaaaggcagcagaaacttcagacttaaacatccctgtcttacagctgtgaagagagtagtggttctcccagcatggagtttgagatctgagaacagacagactgcctcctcaagtgggtccctgacccctgagtagcctaactgtgagacaactcccagtaggggccaactgacatctcatacagctgggtgcccctctgagacgaagcttccagaggaaggaccaggcagcaacatttgccgttctgccatgtttgctgttctgcagcctctgctggtgataccagtcaaacagggtctggagtggacctacagcaaactccaacagacctgcagctgagggtcctgactgttagaaggaaaactaacaaacagaaacaacatccacaccaaaaccccatctgtacatcaccatcaacaaagaccaaaggtagataaaaccacaaagatggggaaaaaacagagcagaaaagctgaaaattctaaaaatcagagcacctcttcttctccaaaggaacgcagctccttgccagcaatggaacaaagctggacagagaatgaatttgatgagttgagtgaataaggcttcagacgatcggtaataagaaacttctccgagctaaaggcagatgtttgaacccatcgcaaagaagctaaaaaccttgaaaaaagattagatgaatggctaactagaataaacagtatagagaagagcttaaatgacctgatagagctgaaaaccatggcaggagaactaagtgatgcatgcacaagcttcagtagccgattcgatcaagtggaagaaagggtatcagtgattgaagatcaaatgaatgaaatgaagtgagaagagaagtttagagaaaaaagactaaaaaaaattgaacaaagcctccaagaaatatgggactatgtgaaaagaccaaatctacgtctgattggtgtacattaaagtggcaaagagaatggaaccaagttggaaaacactcttcaggatattatccaggagaacttccccaacctagcaagggaggccaacattcaaattcaggaaatacagagaacgccacaaagatactcctcaagaagagcaactccaagacacataattgtcagattcaccaaagttgaaatgaaggaaaaaatgataagggcagccagagagaaaggtcggttacccacaaagggaagcccatcagactaacagcggatctcttggcagaaactctacaagccagaagagagtgggggccaatattcaacattcttaaagaaaagaattttcaacctagaatttcatatccagccaaactaagcttcataagtgaaggagaaataaaatcctttacagacaagcaaatgctgagattttgtcaccaccaggcctgccttacaagagctcctgaaggaagcgctaaacatggaaaggaacaactggtagcagccactgcaaaaacatgccaaattgtaaagaccatcgatgctaggaagaaactgcatcaactaacgaatgagcaaaacaaccagttaacgtcataatgacaggatcaaattcatacataacaatattagccttaaatgtaaatgggctaaatgctccaattaaaagacacagactggcaaattggataaagagtgaagacccatcagtgtgcggtatttaggagacccatctcacgtgcagagacacacataggctcaaaataaagggatggaggaagatctaccaagcaaatggaaaacagaaaataaaaacaggggttacaatcctagtctcggataaaacagactttaaaccaacagagatcaaaagagacaaagaaggccattacataatggcaaagggatcaattcaacgagaagagctaactatcctaaacatatatgcacccaatacaggagcacccagattcataaagcaggtccttagagacctacaaagagacttagactcccacacaataataatgggagactttaacactccactgtcaacattagacagatcaacaagacagaaacttcacaaggatatccaggaactgaactcagctctgcaccaaccagacctaatagacacctacagaactctgcaccccaggtcaagagaatatacattcttctcactaccacgtcgcacttatatcaaaattgaccacattgttggaagtaaaggactcctcagcaaatgtaaaagaacagaaattataacgaactgtctctcagaccacagtgcaatcaaactagaacccaggattgagaaactcactcaaaactgctcaactacatggaaactgaacaacctactcccaaatgtactgggtatgtaatgaaatgaaggcagaaataaagatgttctttgaaaccaatgagaacaaagacacaacatacgagaacctctcggacacatttaaagcagtgtgtagagggaaatttatagcactaaatgcccacaagagaaagcaggaaagatctaaaattgacaccctaacatcacaattaaaagaactacaaaagcaagagcaaacacattcaaaagctagcagaaggcaagaaataactaagattaaagcagaactgacagagatagagacacaaaaaacccttcaaaaaatcagtgaatccgggagctcattttttgaaacgatcaacaaaattgacagatcactagcaaaactaataaagaagagagaagaatcaaatagacgcaataaaaaaggataaaggggatatcaccaccgatcccacagaaatacaaactaccatcagagaatactacaaacacctctacgcaactagaaaatctagaagaaatggataaattcctcgacacatagactctcccaagactaaaccaggaagaatctgaatccctgaataggccaattacaggctctgaaattgaggcaataattaatagcctaccaaccaaaaaatgtccaggaccagatggattcacagccaatttctaccagaggtacaagcaggagctggcaccattccttctgaaactattccaatgaatagaaaaagagggaatcctccctaactcattttatgaggccagcatcatcctgataccaaagcctggcagagacacacaaaaaaagagaattttagaccaatatccctgatgaacaccgatgcaaaaatcctcaataaaatactggcaaaccaaatccagcagcacatcaaaaagcttatccactacgatcaagttggcttcactcctaggatgcaaggctggttcaacatacacaaatcagtaaatgtaatccagcatataaacagaaccaaagacaaaaaccacatgattatctcaatagatgcagaaaaggccttcgacaaaattcaacagcccttcaagctaaaaactctcaataaactaggtattgatgggacatatctcaaaataataagagctatctatgacaaacctatagccaatatcatactgaatgggcaaaaactggaagcattccctttgaaaactggcacaagacagggatgccctctctcaccactcctattcaacatagcgttggaagttctggccagggcaatcagacaggagaaagaaataaagggtattcaattaggaaaagaggaagtcaaattgtccctgtttgcagatgacatgattgtatatttagaaaaccccatcgtctcagcccaaaatctccttaggctgataagcaacttcagcaaagtctcaggatacaaaatcaatgtgcaaaaatcacagtcattcctatacaccaataacagacaaacagagagccaaatcatgagtgaactcccattcacaattgctacaaagtgaacaaaatacctaggaatccaacttacaagggatgtaaaggacctcttcaaggggaactacaaaccactgctcaacgaaataaaagaggacacaaacaaatggaagaacattccatgctcatgggtacgaagaatcaacattgtgaaaatggccatactgcccaaggtaatttatagattcaatgccatccccgtcaagctaccaatgactttcttcacataattggaaaaaactactttaaaattcatatggaaccaaaaaagagcccacattgccaagacaatcctaagcaaaaagaacaaagctggaggcatcacactacctgacttcaaactatactacaaggctacagtagcatggtactgttaccaaaacagagataaagaccaatggaacagaacagagccctcaaaaataataccacacatctacaacaatctgatcttttgacaaacctgacaaaaagaaggaatggggaaaggattccctatttaataaatgatgctgggaaaactggctagccatacgtagaaagctgaaactggatcccttccttacaccttatacaaaaattaattcaagatggattaaagacttacatgttagacctaaaaccataaaatccctagaagaaaacctaggcaacaccattcaggacataggcatgggcaagtgcttcatgactaaaacaccaaaagcaatggcaacaaaagccaaaattgacaaatgggatctaattaaactaaagagcttcagaacagcacaaggaactaccatcagactgaacaggcaacctacagaatgggagagaatttttacaatctacccatctgacaaagggctaatatccagaatctacaaatgacttaaacaaattcataagaaaaaatcaaacaaacccatcaaaaagtgggtgaaggatatgaacagacacttctcgaaagaagacatttatgcagtcaacagacacataaaaaatgttcatcatcactggccatcagagaaatgcaaatcaaaaccacaatgagataccatctcacaccagttagaatggcagtcattaaaaagtcaggaaacaacaggtgctggagaggatgtggagaaataagaacacttttacactgttggtgggactataaactagttcaaccattgtagaagacagtgtggcgattcctcaaggatctagaaccagaaaaaccatttgacccagctatcctattactgggtacatacccaaaggattataaatcatgctgctataaagacacatgcacatgtatgtttattgtggcactattcacaacaacaaagacttgcaaccaacccaaatgtccatcaatgatagactggattaataaaatgtggcacatatacaccaggaaatactatgcagccataaaaaatgatgagttcatgtcctttgtagggacatggatgatgctggaaaccattattctgagcaaactgtcacaaggacagaaaaccaaacactgcatgttctcactcataggtgggaattgaacaatgagaacacttggacacaggatggggattatcacacaccggagcctgtcaggggatgggggagggatagcattaggagatatatctaatgtaaatgatgagttaatgggtgcagcacaccaacatggcacatgtatacatatgtaaaaaacatgcatgttgtgcacatgtaccctagaacttaaagtacaattaaaaaaaaaagaaaagaaaaatatactggattacttggtagtgcctatcaaatgcttgcctaataaggtccatgtattaaatcactactgtatgtaatatgtgattcattgaagaaatattaataaaattctgtgtggaaagtaaatgacacatatcacaccattcttctgaatggagactcattagaatttcttgaatttctttttttcgagacagggtctcactttctcgcccaggctggagtgcagtggcatgatctcagctcagtgcaacctccacttcctgggttcaagcgattctcctgccttagtctcctgagtatttgagagtacaggcacctgccacctttgtatttttagtagagacagggtttcacaatgttggccaggctggtcttcaactcctgacctcctgtgatccacacgcctcagcctcccaaattgctggtattactggcgtgaaccaccacacccggacggttcattagaattgctaatgcacaaagcactctaattgtgaatatatgttatgacgattttgatcatgcctgagacaaaaaaattgtcatctatggactgcatggtgcttaaggcagcctagcataaagtctctatgtatagagttaaatagatagatgatagatagatagatagatagatagatagataatagatagattagataaagagataaatagaacataatgatattccatattggttagtaactaatgaataccatcaaatactctctcctataatttcatatgaaaaatatatccagaggcttacaaagtattgtaaaatagaacctgataatcatatagacataacattaaaaattccaggaggcaataaggaaggtagagagtcaatacttggcagcattgatggaggcaaagggactgagtcagagaatggacccttaggcgagttgctgctgagccacatgaggggatctagtatccaggggactccaatgttctgcatactatacaacctcattttgatactaaacctcataataatcttaaagtctagaacaaaagtgaatgtgcagattctattttatttttcctcaagcagcagttttccaggatcattcctcatagaattgttatcttgtattattcttcctttccttcttgatttcttctattttcttcttggtattatatgggctgcacttggaactacagagatttaccattatttgcattccctcttttccaacccagtatatttcatacttttatgttttgcagtatggcttgagagggcaactttaccacatactgccatccaaatcactgctcctgattgcttgggtgggtgccacagtacttccatacagctcccagtggctccatcccacctgatatacccacttaagagactctccagtggagaacaaaatattgcaaaaacaaattgaaagtcactgaacaaatgagggtgttaagcccagtagggtggcccagatgaacagaacactgcagagctaatcaggaaaccatgcaaccagagaatacaaagatagctgagcctataacaatggaggaaccatacaacgaatacttctgatgccttcagctatttcaaatttgtcttgccagggtttcataaaagggagcaaacatttttcttgatgtgagcagacatgatttcaagttctaactgtgttattacctgcttatataatcctgggtgaagcagccaaacagtctatgagccctagttgaacataatactgaccaattttacatatatgatgtatatctaataataaaaccaattagatttataaaattatactatgtctaaaatgttttcatttatgttttaagtaaattgcatattaagtctaataattataactatataaatataaatatctactatgacactgatcgtttctggatccaaacaaaattcattatgaaggctcacatttaccaagattagaaactgacattcattcccttaggtacagtaaaattattttagtaaaaattgaaaaataattgaaatatgtgataaatataatttattaagagccatattagctagcatacattttgtatatgaaattatctatcaaaataaaaattgaaacacaatcataaatattttcaagaatggcaaataggacattgttttaaatatggaataataatattattattcaagagaagaacactgatattaggacactgataattaaaaagctatttttttctttcaaagttttaagtagttcagaagaaaggtgagtgagcatcaatgatccctctttccatcttccttcctccccagccattagcaatgctgtcactgtttctttctaaatgtcaggagcaaagaagtcacacatttgctctctttggaggaaagaaggaaatggggtagcttttgtgtgagccaaatgaacaaattatctctaagatattctaaggaaagtcggtgatgatagcaactgaggcagttgcttacctattttataatgttgataaatcccaaaactgtaatcactaacatgacagagggaaaaagtaataaatacaagttgtaattcagaatggtataatgaattaaggaaacctatatcatatccattagagtatttttctaatttatgaaagcatagatttcagccaggcgcggtggctcacatctgtaatcccagcactttggggggctgaggcaggttggatcacctgaggtcaggagttcgagaccagcctggccaacatggtgaaacaccgtctctactagaaatacaaaaattagccgggcatggtggggggcacctgtaatcccagctactcaggaggctgaggcaggagaattgtttgaacacggaggcggaagttgcagtgagccgagatcgcaccatgcactccagtgtgcgcaacaagagcaaaactccacccaaaaaagaaagaaagaaaagaataaagtatagatttcatttataatcttttcaatgattttgatttcataaaaactcattatggttaattttatcagagaaaaaattaaaccactgactgataacacgtagttaacaaagacataatcatcatcagtttcacaatgaaatggccaccactcctcaaagacgtgaacatggtaatcatttcagaagaaatgttaacaaaagtgacaattacaaggtaaaagtgttctcaggaaatggtaatataaaatgtgagccctgctgaaaagtactgattagttaagaagaagagtgaaaacatatgaagagcaaaaggaaaaatggagagacaagtaccaagactatcaatacctgttgaagctagcctctggcaatttgtcaaactaataataaataataataagaagaagaatccacttccacaagtatggtatttatatcattcagggactatatatgggctgcagcatgactcagtgtaacagactatctgtgagcataaactcatgaggcacactgcctggcttcagattctgctctgcatttacaagttgtgtcatcttagaaagtgtcttattttcctcatctgcaaaatgagagtattaatatctacttcactgggtttttatgaggataatatgaaggatttaaaatagtatatatggcacatggtacatattcaacaaatggcagctcttgatacataatgaatttaaaaaagcaccaaagcaaatatgatcagactgtacagccccatgactgttcttcttcaaggttatcttcagagggtatgactcgtgtttctgatactttttttagaataccttactaggaactggttgctgtacaatctcaggaaacgttaaggatctctctaacattatttcaaaatttcataggccaaatcggttctacaatcagcatcctttcttcagttcgcgaacaggttgtttgagaccaagacaaacagtaaagtgggttactttggtaccacggttgggttattctccacccacccccaaacccacccctctatcttttagagggaaaggatggaagctggaggtggagactaaagttgttatgaccctatcacgcactcggatctttgtggggaatacaccaaaacagctgggtgtttttctctctgtcctcactgtctaccaggtacctcttatgcccacacaacccctcctctattactctcctttgtactcttttgatgtaagcaatttcagctaaataaagtaaaaaagataaaaattagaagttgccgaagttgttctaaattatgctgcttagtaaatcaaccaagatactcaattgttttgaaacatttgaggcagaaaacacttctttgccaaattcagcatgtgggcataattatttttaacatatttatactttaaatatccatgtgtcaggataaatatacttaactgacatactctagaccctgcatagaatggatatgacaactttgaaagtcatagatctcaccatctctctggactgaggatacgtttacgtgtaagaaagaccctctctatgtccaaacctatccgtatttaagggatgggtcagacaagcacagccttcgatataaaggaaaatgacaatatgtgaataggaaatcccttttggctagtaaatctcacttttgaatattcactacatttattttcattggttcctctgatcctaatgtatggttactcagaaatcacagacgaaaatgatgacaaacactatttccatattttcctttctatctaatcctgaaaactcattcctggatgctctgaggagtttgtttttgtctttattgttttgattatttgtattttgtttcctttcttctgttaggtattgccagaatgcttgttgaaattatcctaggtatggaggcataaacagtaagaaataacggtataagtgatttcttagtttgagttccttttctaaaatctagtctgaaattaaatactgtccaccattatccaggttgagaatagtatactgaagtaaactgaatcctcggatagttccttactggcactaaatcaactgtttcagactctattatcccaaatacagtgctattttccctttcacaaaccaaggcttccttctgcttttgtgcattcccacaatctgttctacctccacctgaatgctgtgtcttctgcctaccttactctttttctaggaagtgattatcagttcatctatcttaactggttgcccttttgactgaagatttctgaccttacttgaccaagtcagattctctttttctcaggatattgaaatcaggactctgagatgccaagtagcatcttgaacagatgtagaaaattaggggtttggagtgtgagttatattcttctatcatgcttagaaatgtacagaaagctggtctcagagaaaaaggggaaagtgatgcaggtgcacacagagaagcctagggaggaggataagtgacccagagaaaaagagaaagacaaagcaacgccactttggcctgagtctaactcctcagcatacgatgacacactcagcctccttgcagtataaagtgctttctacctctcagttacaagcatatgtcccgatggatacactgactgtcattcaaactaaaggtcgtattttaccttctgtattacatcttccctggttatttcttattgatgtctaaatgttaaaaattccattgcaacagaggctttgtgccacaaaattctgtactaattatataaagttatgcattatctatatttgttagtcacatttcaccaccaaaatcctatgatcagcaccaagtctttacttttcaaaaaattttcaaatacatccagcacagtactagcaaatagctggtgcttcataatagctttgattaacacagtgtatactttggatccatgaaatgaaaaaataaatgttatacaaatgctgtatggtcaaaatataggtgtgaacacataaacatgttgacttctaaaatagatgatgtatcatgaaattaaataacaaaaagtccccaaactgacatataatgactaaaaatgtgtgtaataatatattgtgcgtgtttcttagactgaccttactaatttttgtaattttaaatggcatacatgtagaatacttatttttaatctatagggtctttttttgaaaactgctttctaggaatgtctttagacaataaataaatgaaaaataaaaagctatttgaacaattacagagaacttgtcaattacccttttgcaggaaaacacacacacacacacccacacacacacacacacacacacacacacacacttcagaaagcaaagcagcctcactcaccccctgcagctgcagaagtgagaaggcaaaataccgccctactttgcagtccttgggcctcagggtgaaaaaaggggggagggatttcccagagagctgtgaataaaacctgttgccagagtcaagtactttaaaatgcccaagggtagaggattctaacataattcccttaaatacatacaaacaacattttaagcatagagccaaaggactttaaaaggatagtaagagagaagccatttaactatttagtggtgaatatcttgactctcagacagaaacaatgcaggctggctccttgaatatgctcttacaaatagaggctacccatggaagtagaggacaggcctctttgagctgcaatatgacttcccttagactcttagttgtgcccctcctgtaatccgtagaacttcagcatttgaggtgttgatcactctcaatttaaaacggtccctaaaggcaaatacagattaaatatgaggcttaattctccctgttgaaaataaggaaataaactttctctgtccttttcttaaagcatttatttagaaaacttttcacttcttcctcttctctttgcaatatatgtaactctttttaaaagataataagccagctttacaaccccagaatgtctttctcaaagactagggaagtaactttttgaaatggaatcatcagggaagatagtgtctctgtcacccaattcctaaggaagagtaggagcctaactttggctggtgcctctcgccaaaacaaccttccatcgtaaagatactatcgtttttcctttggataaagccaactagctaatatgacaatatgcatggtcaccccaattaccaaattaagttaggatgaattatgtgtgacaaatgatgctgtcaagttctcttacttgagaactagttattgtttatcttgggaacacgtaggaaatgagttgtacctgctcagacacataaaagggtgatttctttctatcttcgcaatctctttagtggatttctgtgatgcaggttacattccagtttaatgcttattcaataattaaaccggtttctttctcctttacttttgtgggagaggctttccagtttgggagattttgtttctaattttatttccctaacatctgctcctggtttccgggacaccagtttctcctggaatttttcctatttctctaaatgtttcttcttgatatccttggctgaattcttttcctaccatagaatggaccaaatttttcaaggtctggtctcttttctatttttccaacccttatcctggctgtttccactcctaccatctcctgtctagccagcccttgcatatttacaatgtaacacactagactagagacatagcatgttacttttgatgctatgcttttaaggtgctgttctctctggctggaatcatattctccattctcttggcagacacataataaccctcctccggtatgatatcctctgtgaagctcttctggaccaaactctggtaacacttcttacttcctttcagtgcaaactctgctgtgatttcatgctgccctagcaactttttgattgtgactgcctgtactgtagatttgccgaagggagaaaatgcacaaatctgctccagaatttctgctcatgtgacagcgatttctcattataaatagggtggcattgttttgccatagtttttaggaatcagtttctgtgaatagacaagtgtgaaactgcctctaagaaacgggatgatccattcagagttatttccgaggtttgagggagtgaaagtcagacacaatataatggcagccattagcactctgtggatgccggttagtcggccttccctggttatatgtcaaccccatctcactttggacatctgtttaaattgtattttttcttgtcacaggtatgcatataaatataacacactaatcaaggcaactcatttctctgatcttggttttatcaattattaaatgtcaggtttgatcttgatcatctctaaaagtcattctcacagtaaaatacatgaatttgaaaatgtttttctaattttcaatgtcaacaccagcaaatactagaaacacacagctacatttgattagtgtcagacattccgttttctctttggtgagctttggtgtctataaaccccctttaatataagtatctcaaagatttgatttaagcaatttagaagcactaattaaaagttattttaaactgacacctctttatgttaattattctcatatgcatcactcaaacaaatagagggctaaaggagacgacttttggcatgctgtgaggcaaagctgtgcacatcccggtaattctgtctgtaacagggtgaccttaaattaagttcccttttatcttatcaaattttcagaatttcaaacttttaacactcagatctcctgaagagcgcatcaaatggaaggcgtatgtaaagaactgagtgaataatgaatgtacaagaaaataaataaatagataaataacatcgtttaaggtgaggttgaggaaaggaaaaagacatagttaattactgaagtcaaaggggcaaagacaaaaatgaagcttagaaatcattaacttttatcatttcatgaagcaaatgttccagcatttaaagtggtggaaaactgtcgccatagtacattgaaataaaatatctagttttgctgatgtctcatgactcacataaaaatgtttgacccacataaaaattttgacccacataaaaatgtttattataatacagactcatgcaagtaggcctttgagtcctagccagatttcaagaaaaatctatgtttattcaacaaatatctttgagtggaagataaatatagactctgccttcaacaagcaggagaactttcagggtaaacagtccagagagaccctactgagctgcacatatcctgtgatgtttctggaaccttgtcaggaagcaagactttgctaacatctgctaggaacagatgaggagctgctttacatggcaatgtggctcagcctacattcccacttacacttgctgtccagaggtagacatacatatttttaaaccaaaaaataaaaaataaagaaaaaatatctgttgaatgagatttcttaatttaaacataaaacacataagtctgttattgcctaaatggaaataaggatcacatttagggcaaagaaaaagctcagaagcatgggaataatataaatttgagcatctcgttacttttatttcttcatgagccaagcacattctggcaggaaatatcagatcagaccagtattttttcagaagcttttgcagctaaaaaagaaagtaatcttccaaagtcttaaaaactaaagtgtttgttagatgaaccttgaattactgctaaccaaagaaaccagataattaaaataataataataataataataataataattgcaagaagggatacaaatagcttgccgtgtcaaacatctttgttatctggagattgacaggcttgagaaattaaaaaactttatagttgctttaagtggggaatctaaagcgttcatttctttcacatcgatgagaatctgtgtacttactatggcaaaataacttacttccaaacatactgctttatattaaaaccagaatccctatttattttaggttttcatttttcaaacttttcttcaattttgggaaaattttaaagtttttaaattgcaattattaaaaaaaataaaaatataattacacatttaatgcatgaatatatttgccatgttaaaattaaaataccacagataacagctttttcttttaaattgtgggtatagagaaagagaaaagtggatttataatcagcagaagctaatttcccatcacctttaagcttaaggccccttatttgcacagtctgtttccaaggaccagcctctggtttttgatttgctatttcatattctattcatttagaagcccttcctccttccttcaaaattttataagcttcaaaggccaatgaaatctgaatgtgatattgataatcagttaacattctacattgatatgatcaccagctatttttccatctttcaatagtaagaaaatcttgtgacctgtgcctgtacaggaaatgaggaaatgtatttgtgacttgactaatcatactggcttaccaggaacctaaggttttcttggaaaaccttgtattttgactataaatataaacgaacatttggtaccaaaaccaggacaactgatcactggaagtttgggttggacagtggcttagtcagaagaagaaggacaattaagtttgtttaatcatgttctccaaatacaaaattgcttgtgaacctgcatattctggctcccttttttccccttatgaaatgaaaatgccagttcatcacttccaccatcatgaatataaataacatcacaataaaaaatttttataataaaaatgctacacatttgttagcatgtggcattcctttaattgcttttttatctgttcattcatttgaaattttaaactatccacaaaagaataatattttcacttaaaaaaataaaagaactaagccactgaggttttgcataaacaactgaaggagacatagttttttaagcctggaccagaaacaaagcttcttgacttagaacacagtaaatcagcaagaaggcatctgtaacctagtgtaaaaggtcctagactcccaatatttaccattaagaaaccatcttaaacttaacctcaactgtgatagcaatttaaccatatcagaaagagtatcatataggcgtggctatttgattttatctgcaaaaaatagtcttaagtttaaacaagccagagagactactgtattgctttctgaatgaatgtatctaaaacagaatacaaagaagacttaatgtttctctttatatatgctagtatacatgcctctctatatttgttactggtctctttaaaattgtaacattttaatttgagaatttcataactatataactattaaaatgtgtggatttattcacatgattaaacataaagtgtcaaattaaaacaaaaatatattatgatcatgaattacactcaaaaccacaattattagaaagttttaaaatgaataatttttgacaacaaatataaagttatgtattaaagatttaaaactatgtctagccaggtgtggtgactcatccctgtaatcccagcaatctgggaggctgaggtgggaagattacttgagggcaggagttcaagacaacttggtcaacatagtgagacccccgtctctgcaaaaaaattttaaaaattatctgggagtggggcctcatgcctatggtcccagttactcaggaggctgaggcaggaggacagtttgagcccaggagttcgaggatgcagtgagctataattgtgccacttcattccatcccaggtgacaaagagtgaaaagccagctcaaaaaacagaaacaaaaaaactatttctgatacgcttagattttcaaatattgcaacataatatcacacctaaacaaattagagtcctaatttaaaaaagaaaaaagcttgatgcagaatgaaaagaacactttcaaagtttataccagttttgaaaataagttcacaatatgtagtcatatcccagagtgttgatgtttatctacttccccacagtgttcttctcagaataaaaaatatgatgaggcatattataatatatatctacatacaatatttcgtctttaatatacttaaatttctgactttatggcaagtgccaaacataacattaaacgtattggaaagcaataatttttaaaatgttttttaaataatttactaaagtaaatacctagtgattggaaaatgatgttattcaatatgaacttgatttttgagagttacaatgaaaactataaggcaatcaaaaatgtacatgatgattcctagaaaataaacatgactgaattatagacaatgaacatattaataattatgatatattatcagacaaaacatatacatttagtaggtttttcttaataaagtataggagctgagaatgaattcatacataattataacttttaaatcatgttcatatataaaaacagtatagtcaccattttgtttaagtttgttacaatactcacaatgtttaaatatgtgttaggttagaaaggaagtaaaggaccatttttcttttaactagcaatttatgccacaggttctcatatttactttcgtgtgtagcaagcatgaaaaacaaaaagtaaacccaggtcttcatattttctgactagcaagagaatctatgtgtttcataagtgttggaatgggtaaaattgaggagaaatagtagactgtgcactaatagtcatgaggcaagtgcacaaatcaattttcaataacaaacttagcctgtaactttaagtgaacaaacagacttttcctaataaacatattttcaaagctgaggaattttattttttttctgttctaccttatgtaatgcagaaggctttcattattatagtcacatttgtacttctagactcctatatgtattatctgataaaacaattaactcaggatggattaaagatttaaatgtaagacctaaaaccataaaaaccctagaagacctaaaaccatgaaaacccttttttcttttttaaattaggactctagaaaaaacctaggcaataccattcaggacatagccatgggcaaagacttcatgactgaaacaccaaaagcaagggcaacaaaagtcaaaattgacaaatgggatctaattaaactgaagagcttctgcacaacaaaagaaactatcatcagagtgaacaggcaacctacagaatgggagaaaatttttgcaatctatccatctgacaaagggttaatatccagaatctacaaagaacttaaataaatttacaagaaaaaaacaaccccatccaaatgtgggtgaaggatatgaacagacacttctcaaaagaagacatttatgtggccaacaagtatatgaaaaacagctcatcatcactggtcattagaaaaatgcaaatcaaaaccacaatgagataccatctcatgccggttagaatggcgatccttaaaaagttaggaaacaacagatgctggaggggatgtggagaaataagaatgcttttacactgttgggagtgttaattagttcaaccattgtggaagacagtgtggcgattcctcaaggatctagaaccagaaataccatttaacccagcaatcccattactgggtatatcccaaaggattataaatcattctactataaagacacatgcacacgtatgtttattgcagcactgttcacaatagcaaagacttggaaccaacacaaatgcccatcaatgacagactggataaagaaaatgtggcacatattcaccatggaatactatgcagccaaaaaaaaggatgagtttatgtcctttgcaggacatggatgaagctggaaaccatcattctgagcaaactattgcaaggacagaaaaccaaacaccacatgttctcactcataagtgggagttgaacaatgagaacacataaacacagggagggtaacaagacacactggggcctgtcggagggtggggactaggggagggatagcattaggagaaatacctaatgtggatgatgggttgatgggtgcagcaaaccaccatggcatatgtatacctatgtaacaaacctgaacgttctgcacgtgtatcccagagcttaaattataacataaaaaaagatgaccaaaaaaaaacccaaacaaacaaaccccaaaaaactaagacctaacattgaattatgagggaagaattacctaggaaattttcaaaagccaaaataaaagaaagcgtaggcaaatctggacattttcttttctttatagatcaatagataagtatctttataaatagattatctctataaatgtaaattacatgagcacatatatgaatacatgcaaacatagagatatttatatataaatacatgtaaacacacatacagagatacttcagaaagaaatgctatataattgtattctggatacaaggaggtaaccttaggggctagttgaagagacccagattaagagaggtaaaatacagagaatgtaaagttctaattatcaagtgcatttgcctcacctttttagatacctcaagaattagaaacatctggtgactaacaattacatagcacttactatgtaccaggcactgtcttaagaactttcatatattttcattttatcctcacaacatcgctttgagaatggaaccattattaacctaattttacagaagataaattgaggcaccataaaatgaaatgacgctactgaggtcacatgattggtgtctggtccaggtatcaaacccacagtggtttggcttcagagtctaccatgatactatacggctcttcaattaactgcctgagcccacattttccatgatatagaactatagcttaaatactgtatgcccaggttacttataactcaaaaaatactgaagtatagaaatcaatattattttgagagttacagtttcatctgcattaattctctcaagagtcttgtaggaagcagtattgagccaggcagacctgggtcctagtccaactctactaacttttgcctgtgagagtttaggtaagtgttttaatcatcttccatctcattttatactttacgctatgaagaaaaaactattttttggagaggttgttatggggattatagaaactatatatttatacattttctggtatttgatgagggctttataaatgatagttattgttaaactatcatgattatttccagctacatatgagaaaatcaaggatgagagaatgtaaaggatttttctatggacacacaacgtttaagtagtagaggtgtgacttgaactcaggttctgtggtgctgtatttcatgcaatttaatgtatttcagggcaccatcctgctttaaaaattccctaatatgtagcacaaacttcatcttttcagttatttcccttagttctttatattcatatcatcttttcttgattttgagtctctatgtagtacaaagtttgtaagatacaatttagtatttaactatttctagcattgtatttgttgcttcttcaaaaacatttcaaattgcctgaggacagaataattgatatatacacaactgtatctacctgtaccctgtgtactcaataagtaactttacttgatttcattatagaacaaatcttactctttcaacaaatacttaggttctatttgtattcatttgatgagccctctgcctctctagaagttatttcctctccagccaagaaagaaaaccaggtttttggtaaaaattttggtattgaaagatacttgcaaatatcataggcaacaaataagggaatgtacagaagagaaatgtcaaagataagacataagaaagaaggaagcatccatcttaaagaagtataccacaacaccacaacaaaagaaaaaggaggaggaacaggacgaggaaggggtctgacattgaaattcattgtcccccagttacttgacgatgagaagataaaggacccacagaaattgcaaaatgggaaaagcaggtacagaaactggaaataggaaatatctatttgcatagttggaagagagaatgaggaataattgtccaacatctgcttctgtattctcaaaataactagctactgctgcttcattatcttagaagaagatttatttcaatctcttcgggaacctcagaagacctttaatatgactgaattagattctaaaacaccctgcatagcatggcatggcatcgtggctaaattctaaggagcacacataacacatttatagctgctagagcagactgaataaatgcgtataagaataaagtgaaatgcccagcaaacactgaatgctcaataattgattttttaaagatttcctaaagagtttacaaaaaaatcacgaaacaaatcatgtctgtttttttgttaaaaaaatgctgtataacaatgcatggtaattatcaaatttaggatataaaaataacaagctctaggattttagaggaaagaaaagtcaccatgggtcagctgatgtggtcagagaaggtatctgtaaagaggatccaagtgtacacttggagtgtggcactgagaatatataattaagcagtgacacctaaaaggcttacatatggtataagaatagcacttacctccaatttacttccctttttcccctgacaatgttcttccagtttgaatgcataatgttctggtaaaaataaccttgttgacagagcaatcataaacagaaaaaaaattcaaggtgcagaacatttaaaagtatatatttattatgagaaattatactgcagcacgcatattcctttactatgatttttcttgtttccttcacaatttaatgtcaaaatctttattcttcaatgtgtatactcatggtcccaagctatcaaaggtaacatttcatttgaattctctctcaaactcacaaaactgtacattcaatgtttaattcccttctttttatgactattattttttctttattgttttctgcaacttatcttcctctacttactatttatacagaataaacattttgactgttctctctatccccttatacttaggcatttatatctggctccgatttaaaatctaccagttacatttgtttagtgaatattaaaatatactttgtaggatttatatcagtgacaccaacaatgaacaaaacgctggaagaaaaacaacacataagacttaaaacccttagtggtaggaggctgaggcaggagaatcgcttgaacctgggaggcgtaggttgcagtgagctgagatcgtgccactgcactccaacctgggcgacgaagcaagactccgtctcgaaacaaacaaacaaaaaaaaaacccttagtggtaaggcttttttttttttctttttcttttcttttcttttcttttttttttttttttgagacggagtcttgctctgtcacccaggctagagtgcaatggcaagatctcggctcactgcaagctccgcctcccggggttcacgccattctcctgcctcagcctcccaagtagctgggactacaggcacccaccaccacgcccggctaattttttgtatttttagtagagacggggtttcaccgtgttagccaggatggtcttgatctcctgacctcatgatccgctcacctcggcctcctaaagtgctgggattacaggcgtgagccaccgtgcccggccggcattttttttttctttatgtccccagtactgttctgggtgcttcatttgtctaattaacagtagaatctcaataaaaacacatcaagtagataaattaacaaccaaaaacaataatcacacaattgctcattatttttatctatttagtttatcattaattcttacctccatttatttcaacaggcattatagggataaaaaatagaacggaattccagccttgaaaacagtaaaagtgtctttagggaagatgacaggaaaatgtataattaaaaaagactttgaaagcttagaatgccttaagattaagattccgagctattacatgggaaataaggggagggggagagaaaaccatgttttgttctgcttgccagaaaagggcgataatgtagcctaattatgtacaaccagcatgatcaactttagaaatgaggtactcaccaaaaggcttaaatttttaccaacaaattctgttatagtttggttatgtttgcacatcaacactgaatgattaaatcaaataaaactgtgagtttgggtgatgatctgtttggtactaagctacctggcagcaaattactggccaacccatagcctacagctgttgtgtgatcctgtctatctactcaatcagatcaattcactcagaagtctatgctacatcttctgaggccatgtcgccagcacaatcacctgaaagctctcttatggaaaccccatgccagccagtgtcattgcacagttttgctgagtaaattaagtgataaattatgatgtccattgagtggtaagattgcttcattgtgaagtagaattaatacggtcattctcaaggggttgacagatgagagacagtaaattatcaatattcaaatgcctcgtaacaagtaaagctttggctttaggacatgggatctaaaagtatgaaaatacaattccattttgtggtcaaaagttagcacaagcgtgtagtttattggtgtctatcttatgtgggctaggagaaatacttaagactttcacggtttgtttctcattcaccaaattaaattttcctcaatgcctatattcgtagctctgtgtaggtagtattagcacatctttaaaaggcattaaaagtggaatttcagacctcgaggagcttttggaaaacaggagaatgttacactggcaaaccaagtggtattgttactactatgtttcacaaaccttatttaggagactcaaaaactaatgactggtgtatgctagggtagaaaccccagaaacccccgcccccccaccccgcaaaaaaaagagagagagagacaaaaggagaaaagaaaagccataaagccatgattctctaacagagtcttatttgctacaatcagaaggctaaacttgtcctcaggtgccacatttccagctcactaaggaatacattatccttccaatgaaatgctataaatgatacagaagttccatttctagcctacaaagcatgtgtattttgtaatgttgctggaacgatgtagaaaaggtagtggaagaggagaatgtaaaagaagaaaagagaaggcagagcatagactgttctttaaaaatgtgtttttttaaatttttgcatttgtatagcattatgtagtttacaaaatatcatatgcatgtatgtttcatctttgtcctaaaatttgcatggaatagggaaattacaactgaggatactggaacacacaaacacacacacacacattaacattaaaaatgtacccattaagtattatagttaatttttcaaaatccttctcttctgttccattcacaaagagtttgtagtcctgtgaaggactattccctcctcacctatctgtgaattctccaccttttcatctcttcaggcatttggcaccatcacttaactctcttcagtatataatctctccctcttgacttttcttgtttccctcaacacaaaagcattcttaagatctttcccatgttaaaaacagcagactttctctccacactttctctctctagcgtccatgctgagtggccttcttttcctcttattcctagtcaccactttccatttccaacagcattcactagcaacttatcaacttagtctaatttcccccaatcctataaaagcactcttgttaagtcccagatgtcctacctgctcattcagttgggcattttcttttcttaaccaaattaacatctttgctgcatttgacactgtcatcttccttaaaaatcttctcttatttgccattctggaatctggaaataagatttttttcctcttgtccattccttatcagtcttctttgtaaactccccttttatgctgtctagatgaatgttggatgatcacattcatggtcaatattgcggtcttcttgtatttttccctctctattttctgcctgcaatgaactgatcactaggtgctgtccgttaaactgacaaatcacaggcaaatgccaagttactctctccatctccactgccattgtctcaactcatatcctcaccctctactacttgaatgactcttagtttgctaacagttcttcctgctgtttgtcatcatttccatgaccatcaccatcaccagttcaaatggagtttgaatttgcgtgctttagctttccataatgatggtgttcaggacaagctatgccaaaatacagcaccttggcatttgagaaaatagcaaaaaaaggaaggtctcctgaactttcttctgttctcccatgaaacaggccataaaaattatctgattttcctctgaagcccactctatacccagagaaaagggatgtccttatctctgaagatacagggactcagagatgtatctaaaaagtgggctttgctaaggcctccctgatagaacatacccttgtctcaccatacagctgcacaattgtccactcttcatcaaactcagcataaaaattcatgtttccctgtttctttgggtcttcatttctgaaggctcctgtgtcacgtaaaatttatattaaataaatttgtatgtttttctcctgttaaatctttattttgttatagagagtcatcagccatgaacatagcaatgggtgagaaaagaaatttattctataataccaacctttttttttttttaagacagggtctcgctctttcacccaggctggagtacagtgatgcaatctcagctcactgcaacctccacctcctggggtcaagtgactctcgtgcctcagcctcctgagtagctgggattacaggcttgcaccgccatgcccagctgatttttgtatttttagtagagatggggtttcaccatgttggccaggctggtctcgaacttctgacctcaagtgatccgcctgccttgggctcccaaagtgctggggttataggcgtgagccacagcaatgggccaataccaagtttaaaaaaaaaaaaattgagacagggtctcactctgttgcccatgctggagtgcagtgatgggatcatggctcatgggaacctcaaactcctgggctccagtgattctcttacctcagtcttctaagaagctgagactataggtgtgcatcaccacatattgctaagtttttattttttgtggagatagggtctcactatgttgctcaggttggtctcaaactcctgggctcaagcaatcctcccgccttggcctcccaaactgctgggattacaggtgtgagctaccatgcccagcctacctatcatttttaagctataataggattgttggtttatttgccttattttgagggagtgattatgacagatatcttttaagtatttaaagacaatttctcatcttacccctaaatgtatcttagattgtttgcatcataaagactttacccatgaaaacaatgatgaaaaactgcagctcagtttcgataaatattaaaagtaatttataagttttggagtctgaaataatgaatgatgtttatagcaataattaatcggtgctttctaagcaatatctcaaaaggtattttcttctatgtatttcttgtctaataaatatatgcattatgcttatgtaaaaatgattaataacaagaatggctctatgcggctttatcaaaagtacaaagtaattaattaaaatcctttttaaatcaagaaactataatgtgcccttcatcttacagttcttaattgaatttctaaataaaatttaagccataccctcattttatgtttttctcttggctctctcctgatgaatataaactctgatgtattactgctagagtgtaccattctgtcatatatataaattccacaaagtcttcagccatgaaaaagatggttacatggtgctttttaaaatatctgagaattaatcattcatttctctttctcaacatatcttttatgttttgcctgtttctcgaagataaggggagtagtaatgttaagcaatgttactattcctcgctggtggaaaaaaatgaaactatcagtccccaaacaaagctacacacttgactttgaaggtgcaatactttgtccaatttcagagtctttccaaatacctttcttgaattatgaaatgcaaaatcactttgacagttacagtttctattttcagaatctgtgcctttgtcacataattttgcataatcttccaagcacttggggcatgaaggcagtaagagggagatttaaagtgcttgaattgctacagtataaatgacacatgaagcaatcatataaatttaatcaaaagatttacctctacaaagaacatttccaaaacattatttatgttcatgcgtgactcaacattgtaagtagcacctgtacagttaatatttgaataaaagagaaacaattgaaaaccttaaggattatttgagtttaagcttttcaatcattttcagtataactaaaatattcctataaagtataaatgtctaaacctaggtaatggtccagagaaacgaaaattaattgatctctttatgtggaaatactatgcaagtggtttaattcaagaaaggagttgttcctagttgtaagaattaacatatgtaaaaggttatactctcacactgctggtagacgtgcaaattagatttcattttggaaaaaaatttggaaataaattttaataaaactaataaaattttccagttaagtcagaaatctatcccagagagataatcacaaactaatctatgtaattaagtagttcattccagcatcctttaaaatgacaaaattataaaaacaatacaaatttctgaattatgacaagtgtttattaaatgtagtacaagtgactgacaatatggtaactatgtacttaattatggtacaaatttagcatgctttattaagcagacactaaaatagcagtagatttggaaacgaaataaaagtctgaggagcagcatttaccagggaagggttgggataaagagagaaaacatgacatatcctagtatttacatcctattaattttctcttcttctagggataaatcagaaagaatagacagaaagagacatgaaatatttaaagtagtaattggcttatttcctcttcatttctctattctttggacttaatggctactgatagaaataggtgtggttcaatgactcagcctttcatcctatgttgaacataatatttattctcccataatgatttaaataatttcctcctcaatattaaagcactgcatccttactgaagagaattataaagttttgtaaagttagaaagaacacaaaaatcatatacaacctcactctctagggactgccactcactgtttgacaatttgatgttttttcttaattatatgatgtacaaatatagaaatatatactatgctatgtacagtatgaacttttattcatttttttcatttaatatattgtgaatattttctcatttcctaaaaggtattgtattatttgtaaaatacaatccattcccttatcaaaacattatgtaggttgtttccagtttcttctaaggttgcaatgaataggtgtgcatattaattctggcccaagtttctgtttcattaggcatgatttctccattgtgcattataggctaaaacctaagagctaatttaagattctggtgtattttgttttgttttttgttttgtttcactttccaaaatgcagcagtttatacttccactggtggtatatgtatgtccatttcattgcaccctaatctacattcagtataatcatttacaaattatttactacttttcaagcttaaaatggactctttggttttattttcagtcattttactaataatgcagtaatcattatttttattagatatcttactttttattctgtttgcttattcatatattttgcctttattcaactggaatctttgtgaattctttatagaattccatgatatcttcaaatgtcaccaaaggtagcaatttatatccatgaaaatatggttcttaatttgtcctttggcttttagtagattttctcatattgtgtattcttagagaaggatatgggaatgcatttatgtaatcagatttaacctaaaatatacattcaaagtaaggttagaatttccatgtgttaattatttttttctgattcatcgttaatcaatagggcaataccttaatattatagtgaaaatgagagttatttgtttattcattcctgtatttaatactgtatattgagcagccactggctaaaaaggcctcccttcagacaccgaatacattagttaaacaaaacaggtgcagattcttgactgcaggaatctttcttacattctaacagggggagacagataacaaataacacatgtagtaggaagaataatgatttcccagagatgtccctaccctaatccctaaaacctgtgactattgtattccatggcacaagggaatttgtagatataattaatgttgtgagccttaaaatagggagattattcttttttttttttttttttttggtggcatcttgctctgttgccaggctggagtgcagtggcacaatcttggctcagtgcaacctccacatcccgggttcaagcaattctcctgcctcagcctcctgagtagctgggactacagatgtgcgccaccatgcccagctaatttttgtacttttagtagagacagggtttcaccatgttggccaggatggtctctatctactgaccttgtgatccacctgcctcagcctcccaaagtgctgggattataggcgttagccaccgtgcccagccgagattattcttataagcatggtaggctcaatctaatcatatgatcttttaaaagtagacaactgtctctcgctggaagtgtaaaggaggtgaggcagagggggaaatcagagatagtttatgcctaagaaagatttaatgagcaattgctggctctgagatgtagggatccacatgcaataaatggagaaaggactctaagcgctaagggcggccatcagccggaaatcagcaaggacaatgaaacctccacaaagttttatcaacactctgaataagctaggaagtctattcttctccaagctgcctctatatttgtgtaatttgtcctcagatcagtagaaacctaattctaaatgcaaaataattaaattagatagtattaggagatattattaagtgctctttttaaaaaagtaagattagtgtaaggttagaggggtcaggaatgcctgcttgaggagactgggcagatagaggattaaatagtatggccagattgagactcttatcaagaaggtaatatttgagaaaagacatgatggaggtaagaatgttagccaggtggacacatgaaagaagtcttttcaatttggctgcaaaaggacctgagagaggaaagactccaaggcagacaggcatctctgaagaacagcaagaagccttgtgtgtctggagtggattggtggaagacggcatgtggcgataaaaccagaaaggcgggggggactggatcatggcccttggaaactttaacttttactatgagtgaaatgggaagacactggaagatgtagagaaagcaaataatatatgatttaaaagcttcaagagccaatgtggctgctgtattgaacatagcccgttatgggaagaagccaagagatttgttctgaggttacttcgccaaaccacataaaagataatgggaacttaactaaggttttaaagatggaggtgatgggaagggactctgctctctaaataatttaaaaatgtacatataaaatttcggagattcttttcctaggtagccaccatagcattcctagatggcttcacttaattatcacaaatatatcacactattatcaaacattcatcacacttgtctgaaatcatctgtttactctttcttttcttctagactgcaaattgaactctaagaaaagcaactgtgtattttcaggtgagcctaataaaaagctacatgctgccatccctatttctaatcagtactgtaggtacagttcagttttctaagaagagttatcttttatgacacagcagaggtccttcaggccacttccctcagaagctgtatcacttcaaaccacccagatgacacttagaggttaaagtcacgttcatattattttgattttttttaagaaagaaaacctcatgaatacggtataatcatcagcagaaagacagtcaatttgtaatattgcttcttggattttaatttacgtcccccgctttgtgggttggagcattctaaagaaacagcgtggaccaattcaataagaaaaaaacgtgagcagtgacaccatgttcacatatcactgaggagtaaagtgcaaaaaactttaaagtctgtgaagtatgtacgataactgatttctgctccataataagcaccacaatcattacaggctatgagattcatttttgttttaaaaactttttctaattggtccacatactaacaagagccaactaccatttgttgtcttcagacaggaagcttgtcaggatcagagcaaagaccgttttgcattctaaccactggttagaagacatgcctataagttaatctttggaactaaaggctttaaccatttagcaccaagaaaagcataattaacctggaatgagccttgtgtcttgtagtttacttaagaggatgataaaatatgggagagtgagagaaaaatgaagtagtgataactttgtttttctagtcttggaaaattttaacaagcatgttaaaagtcatctaaggaaaccaagaaatcatttatatcctttcctttaatttttattgtactaatttgatcctggtatttgccagttttctttttgtttttttgtttttacatacttgtggtttacttcctcactcttcttaaagtttgtctttgtaacaaacttataacaagtgatttcagacaacaaatgacatagcaactataatcacttacataaaagagatatttgagatattcttctagttttgaacatgtaaatgaatcaaatgcatggctgaagagagagagagaaaatacgccatttcagagaacaacaacttttcaaagcttattattctaaaaataactgcaaaatgtccacattcctaatttttctatgtaaatcagcctattgcttttaccgtaagttctctctaaattaaacttgataagtattttatgctcaacaaaattggtctaatatcaaatttacttttttactaatcgaattaacaagtatttataaagtatctactattcatcaatcactgctagttattgaaaataaaagatgtctaagacacatacatttgagactctcaaatacttttctaattcaactttagtctgttgaataggctttcaaccctggattgaatctgtgtcttctagggcttgaaagttcaccataatgtgtttggcaggccactggcttagtgtaggagaattaatctgtttcctatagacaggtacatcacagtttatgagggaggaaaagtatatctcttctgcaaatggaagtaatcagaaaaggatgatttgtaggttgcaaaaagaaaggcaagataatatgaattgatccccttataattataataggaataccataaacgtcctttttttttctatccagtgtgaaggggttagtggttagacaacaacaacaaaaaaactcccaagctttcagagtacactacagagtataatattaaaagagggaaagaaaactaaggcatgtatataagtggctaatgtggtggggtttgaacattctagaatgtcctcaaactctggacaaattatcatgcctagaactaaggccatttatgtcactgtccagatagggagactgtagccaaactttgtattcccttaaataattaagtataagcttacccatatttttctctcaattatttaaattttattacgtcactaggatcataacggttggccttgggaaacaaaaaactacaactataagctgaaaatgttatataggaccagaagataggaaaataaagcatatggaaatgaaaaatgttaactggcagtaggcgcatgaaggagcacataaggaaaatgttagcattaacctatgtgtaaagcaggcagctcacagccatctgctctactggtctgtcaaattcacaaattctgcttatcaatgcatattctaaaatggatcatcaggcatccgttcctatattggaacaggggccctagccatattagatcatttgatataatcccaaagacccgtaagacttcctatggagtgctatgtgccagatactcttgcaaatattaacaattcacaaagacattgaaaagtagtcactcttactaggagtactgctgtcttgcaaattgggaaacaaaatcacagttaagaagcctgtctaaagtctcacagtcagtaacccagtgaagtctagcacccatttagtttggtaatattttttggaaagaagaaggaaagtgtaggcatcaaaacactcacaactgtcttcagttttcctgatataaaatgtctgtcgatcttcatgggaaaggagaagaatgaataatgtgaggcaaaaaacaaacaaacaaacaaacaaaaaaccttgagacaggaaactctgcagacaactatttagaagaaaaacaaaacagaaataaaaaaattatttccttttatttttttcaagagatagggtctcgttcagccacccaagctagagtgcagctgtgctcacagctcactgcagcctccaacttctcctgggctcaagcaatcctccctcctcagcctccctagtagatgggaatacaggcgcatgccacaacacccaactaatgtttttaatttttgtagagatgaagtctcactattttgcccaggtgggtctcgaaatcctggcttcaagcaatcctctagccttggcctcccaaagtgttgggattacaggcatgagctactgtgtcctgctgaaaatatttcaagttgcaaaaatacttttgaaatgttgtagattacagataatgtataaattctgtgacaaaataaattattttgacagtagatttacagagggagggagaggctggaatgaaagaaatgctccaggctatcaccaacatcagcttcatttccttgggaaagagcctcatggttttcagatgctattgaggtacacacacaaaccacatgttgcccatgcaatttcaaggtgagagtctcagaaaagggcctttgagctaaacagttttgcattcatccttaatcagaagtcaaatttaatccacactctaactgaaggctgaatatattacaaataaaggaaatggatgtatctcagagatttattaatgtgcttttgaaaactatcaaaatctcatcaaaatttcattttgttttttcaggaccatttttgctctagtctagaaaagtgtatattgctaacccttttaattccatgtgaataaaatcattccatcaggctaattaatatttgagccatatttcagtatttcaaactgacattaaacctggcctatcattattaaatatctataaagtgacaaaagttttaaccaggctgcaaaatatttgactggaagtaaacattagacatcaaggaaagcacatgctttaattactcgtatataggctggaacctgtacttggttaattgctgaagttaagagcatgtcctttaataaaatgaagccaagaaaattactaagtctctattctatgtctcatgcattgcattaggtgtttgagtttctaaaaatgggtctctgtttttaaggggaagggcagtgggaaagaaagaagtaacatgaaaaaggggaagaaaaaagtaactaaaggcattgcctgggtcttcaagaatcctctaagggaataatttcaaatcttgttttgctaaataattggaaagagtcaaacgcagattactattctggttaaaatgtctgaaatggacattttcaaggtaaatatctatataacaaaaagactggccatccctctccctcttgatgctatatttattataagtaatagtttttggtttttttttttttactttgagaaaacaaagacacttttcagctttttgggactggacatttgtttaatccctcattgggattaaacaccaagtgacatgttctatatacaatgaaacataaattacaaaaggacgttatgaaaacaagggaatagagtgagttagctaatcagccatggcaacagcatggttagaaatttattagaattagaggaacagaaatcaaccttcaattctgttatgaatatcattaaaactacacagtgcctatgtctcaggctcttttaagttccaaggaaagaagagtaccagatgcaggctttctaggatgtgagagtctattcagaagaagatcacatttataaaatgataactagcttttcttaagggccaagagaatgaaagagatataatgtcactcaggaattaagggacatatgaagtcctagtgagatacagtggaaaaactctgctgtgaaattgagttatagccctagactattatccagctacttatcccaaatgcaacttttatttccataatgtccatgaacattgcagataagagcactgactagaaataagcagcaccttgttataacccaagagccatgcttaccggttgtatggctttggcctaataacttaatctttctacgattgagtattttattacagtatgagataacaaatgaccacttcatcaactagttatgaaaaataaactatataattcataaaatatagctagtatatgccaaagtgctcagtaaatgttgactattaatggaaagaataatagcctttgctaaattacaaatgagtatctaaaaatgaatttcttgcgatatagatagataagaaaagggaaatagtatgagattaagcacttgctgattaattagtttaagtaaaaactaaaaattaatgttgagtttccagagctctacaaaaatgctaacatacattgtacttgtggatctgaaacctgccaaggttgaggtctttgaagttactttccttgattcatattttactgtatatatcactactatgttgaacatttgatcattgttgagatttgtgatgttttctcctgatttaaatttataccatgtcaccaagaacccaacaaaaatttagatgtaataaaacagatatttaaagaaagacaaaagcaagcaaaaaattcttaaaattaatgtaatcatcatttttactaacactgtaaagatttagatataattctattgcaaataaaaaacaaagattcatttctgttcaaacaatcttaatagtgaaaatgtaaatcattatatatatttaatataaatttgagtatcttccatcatcaggttgtttagttcacccatttcctttaacaccaataaactaatgttactattctgatgtgatgaagactctttggaaaaatcttaattggaggaacaaaactggatccagatgcagagtaatttctatatcagtaacccttttgtaccagatataattttggttgctaacatataaagaagaaacatggattaatcaatagagatatttcatgaatgacaaactcagcaacctatctttgcctcatagtctcagacaataaacactagcaatattctataatttaaccaactttaatcatcctatcttgtttaaaatatgttttacatatactttggatatctacacatattcacaagtaccccccttataggttgtttcactttctatggcttcagaaacccatggcagagtaggataaaatatttagagagggagagatcacattcatgtaagttttatttcagtatatagttataattgttctattttattactattattgttaatctcttactgtgcctgatttataaattaaactttattatagtatgtgtatataggaaaaaaaacatagtatattactatctgcagtcctgctaaccccaagagaatttttgtataaaccttaacagaatacacacaaggtatatgactaaatatccaaagattgggttatttataaagaacaacaatttatttctcgcacttctggaggctggaagtttgagatgaaggggctagcatggtttctagtgagggcctcctccaggctgcagactgccgtcttcctgctgcatcctcacatggtgggaggattgagggacctctctggggcctcttttataagggtgctaatgcgaatcatgaggactccacctgcatgacttcgtcatctgttaaagggcaatctgtaaatactatcaccttcatgtttaggatttcgaggtatgaattttgggggttacacaaatattcagatcatactattccatctcccacctgcccaaatttgtgactttttcacatgcaaaatacagtaattccatctcagtagcccccaaagtcttcattttatctagcgtcaactcacaaacctaagtttagagtctcatctaaatatcatttaaatcagatatggatgagacgaaaggtatacttcatcctgagggaaattgatctgtagctgtgaatgtgtgaaatcaaacatgttatgcatttccatgatacaacagtgaaacaggaatagcatagatattcctcttccaaaaaagaaaaagaaataggaaagatgtaagggattacaggtcctgagtgagtccaaaaccttaattttcaagaataatcttctttgacttgatatccagtctcccagacagactaaagcaaggagaacctccaacattgcttgtagtcctgcccccacagccatttctgaagctctaatgggttgtagttagggacatgttgctcttccaggctagaatcacatgaaggctaccctgctggtccagagtcacaaaagtgcccacatccccatgactccactaggcactgccctagtggggactcttgaagtggccctgcccttgggatggccctctgagtgaggctccaagtgactctattctttgaaatctaggtggaggtaggtacactctcagagcacacgcatgagctgcaccaggagagatggcactatgcaaggttcaccacctgtgccctctggagagagcttctgcatcctgtgcccccaccttggcctactggagcaaaatctgaggtggctaaagagcactatgccagagtacagtgaacaaaaccatgaaatcattctgctcccaccctccccatgcacttgcactctgggtttgtaatggaaagggcataatctctgaaatgtcctttggaggtcagaaggaagagaggagagctgtagagtaagccaccatcatctcagaaaacatataggtaatcttgaagagaatgctggtagaagcatggatgataaaagctattgtgatgaggtctcattgtcttgatgagtaactcttggcttctgttgagatggcacattcgtattaatcttatctgtgctttctcattcttttctatataaataagttgagaattttcctaattttaaacttgtttcccttttgattaaaaattctgtctttaaataatttccctttttcacattttgctagaagcattcaagcgaagccaaaccacacactcaacattttgctggaaatttcttcaaacattctactttgtcactcacaaattctaccttccataaaacactaggacacaaacacaattcagccaaattatttgccactttatgacaaggatcacctttcctcaagtttccagtaacatattcttcatctccacctgagacctcataacaatagcttttaccatctatacttcgaccaacattctctccaggattactcatatgttctttgagttgatggtggctttatctactacagctctcctcttttctttctgagctctaaccagaatcaccctgaatggtcctctcacagcaatgtaggctttttctagcatgcacctcaaaactttttcagcctctaccctttacccaattctgaagctgcttccacatttttagttacttgttacaatatcacctcactccttctggtaccaattttccttctttttatttttgagagaggatctttctctgtcacccaggatggactgcagtggcaccatcactcactgcagccttggcctccttggagctcaagcaatcctctcacctctgcctcctgagtagctgggactacaggtgcacattaccatgccaggcatatttctaaattttttatagaagtgggttcttgctatattgcccaggctggcctcaaactcctgggctcatgtagtcctcctgctggacctcccaaactgctgggattataggtgtgagccactgcacctggacgagtacaaattttctatcttagtttgtttgggctgctataaaaattagggtactttttaattttttaattttttatttctttgagatggagtcttgctgtgtcgcccaggctggagaacagtggcatgatctcggctctctgcaacctctacctcccaggttcaaatgattctcctgcctcaacctcccgagttgaggattacactgggattacaggtgcgtgccaccacacccagctaatttttgtatttttggtgcacatggggtttcaccatggtggccaggctgatctcgaactcctgacctcaaatgatctgcccgccttggcctcccaaaatgctgggattacaggtgcgagccaccacgcccagcccaaatttatttcttaaagttctggaggctgtgaagtccaagatcaaggtgctgaaagttcaggctgtggtagtacccactttctgattcctagatgatggcttcttactatgtcctcacttagtggaagtagcaaacaagctaccttgagcctattttatgaaggtcctaattccatttatcggggatccaacctcatgaccaaatcaccttacagaagccccaccccttgtcaaactgagagttagaatttcaacatataaattttggggggactcaaacatccagaccatagcacatggttttaatgagaatgacatattcagacatcacttgctagcatcttattgcaatttacttccttacttcattttccaagcattatatctaactggtatgagagaaatagaacccaggtctaagggaacaagaagaacattaggtcagaaattctgttaagaaggtcagctcattggaaagggtttatttgttcagtaaacactgttgatactactataagtactctatgaattctggtgacaaaaagtggaatacttttcagttcttgccatatagagagattgtagattagaaaaggattaaagacagattaaatggaggttaaatttaaagagtattcagacgaaactaaataattttgagttatttttaagaagcacaactctgagcaagtcattcacttcacactgttatatcagttatccatctgccagtggttgaactagattttaagttgatacttccatggtataaatgaatatttataaagggaatggcaaaggactaccaagaagaaaggaggattatagactgaagtgatactaaatgcagaggcacagggacataatcagactgtcctcattttatcaatactgcacacttgaaagaagaattcacaaaaggaagcttttttttttgttctatcagagatttagttattgaaatacctaatgatatttattgtaggctgattgacccatgagaagtcataggccatgacccaaagaaagtaagatgctcgaaatctttaaatatgtgtcaagtaatcatgagaaaaatgtataaaatatttcttacagtagccttcctttacagaacacatcttagcacataataataaacttgatttattatgtttagtactcttgtatttttaactacactactaatggcctttccttatacatttcttatacaggtttgctgcttatttacatatgccagctataattctagcattagctaaatttgtttaattaatttgtgttaaaatcatgtaaagaaaatatactatatctctgaatatatacaatatattattattgttataaatatactgcatattcatatttaagttgataattgtggaactggtttgataattcaatgggggataaaatatttttctaagtggaccatttttcttgtgagctaattggagaggtctttttattgaggtagtcatacttatcaaaggttgaaatttcttcaaggaaatatgtggtataaccaaatacaaacaagaataatccaaaaattaaaaggtaacaagatataagccttgtagtgtgaataaaagctagtactaaaaatgatccaagtaattaaaacgattgtcaactttataataaggattagtgggtaaattatgccagtgtggggtttggatggaaggaatatgcacaatacatgcatgcatgcatacatatatacacacatacaatgcatatggtagcttaatatttttagctaattaaaaaaattactttcagaatagtgattgtaaattgaaagttactcaatttaactgtaataactgacaagacaccaactgacatcaatctcttcagaaataattctggcatagtaacacactcacgtcacaagataaagatgaaggataaagaattcaaatgtggaaggaatgagatagactatatctaatatctttcctggtcttctattttggaaacagcagtatctgttgtaattccaataaattctttatttgggaaaatcttacataccaatttaatataaaaggtcttttaattaacttgaagatagcaaaagcaaaaagaaaagagaagaaggaagtagaggagaagaaagaagttatccaagtatgtgttgccattttcttcttggtgctataaaacacaaattctaaaatttggagctgatgaaaatggacacatgtggccagatgggctcaattgcttgcaaagctctgagcactgtaggactccttttctcactgtaatccttttctcatgaagccataggtattacagaccttgactggtgaaaaaggcccttactgttgttaaaatcagacactaagtttttataaggactcccattttccttagattcaaaagcaatatctaaaagaaagcaataaagagagagaaaaagagtaagttaataataataataataaagcatcgtagcacaaactgtatttcctctatcaggaagagcaaacacaaatggtgcaccctttcagaggaccattttgattcttgttattttacattcatttatatacaaagaaaacatgcctatttcaagcataaaacctgagaaatatagtacagcaaatagacttcagagctgagaatacgataggaagagtgccgctgttctttccagagagtaaaacacacatattatgtcaaaatgttacattttacctggtcaatcaataacccctaatataatctaggaacctactctctgggtcagtttgatgtaacgtatctggagaatttcactctggggtctctacttacgtctacctgaaatgttttttacattttcaaatgatgttattcaaagggagtcaaagattaaaagctcgtttcatgaggcatttaatttaggtaagtcaatcagccaagaaaaaacaaaacagaacaaactaaattgcaaattgtggggaagaatcctgccttctttggctggcatcacagatggtcaaacaaaacaaagtttgaacactatggttcatgttttcagaaaaagatggacagtgggacacatttctgtaacttccatcctttaatatgtggaccagctgaaaagcaaaacaaacaaaaacaaaagcaaaatcgtgctgcaaatgctttgagtctgttatttaaggacaaaaaagtacaaccatactgtgttgatattcagggaaaatatttattttgtataatgttgcataaatagagttgtaattatccctagtagatcactgaactactagtgaacaccaatatacaaccgatgcatgtgaggaaacaaaatcaaatttaaaagaaacctctcatgaagactaaagctgtttattactaacaggataatagtaatggaattagagaactctcgcattgcaaaaactagattatacttcctaaatgttcttaatttttaaaaaatacaagaatgcattctttttgagtttgtttagtttgctttggtgttagatcatctgctaattgtgttgacttttaaattcattttttttcaagttaaaaaaaatcatgtgcttgacaattttgaacttttggtgactgtaataaagtattgtacaaagttaacaatattctttgaagtttaaatgccactaaaaagacacttttataaaatatagaagtgtgctatggcatagacatttatgctctgttttgtttcataaatttccaggccagcattttctgatttttatttccaaattcataaattttctactctcttccttggttaagcattctcagtagtttgtaatagcaatacattaaatatttgagtttattcatgagcaaactctccatagactaaaaaggaactatgagtgctaatgttgacttcccaattactttttttcctagtaagtcctgggcttttctttaggttttaattagcaaggcaaatgtgaataagagtggcagacctctcttgtctccaaagaggagtggcagacctctcttgaccccctcctgcctcctccagcttccaggttaacaaaaggaaaatgagttaaccaaacatgtcttccaaagaatgagagaactgccaggatattcccgaaattcaagctaagaaccatttaaaagcaaggatcaagtgaaaaagcttaaattaaaggtatatttacattgaataaagttttgtttccatcattcaaatattaggtctgaagttttttaactttttacattataattttcatgatatctatttttgccatccttctttctctaactcctttcctattcgtaggtatcgactgagctggtgacagtgcaaaaataaagttaaaaataatcagctgaaatttttcatgaagaatatgtttgttccttttttcaaatgccatcaacatgaaagccacaatacatgtctcttctgtgtcagctcacttttaaggactaagtatagagttaacattctgattctatacactcgaaaccctagaaacatatgatcgataaatagatggattttaaatagatagatgatagatgatagatagataggtagatagatattcagacgacagattttacctgttaatcttaaacgattattaatttcctttttcctacccataattaaataaccagttgttttctcttctatgtatgtggaagatatttttatgcttaggcaaattattttgcagtgtttagatgtacaatccttgctttctcttcttgttttcattctagggactctaaacatgtcacacatctgtataatgatatattaaattttatccccattgatagtatcatgagctaaatttgaaattcattactcttcttattggtcataaaaataattaaaaagtcaaaagcatttgcaaaatgttttaaattcctaagtaattcacttctgtgagttaacttttttcctcttccatactaagtaactatacccaatacttattagtaaaagctgggaaactaacctttattaatgctgatatccatctaccagatactaggtgctttacgcgcactgttcacctaatttaatcatcagagcaactcatttgacaaaagaggaaagtgaagttcagaagtgttaacttgcccagatgacacagctactaattgtcagtctttatttgtacttagtttcccctatccccacgcctgtgtgtgtgtgtgtgtactctttaatttcaatatggtaattagatggaaactgaaatttagtatgtattcttcatgtattaggatgctttattttcttacttatgtagctttttaagaatcatgtgatagaacttaatatattatttcctactgaatttttctagtgactaagattgttaaagtcaaaagatatgtcagtgttctgagaactaacacactgtttattttatttaactatttattttattttattttattttactttatttttgagactaagtctcgttctgtcacccaggctgaagtgcagtggcataatctcggctcactgcaacctctgcctcccgggttcaggcgattcccctgcctcagcctcccaagtagcttggaattacaggcgtgagccaccatacctggctaatttttgtatttttagtggaaacagggtttcaccatgttggccaggctggtctcgaacttctgacctcaggtgatccacctgcctcggcctcccaaagtgctaggattataggcatgagccaccatgcctggccttaatcctcatttaatttttaagagcagctgggcacggtagctcacacctataatcccagcactttgggatgcccagacatgtggattgcttgagtataggagtttgagaccagtctgggtaacatggagaaaccgtcgtctctacaaaaaaattttaaaaattagctggtgtgatggtttgtgcctgtggttccagccatttgggaggctgatgtgggaagaggatttgagcctgggagatgcaggctacagtgaaccatgatcacgccactgccctaaacctgggtgagattctgtctcaaaaaaaaaaaaaaagttttaagagcatatttaattgaggttcagagtgactgaattcagcactctttgtaatactccaccaacatcttctcatgtgtgtcagaactatatcccttatactcatttgtatattagaagtgcatcattccttggcacatacaattatgaggatggttattctgattattacttgtgattctgattattatttaagcaaacagtgaaattctagatgtgacatggattgtatattatttagttaattcagagtggagctagagagtcttacacaggagcaatacatatctatgtgacataggtaactgatctcttcatgtttctcttttccataagaaaaatactgatttcatagactaagatagaagttctcattctccacctaccctcccattgcctagctatggataatccaaagcaaacaaccatccataatctcatagtttttatttttctaactctaaaggatagagatatggaaaaggcatcttgtgttggtacgttgcaggagaaggcaatctgaagtgtggagagaaaggtgggggatgatgaaaaggaaggtagataggggaaatccagtaaagaagtagcccaagtgggatgggaattggagcagctcccaaggtagaccttcaaaaagaatttctcatttaaagttatcaggcaatttaaatttagcttatctgataagtctccataatccctggtgtatttctgtaaatttgtgaaatccttgtccttgaaaaatgtggttcaatgttaatgtcttattgggagaggctgcaccaagtttgatattcacattacaaacttcagatttggagatattcatttttagcactatctggtaaaacaggttttaaatattagtgcacacatcgatccagacaataaaatgaaatcagatacatacaccctcatttaatttcagtaggagatacatgtacaaacagttacctaaatgcacaaaataatagcatccattaccatcaaatcccaagaatgctttctaacagaagacctttgggaaccagtgattatgatgtcagttaaatgtctaggagtaaaggaaatattaagcacgcacacacgcgcacacagagaaaagccactgaggctataatcttctaggaacaggaagtaaattgttttctgttcaggaatgtcaaggagtgttaggatatttttcactgaagtgtaatttaaaggctactttctccagagagtttcagaaagtaatgttcatttgagttcaattttgatatactattcctgagacattttattatctgtgtgtataaatatatatgtgtgtatattttgacatgttagacttttaaaagacttgcaaaagagagagtgcccgtatgccctctacccagctttcctttatgtaaaagtcttacatagccacagaatatttatcaaagctacgaaattaactattgtacaatactaaattcacaaatgtatagtctttttttttttaagatttcattggatttttaatgaatgccctttttctgttccagaatccatcccaggatcccatatcaaacttagtttctttgtgtcttctttgtgtcctccagtctgggagggttctctgacttacacagcccggatgttttcaaagagtactgattgtttattttgtagagtatataaaataacatagagttttggcagatgagaacatggacattttggcggggatacattcttctgtatacttcacaaagtatttgctagaggatatcacatttctgcccactaattctgcctcctaaatttttgctaatttgactcccatcggaggatctagcctatggcagttattacagtggtgatctaatggtgattttttttacttctattattatttatcttgttgatcaagttattccaaatttggtcattgggatctctttcagaaggacccctatatgttttcagtatgcccctactttttttgagccctttcttttctttaaagcacgttcttacttttttgacaccacaagatgatctgggtataactgttcgtttaacaaaaagatagcaaccattttaactatgaaatatgcaaaatatggaagttactagtattactagttagataatataattaaaaaatagcaccaaaaattattttctagaaaatatgcagattaatattttgtaaaaaacatattttttgaaaaagcatctctgtgtgtgatatgtaaatatatcacacattatatatatcatttatatatatcatttatatatatatatacatatatgtatctcacgcagtgaacaacatagttatccaacaatagaggattcactgaattgtatttgatataaagactttaatataaatatattttttataaatcaaatatatttgatataaattcatattttcagaggaggcaggacatttataatatactgcttggtgaagaagagcaagctttggaattctctacatattgtgagttgtgagttactttcttaaatcataggaaaaatgtctggaaagtaacacatcaaagtaataatagttagcaaggactaattaatttcaggtgatttttacaactatgtgataacttaaataacttatgttactagttactagattgtttctaaattgacagtgtttaaataaatctcagtctaaacaggtataaacttcccgtaaactgccatcatgccattattgtcaataaaataaaatggcatacaaggccattacttttctttagtgttttaaaaatggctttaatgtgtcgtctgaggcaaaaagaaaacaccaccctcctgctcccttcctcccacatccacctccaaagctgaaaacacagagatggatttaaggaaaatgataaatcctttttagctatggaatagcaagagagaactgagaggtgtcaggtaaaacagagggaaggatggctatgatcttcaaatgccacggtttgcagatactgtgttttcaacactattctaaatattcagagtactcaccaatttgatcagtagtgacaagaaaaaagtttttggaccaggttctccatgtcattttgtaattattcattcaaatataaatacagacacaatctcctcattctctgtagccctactatctttttgcaacattctcagtagaagcaagaattaattgcaactgagtaattgtcaccaggttgtgtggtgggagacagagacagggtcaaaaaagaagaaccacttttctctttcctgggatgtcacgtaatgccagatacttcctcaagtggtgaatttgtttcaattatctagcaaatctttctctcttagaaagtgccaatgaacagtgagttaggggaagcctcacatggctctgctaaacatttgattcagtgcagattgtgtgacagatgtgtttctcattattaagagatctatcgtttgaacatgctaggactaaaatttatcatgcagttagtctagatctatggattagctgcaacctgagaaaaaaataaactggtgctaaattcctaagaaagataaattattccttgatttcactaaagcacatttattgatcttgccagatttttcgtttctttttttgcatagctattttaatttcatgatctgttcacaaggaaactttcctagggatgcactgcattaaaaatatatcattatattctttatcccacttcaaatctgatacagaactagaaaacaggaaaaaattaaagaaactctttactcacttttttctatgtattattaatgaataaggataattactctgaagaatatcatattagtatcattcagtcattctcatatttgaaaagattaatgtgcagttttaaagtacaattgtgttttactgcaattgttgctgtggcttgctttcaagattttaattaggcattttatctttacactatagtagtacagatgtttttatagtgagttatcattcaatctcaccataaactagggaaatgttgattagtctacataaagattaattttcaaaatcaggtatatatttgatctttaacatttggaatgtgctactgtttcacaataaaaatgtcaccttaaaatattaactttcaatcatctgagttcagaactctctctacatatatgttttgtattctactatctcattatcatatcaaacccaaataagaaaccctagtgggacaggcttttctaagaagagcttttccctatcatttctgtctctcattctctctctccatacatatatacatatttatgtatatatacacacatatacgtgttacacatatatttgtgtatacatacccacacatacataaatatacatgtatatatgtaaaatacatacatatatatataaacacacacacacatacaaaattcttcaccttaagaacaaaatttttgtaaaatgctacatggaatagttatttatacaaaatactaaaagctttgttgaacagaatcaaatcacaaactgataatgggatcatccacaagttattatataaaaaaactaaggggaggccaaggcaggtggatcgcttgaggtcagaagttcgagacaagcctggcccacatggtaaaaccccgtctctactaaaaatacaaaaagtagccaggcgtagtggcgggtgcctgtaatcccagctacgtgggaagctgagacatgagaatcacttgaacctagggggcagaggttgcaatgagctgagattgcgccactgcactccaacctgagcaacagggtgagactgtctcaaagacaaaagacaaacaaacccctaagaaatttatataattaacaaatatgaagatatatatatatatacacacatatatatttttatatgtgcatatatgtcaaaggagaaagacagttttgatatttagttccagttctttctcacctagaaaattataacaattcttagcaaatataacacaggtaatggttttgtatcttctggatttctctttcactttattcatggtctgcagactttctgtcttttccatggcattcttctctcatagcattctgttctgggaaagtcttattctttttataaagcatccatcatcatctgcatctctgcattgtgacttatcaaatgctgaaaattcacattaggtacaatcttcataaatcagttttggtagacttgctttttcatgcaaatgcttagtgcctgcttcacttattaatcatgatgtgatgtatatttattcattgtaagacattttattgagttcctcaaagtccgaggcaccattttcagtactgaggacaaatcggtgaaaaagagaaacaagatttgtattttagtgggaaagatggagtaataccaagtaatttcatgtaatgaggaatcttcagaagacagtaaaataatgtgatagaatcagtagctaagagggaaacaaggagtggggggaccataacattacataatctgaaaattgactgaaaaggaggtctggatgatgataacgagaacagcattctagatggaaaagcatgtgcaaagtccctgaggtgggaaagagaggaggacagtgtctctagaaggtaatgaatacatgggagaatggagttgaaatcagagaggtacagatctacaggtacagttcctacagtgccttgttgactcctctgcaccctttggatttgattataacaacaatggtaatagtcttaagcaaggcagtgttgtgatctgagacatatttgtgaaagaccctttcccagtgagaagcacttagggaactgttgcaggagataatggaagtaaagccactaaaacaggctgatgagttgatcagaaattataaactaaaagaagaggacaattctttttgtttgtttgttttcctaagcaattgagtagatagtggtgccaagacagagaatatcaagattatgtctgtgtttttagccaggtagttttctaggattatcttacatatgatccctttgccacgatctgcgtttctcatacttcattgaagaaagtgcatgcttaattaatttgagtgggaagacactttattgggggtgtaagaaattttaaatacctaaataaaatttattctctgtggaaaacaaaaaaaggggtaccattatattactttattgaatcacaattacaaatactgctccaatctaccagtaataccaataatagagcagcttaagttgtttctgtttaaacatataagatcctatatcaagtaagcacttggaataatatttttcatggcaattgaaagtcttattcattcaaatgatggcatctcattcatttaaatattgacagtacacaaaatgaccaagtataagaattatctaaattcaaatactggtgccaccagtctagctgtttgactaggggcaagttaattaattcagtttcactttcatcagctgtaaaatggtatctatcttatatggttattttgaagattgactgagtgcacactcatccatgtgcagggcttaaaattgtgcatgcaggaagaactcatcaggcatttgcagcccttatagtttttatgtcattatctgttttgattggggattgtctgcagacataggcaatattggttagccctgaccatgtcataatgtgtgattgaataggttcattcctctttttattttcatgtacatatgaatatatgagaatatataagtatatattcatattcctgtatgaatccttagagagaatgaataattattaaacaattaatcagatgttacaagtatcaccataggcaatggcaactcactcagctttgaaaatggactcacggtgtaagttttaatcatcagtttagggaggggaaaaatataaaattttctaaatttagtgaaaaaaattgcttaaaagtcatttatattaatctttttattcaaaggtcctgagtaaaaataaaattatgatattcatgtcattggaatgctatgggactcatatgtggaaagatacataaaatattaatcccaatgcccaggcacacaaaaagaatttgttaaatattacgcctttggtattgttatgatggaaaaagcagaacacttacaagaggtaaatccaggtcttggctttactactaactgtgctttgaagaaatttgatcatgtttaaaatcctacccagagtgctgtttttcctttgcacaaatgagggtttggggagtaacagtatcatattattacaaaaataagttatacttaacggcacacatttttgtaacttcatggtgaaaaatagatgaagacagtctaaaatagagacttagtaactaaaaacattgagatttgtctacattacatttttttaaatggcagttcatgctatacttcagtaaagagtctaaaaagtgccacagtaagggaacctttaaatttgcctaacatagctttccacgacatatttgactacaagcactctttatttcaaagacccttatgaacaacctgaagcattattacttgaaggaacaaagtctgagagacacaaatatagatagcatattatttacatcgacttggttatccaatggagattaacataaatgaccaactcttgaaagactatgtctattagatcaaaatactctaaatgactgtgctaacctatgggtgctgtgcacatatcaagctctgattgtttttttaaagactgtagaataactaagattcacatggggatttttcgctcttagttttgtggttaaaaaatattaaaaatctatggcacaagataaaagtctatttaatgtccagagttaaaagatattactgaattaatgtccacttctgatgattaagggaatctcacacttatatgtggggccacagctcttgtctagcagttgaaatgtgtcatattgtgttatctcatatatatccgctaaattagatttataagtccttgggataacaatctgtatattaaagttaataacttatatgcactttctggctcctattttatctccatcacatgtagaagaaatttctccatggaatatttagctgaaatttctccatggtatatttagttgaaaacaggataggatctcagtccaccagtatatttatattttcacttatatgaacaaaggccttatgaactaccttatactttctgtgcccttctgacaaaaagaatggttgccttgaatataaaatttgaaaaaaagaaaattttaaatatgaatgttagaaaaattgatcttccgatcttgatattactaatttgtacaatatagtctaaatatattctaagcaatgaatttctgaaggatgacattttggaaactctagtttgaaacaatcatctttattttattttgttggatgatctaggtagatgaagattagagttttgaagaagaataattagtttagaagttggtagcatatcagaacccaggcattaatataatttcattgattcctttcctatttattgaatacctaccatgtgccaggaactgtgtcaaatactgggacacaaagatgaagaggaatgactctccaggagctgtccctgtggtcacatgaggaaggcatgcactgagccagtaatgatagatataactgcctttttaaaagagaaagggcagggtataaacaaagcataggaagttttagaaaaaagtgtttgaggggaaatattaatttgggtagttataagatggtcacaaccacagtcaatagttttttttattaaaagcattttaatactattagacatagaaaccttaaaacagcagagttgtccttctgggaaacagaggcctctcttccttctacttggtttcttggctaggatcgtcttctggaaacactaagtattgattaagaaaaaacgtgatgttcctccacccacctgaatttttggagaaactacactttgattaccaaaactaaacacatagaaaaatagagaagacaagagaactgaaataatttaaaatcactgtgaaaaatatttttaccctataaaataatcgagatgactattgccagttttgaagcaagtagcttgatatcttaatgaagatattccctaaagctttataaaatctaattcaggactaaggagacatttgaaaaactattcactaagggaaattagaaattctggattcacgacatcagggaaatgaagtgttgtggggctgatgccgccatttacattgttattccatgaaaatggaataaagctgtagacttcaatttgggataagcacactgagaaaaatgaaatcatctctttgtaattcaaagcagacaaagcattatctgctatttaaatatctcatctagctatgcaggaaactaatacatgtgctaattcaggaatgtgttgaagcttcacagagaataatttgagatatggtcagtgaaacaattatcagtcattgtaaagttttgcatgtgtttgaaaatttaatcatgtggtggacatatctgatattagcatatgtatccataattatcattctcaaattaattttaaaccattgctaaataataagagaatatatctcttaaaagataaaagcttttcatatctgaaaaaagtcactctgatagcaaaaaaataagacttttggtgacaaaaatacacattaagattctctattttaggaaatcatcatttaagaatagcttatcaattattgaataggtgcccttttttattcttgccatatgagtgtttttctgtgatacttccaattttgacaaaaattcaactatttcaataatactcagatacagacccccttgaaaaagttacttaaaaactatccagtaatttgttacttataggtgttttgtgctactgagaatagtaatgttacctttaatttatttgaaaaacagacaacaaatgtcatatctcatagaactaggataatttgtagcattgtgaaactttgtcttttgagttcatagcttattgagtgacttttcagttggaaagctaacactttgatcaagtgattcttactaattctagactatttctctgaggtcaaagaaggtagaatatcattctcagtgtgtatgtaaaaccagtgtggacttttgtatttattgcctaaaataaagtattttacagataatgataagataccctaaggatgtctgagatgttaagtacatcacaaagatatatgggaagtggtaaatatagcttgtgttaaatgggctaatataattttcacctcgtagttactttctagttttatttagttatagttacaatcaacatttaagtgtggtgtgcataaattttgatttggttaatctgaaccccactatttcaagatggtggtttataatgctttaattaaaaccaacattgaggctgggagcggtggcttatgcctgtaatcccaacactttgggaggtcaaggtgggtggatcacttgacgtcaggagtttgaaatcagcctgaccaacatggggaaaacctgtctgtactaaaaatacaaaagttagccaggtgtggtagtgcatgcctgtaattccagctactcaggaggctgaggcaggagaattgcttgaacccaggaggtggaggttgcagtgagccgagatcacgccactgcactacatcctgggagacagagcaagactccatctcaaaaacaaaacaaagcaaaacaaaccaacattgcaatatacaacttcactttatgtaggcaaatacagttagttaccatgcttagttctagtgaaagtatcactcatgagaaagagctgctgcaccctcttaaatatacccaattctcttaatttttaactaaaccaagattttgtgttctgccagacattaaaatgcatttctgcaatgcaaatatttttggctgctgtatactttttccacaattacccatcatttcctaaatagggattgtgcacattttcacctggacccacacatcagtgagtctgaggcatggaccacagcagcatgtctgagcataacctagaaattggcattcttgagcatcagcagttttcactaacaaaaccctcaacccacattttaaccacctggcttagcactgtctaggacctatgccatgtgactactgtggccttcataataatgtttaatttgttttctaaaactttctagagtcatcataaatggccatttgcattcatggtaacaactcacaagtattaaaggcttattgaaaaatgctagtcctgccaaacctctcttgtactgagaggcacatggctttttgttcctgccaacaatactgtgatggatgattccactccctcatgaccaggttactgaaaaagtgccccctggactttatgcttctgggctcagctctctcaaatccattccctatgaatctggcagaacgtggctgtcaaacagtttgcatcattcaatttctttctagaaaatctacattgtttccaactgacctaaaatcatgggcttttttctggggctcttttcctttttttgtctctctctcaagctggtcgcttttagtcagagaggccatccttatgactaaatgccttctcaagcttgactcctgcattctgtgcacccaaaacttcaatagtaaagtccataggttatagttgtctacaaactgggacatctcagggaaaactcatccataaatacatctctgatattcccagtgttttcatttctcaatttgagaagttgtctttctaacagggataaatgaaagctgataagaaattcaagattttttaaatggctaaagtttatataatagttcaggtgtagcaagtgtattctagtgtagcaagggttagaaataggtttcaagttatgttatacagaatcatctttatgtataaactgagtttcataatgttacatgtagctagtctttagtagtacagataagcagaacaaatggcattttcttttcaaggtgtacaaaaaggggaccccaactggagttcataaactaggagaatggcagggaaaagaacttcccctgatggagtatgccatactctctgggtgaacacaacatatttctttataatacccaggcttttagggaaaccatagaaagtaccctctagccgaggggtgtccaatcttttggctttcctgggccacattaaaataagaattgtcttgattcacacataaaatacactaatactaaagatagctgatgaggtaaaaaaatcacaaaaacatttttttaggaaagtttatgaattcatgttgggcctcattcaaagctgtcctgggccacaggcagcccagtggccacgggttggacaagcttgcaatctagccagttcatttcttgaggaaagcattagctcaggatccaagttcttgatacatgctcactgcatctgtaccttgcagaaaaaagaatgatatctaggcacccttgagttctcctctgtgtgttcatcaaagttgtatgcacgtatacctaccacagtacttcccattctgcaatgtagtttttggttgatttgtctctctctaacaccatacaaaaagctacttaaagagcaggcacattacttcattctttttagcctagaattgtactttcttttttttttgtggtggggagggggacaattcctctaaactcacctctgtgagaaataaggtcagatttactcctctccatcccaaagcagttaagtaagcatataactgtatgaaataatggctaactacatggacaactagcattcagattttaaagcaaaatattcaactgtcttgtgcctcagatatctcaactagagaataaagatgataaggctccctactacaggtttgagaggtttaattaaatgtgataatgcacctaaccatggcctagtcaagggcatatggtaaatctcagtaaataacagctattatttgtattccatttcatatctttgatatatttccagttgttccatgctgcttatatgttgcaactctggaaagattgcaaattactagaagacaatgtatgtccctccatttctttagtggctatagtatttcctcatgtcttgtactcaaatccacccacagtttgtaaatggaaagggttgccaaatttcaaatgaagtacagagtagagtggaggcaacaaatgataggaagttactgtgtgaaacaaatcagccttcaaatgtgatcagggaactggggccatctcctaatttaagaatatgatcagaatttcatctgcagctgatcatttaaattaaacaaacaagcacagctggaaaaacacatgcaaattttggtatttcagtccagcaatatgcaagcatatccactgtaggagtaatttgctgaataagcctcattaatgagctctagcactagtttattctgagtagtcatgctacactctaataaaggcaacatttttctgagcactacataaggtcaagtcttatgtgtggtatctttcctcatgaagcacagtaccagtctttctagtcaagaatttctcccattataggtagcttgtcaaatatacatggagccatgtatttctcaagacctcattctgaagtacctttagacttaattgttataatccattctacattagggtatgattcagaaacatcagtggatggattgggtacaacctatccattactgaactgtattcttattaaccatctgtgcattgatttagcttcctattacatttgcaaacttgaggtctaaaaatagaataatctaaaggtaaagattttagctcatcttcaatacaagagtaaggtaagattttgcaattttgcaatgggaggctactcaacagcataccgaaagttactgtcctctccagaaaggagtggcacatatatctaaccatcccaccaccttcaaagaaatatggatataacttgataggcaaactctgtgttctgaccttgcagcctagcactggtttacatacgtgagaaatgggagctgtttagagccctagtcatttttcaaataatttcaaatattcctgatcaggctctaaacagctcccgtttctcatatgtgtaaaccagtatagctacttccctctctagctccattatgacattttcaagagacaggagccagaaatatgctgcagctctatccctgcagctgcaactcccaagctggaaggaggaaatgtcagcaatgcaaaaagcaaaagaagaaccagaccaattggtgctgttaggacctgattcattagcatgggccagggtttattttccagtgtagaaaaaactggcacaaatgcttggcaatgtgctccaagctctatcagggaaaggaattgatcatttggataagaaacaaaaaaaagtctctctctgcttcactgtgtctcttatgtgtggtgctactgtactgccttaggaacaagcatagtgtgtctatttttagggcaaatgtgcctactctatcttcgccaactaaatctttctacatgactaatttgcaagttgaattatcttggtaaataggctgactcactagcaaataatctgcagaatttatgcattaggcttctgtagtgaattaggtccttttgtcttgctcagcatgctgtaataaactgcagtagtgctctggttaataataaaaaaaaagaaaggcaaggaagagaagttattccaaacacatgaagagtctttctttagaatagttagttatgatagagatatatatagcaggttatattgagagatatggcaatgacttaagtcaaataaggaaatgaaccatgatataaatagatatatgcatagctgatgtgtgtatatgtaagatatgttttgtgcctctgtttgtgtgtgtatgtgtgtgtatgtttatctcctaaatgagttaatggaataatttatacttacataatcatttatcacaaaatgtgcatagcaatcagtatccaacagctagtagtcattcaagaaacatttgtaaaatgaatgaattgcaatgttaggttaacattctccattgtcagtggtcctccccttctgctgtccctactccctctatgcttgtggtgattcagttgcagaaagacacatctatatttcatagctgtagaaaaattctttttttgtggttgatttcatgtggtttaaaaagaatgccaaattatttgtacctacagggataatgaccgactaaatttttttttcatatatgtgcgtatgtgtgtgtctatgtctgtatgtatagtctaaatattattgtccaatcatggcagggattatggttgtatgtactcgagtacctaagagtgggccaggacagttattcactaagggagtgtgtgtgtgtgtgtgtgtatgggtgtgtatgcatatgagggctagaagtattttattagtcagtttccacaattgttggtgcatgaagataataaaaagcagacttacttttagcctttttttcttttttttggtttgtaaattctttacagaaaatgtaccttcttattgcctgcacctggtgtgcactgttcctaccacctctcttgctagtgccaagattctcagcagaaacctgcaggagtataggcagcacagtgcagacaatgtcactgctccatccatacctctaggattgtttccccatcacatgtgtcggctccagtgtctcactcccaacagcatacccctgaggatccctggaggaaagcagcccttcagctgctgcagcctgctttgcctgcacacaggaaaaagtacacatttggggcagaccttaatgaggacgtataaatatctggcccctgatctgacatctctgaagtgtgatctccactattaccagagttcccctgagggactatgtccatgggactttgtttatctcacatccttacttgctgtccttccctgtgccatttcctcactcatgggaatgctttctagtacatcactgtctcatgaaaccttgtcttagcgtctgcttattgggacagtgatggcaacttaagtcatacgtaattgttaaacctaggattggcaaaactgagaatcactgggcaattttatataaacgcttttccagagaagagtgaaaagaaattcttctagttggtatctctggtagataccataaagtaataaagaaaagctaaaataaaccccagagtctaactcagcatgattctacactttctgtaggcttctgtaggcttctagaaattccctggaaagggaattgtcaaaatataaaaaacagtgagatcttcctctcactctaggggtgccctttgtccccatagttatgctttcatgggggaaatatgtgattatttcctctggaatccaaggtatcattacgtaaaaaaaatttacttctcttacctctgccctttacccttttcagaggtagaattaaattcaagggtacagctaataactgaatatatggtaagtactgatttcatttggggactgcaaatacacagtcaaacaaacattccataccttcagctgtattacaatacagtaagagtgacagatctgtgcaaagcaactatgaagcaaggaaggaaatacatgccacaaatagaatgataaacacaagtctatgggagccaaaaggtgagaccgatgaactctgagctgagtgatcaggcaaagtagcagagccaagaaagctcttgatgagatcctttaataggcaagatttgatcaagcagagtcaaggacttccaaactgagaacaacataacaagggcagctggtcacggaaaccaagtgtggagagcagaaatagaatgggctcacaatgcaggtagcactgagccggacagggagcaggcagactggtgaggtttcaggaacacaatgaatacccgctggctggatttcattgactgaaattccactgaccaactgaggttgctcaaaatgcacatttgtgcaaaagcgcaaatttttaaaaagtcaaataagtgacggaagtaaagcaattttttaaacattctgaaggacatagtaggaaaattaagagataatctaactctaattaccaaaataagtatataaataaatatgttctcaacaaacttacattaagcatcaataagtacaaggttatattatggagccatatagactccctttcctcatggaattgacagttttttgaaaatcagatttgtcatgggtacaaacaacatacgacaactagcagagtatcacaatatatacttggtagataaactacagaagttaaatatgctattatgccaattggtagaatactgttaatagaaatataaaccagtacttgaagttttagtgaaacttattaattagacccaatatcatgaggacaaagctgagaatgattagaaacagctgccacaatgtatcttgggatagaatcagtgtcaaatgcacacattctgtgcaacagaacaaatattttcctatttgatttcagaaaatagataacccagtcaagtatattgatttaaggttctatttaggaaaagaaaaaaacccttcactgcagtctagtgaagaaaagataaacaggcttgtggtgtagaaaatgtgggggctcaaacaaacactacttgtcatgtgatttatcataggttgggatcaatttttaacaatataattgataatagaggcaatggagaggatactttgagttcttgttttgtgataagtggtcggttaaggtatgtatacatatttatttatttcttcactgaacttacatttattgagtgtctgtttagtgtcaggtagtgttccagatggtacagacctaatggtgaataaacagcaagaaaggcttctctgatcatctgaagagagacctacatgagagagtaaggcaaacagttgtctgtaggctcagtgtttccagcagagggagacaggacaggagtttccagcacaggagtcagggatgcacatgacctggtcagggacttagtcagaggaggctggtgcactgaggtgatgtaagcaggaaatctcactggagatgaggtcagtagtgaaggcaggagcagagtattaacaaatttatcctcacaatgattctaccttataggtattattatacccctcatttcctacttgggcaaacaaaagtttaaaggcattaaatagtgaggcacagcaaacggaatgtaggcaccatgaagcccagcatatactctaatccccacatccatcaccttcctgcggataccacatctgtgtattcgagcccccgcttatccaaagttttgctttctgcaatttcatttactcttggtcaactgtggtctgaaaatattaaaaggaaacttccagaaataactcctaacttctaaatcacatgctgttttgagtagcatgataaaatcttgcactggaatatgaatcatccctttgttcggcgtacccatgttgtctatgctacccaccctttagtcacttaaccatctcagttatcagatggactgtcactgaattgccgttcttgtgttcaagtaccctgattttacttaatcatggccgcaatgtgcaaaaatagtgacgctagcaattaagatatgccataaagtactttctttaaatgaaacagtgcacgttctcaacttaaggaaagcaaaaaattgtatgctgaacttgctaagatctacggtgagaacaaatcttgagatcatgaaattgtaaagaggcaaaaagaaattcatgccagttttgctgttccacctcagactgccaaagttatgtccagagtgcatgataaatgctcaattaagatataaaaggcattaaatttgtgggtagaagacacgaacagacatgtgttccaattggtggcaattgtgttcggtactatccaaggtttcaggtattcactggggatgatggaatgtatcccccttggatatggagaactactatatgacactaggagagctctagcttcaaaacagatgagaaatggtaattgtgttgactggctcacaaaattaaaagaattagacttttctatatatgtatttgtttccgtatatttactatataaatattcattgttctgcatttcaccattgcataattcagttcataaattatgcatttatgttgtattttgtttttataataaaagaatatcaaatatggtactaattgtccaagttcatcctcaaattcctgtaatatttcaaataataataaatccagaataaaaattgagatatcagtaagctgccccttgcaaagaaagacacctttcacctgtatatgactagggatgtccctaaagagggaggtctcaggtgaatgttggaatttcggcatccataagagagagggtccaaggccttctgcctggaaactcccaaggatgttcttcaatcctaggcttgtccctgaaagttgtacttttccttcctacataggttctggggacaccctttttgccaaaacacagttactagattataactttattgaaggtatacatctatcttttccacagcataggctcttgcacataagaaacactaaagaagtacacgtttattttacttttatttttgtttattgtctattgagcattttatttgtaagcattacatccctagaaaaataatccccaggattttccctactgtgcactttcatcttgctcctttgtggtccatgatgccagctgaggttgtcaatacaactaaactgactggagaagagcagactgttttgccatttttctaggtctttgagttgtacatcgaagttgaggctaatcatgccacacatgtttaacctgcctgagggattcgcagctcttttcccagctgtgtaatcatcaatgatttcaaatttgccagtgtaaccacgcttcatcatcacagtgagaaaccagatgatggctctggagcacggccccataagaacctgatgtttgcctctctttttagcattgttattgctcttgagagcatcagccaggacaatcatgagcaccattatggtggcatggaaagatggtggaaaaaggacagaagtacatgtttaaatgagagatcatcttgcttctaaatgaacggtgatttgattgcctgtaggccgcctgctaaggagtaaaactttttaccttatattcataaagcatgcatgtaagacttctgggttttcaaaagggtcatcttgtattaaaaccttgattattcaccagacctttaaaaaaatggaagggtgaacttgatgacggtaagtaattagatgtaatggtcactaagcctcatagtcttagcttgtaatagtagtgaatcatgcactccatgagaggtcactaagactggatttaccagctaaaccttacttttctcaagtttaaagggaggagttgtacattgaaatcttcatataccataacctaattgaatagtgacataatacctacttctaaggactatatattcaaagtattatgaaatgtacaatgatgcatttgagaaaattaataagtcagagattaagactttatcacagtatctgctctgaggtgagactctgtaggatatgcatggagagagaaagtggaaaagatggttagtgtaaaggtaagtgctaaacctggtgtatgggtggacaaaagtaagaacagaaaacactgatcctggttgtcgcctcaagtctcctggtatgctttctccatttttgaagataagtgaagttcagtggtagggcatttgattcccacactgaagatcaatgttgactatgaggaggaagaagaaagaaagaaggaaggaagagataaaacacacttgaaacagcagcaagatcgtggaaaaatgtctgcttttggccaccttcatcacctggctgtagcgaccttttctgtttacacacattgttcagagaataagcatctatagcttctgaaagtaaatgttttccctcatatatccccagaattcaaaacaacaagtacaacttttaagttgcaaatcacaccttgcatactctatttaaattgtaacaagagagttttattttttctttttaatttgtgagttcatgttcgccaacttcctttgttattaggtgacaaggaaaagcttcatgaaaaaaattattgaaaaaacccaagtgtaactaatttcttaatttgtattcttacccactcttactcataagacaaaataaaatccagagagggacagcaataagaaatagtgacaataagaaaatgaagaatactttgagggataagcagaaggggagggaacaaagagaaaaattgctgcacaccaacttccttggatgtcatgtagtccctttgtaaattgtctggaacaagacaagcacaaacagaaaaagcaaaccaatgagtcagaaatggaattcaatttcttgataccacaatagtagaggtacgatggctgaaaaatagaaacaatggaacaaaatataatttatttccataactcttgtagggacacacaaagcagtctgggtcaataccttatgtgacaagcacatagctttgtagtcttagcctgcaaaattgtttaactattattttttcaagaaattctcacaaacccacgcctatgtacaactttttactcacttccttaaaaaaattaagaacttctatcagagagtcatccctgtgtgtaattattaaagacgaaattttacatgaagatgtgtatgagtacttggttggaggtaacaaagcaaaaacatcttgggaattttgtcttcttacctactcacaaagaagcaggggaaaatgttatattcatacattgggaattatatgtgagaagattatacaagaaatctgagtggaagattacagaatcagtcattattagcaagaatgattatgtgtttgtgacccagaatttatcctggtttcattacagctcataaaagcctaaacagagagctacagcttaaacagtcatattataggtttccccttcctttagggtatggttcactgtgaaataaatgaaaatactagaaatattttggtgggtggtttgttttaatagaaaattctttgtaaaaacgaaagtggggagtgttgtcggtgtataagggtaaaaagagaaaaaaaaattcttgcatgatgaagacttgcaagactgaagtttacataacgttcaaaaagatagttctcccacttgtcagtgagatcatccactctcctattctgcatctccttagctagatcccagaagtaagtaaaattaaaaaaagcctaagccagggtatgtggatgtagaaaattttaaaaaaagtaaaagacagggtgggggagatcagagagcacccactttctaaagtcaaatttaaattggtgatattaatatccatgatatttatttcagcccccctctattgcagacttaagtgtggcacaacagaattctattcacatactatgaatgaatctcatgcattcttgtagtgactctaatcattatattgaatgtgctgaacacaatggtatagaatcagaaaacaacttatttttttcccacactattctcttaaacctgacccatggactcattcttccttaacctgtggatgaaatattttcctattacttcttgatactaaaatagcttcatgttgctctcacatgctaaatatcaccattttagcaataaaactgtttagtccagggagctactgacttcacagaaggtaatactttcccgcataccctactgtggcttggcttggtactgctagcctgggaagtttcttgctgaagacaagagaaaggtcaggctcttatctcacgcctatcccaatgcctctctctgcttcctggccacagtttctgaatccatttagggagttagtgcagggaagaaatgggacaaagaaagaaaaaggagaaggcttccttcgttgcctcaggtgccagtgggttattgggctgccttgtatggtagtatttccatactaatgctgtgttttctgttgttggatgcttatgtgggttatatgtaaaatctccacagtgacaggagacacagcaataaacttctctagctggtcatttatgatggcaattcttaacattctatgggggcatacagtagtcaactctacagagatttggtgcctccggacagcagtcctagcaaaattctcgttaagttcactgtagatggttcccagtcctgtgatccattatcatccatgggaaatgtagacttttgttcttaccatcagtagaaatgatttcactcctaatgcagtgagctctctcatagatgaggacacagctccagtcaaagcgtattgtctctaaatttctcaggcagaaataaaatatcagggcgttaggctcctctaaaattctctcatttgactggaggatatgtggtaaaataagaaatatgtatttgatcttggtcccttgttcctgacagaaggctcctaaaacgcttgtattttcctgagtggggtgataagagtgtctttcagagtgacaaagagctcctgaattccttggaattttctgggtaatagcaatccctcttattctagtgagatgggtcttggtgagaaggatagcttttggtttccagaaagatgaagctttatttgaggcctactttatttatttattttattttattttattttattttattttttttcagactgggtgttgctctgtcacccaggctggagggtagtggcaagatctctgctcactgcaacctccacctcctcggttcaagcaattctcatgcctcaactgggattacaagcatgtgctgccatgctcaactaatttttgtatttttagtagagacagggttttcatcatgttggccaggctggtctcgaactcctggcctcaagtgacctgcctgtcttggcctcccaaagtgctgggattacaggcgtgagatactgtgcccagcccgaagtctactttcaatccccccactccaatcaacaaccttttaataccactccccacaacttcttggaagagaagaggagctgagatttagtaatgaggtttggagaacttccagacaggtgatgcttccatatgttgaaagggtggtgtaccctaagttagcaggacagaggctcacttttggacttctctttatgaacctcttcaaagcgctcttcatttgtatgctttataaaacagtaatagtaaataaagtgtcttcctgagttccttatgctgcaaattatcaagcgtaagaaagagattgcaggaaacccctgcatttattgctagttggtcaaaagtttcagtggtccaggacttgcagctggcatctgaagtgaaggcagtcatgtggaacggagtccttagcttgcaggatctgatactaactccagatagttagtgtcagaatttcattaaattgtaggttacccagttggtgtccagagagttggagaactggttgctgatatgaggaaaaatcctacacatttggtgccacaagtattgtgttggtagaaacagatgataataggtgaaaagaaagcatttctccagttctttccagacgaatcttaactccattagattcttcaactttaaaattagatgaacagccaggactcattaaactagcattttgtctttgcctgtcctgcaacagtagtccagcaccattcctaaaaatgtgaaggcatatggcatttttttgttctttacttttggaaactcctcaatgctatttgtgtctgaagagtatactttcatttaaacactattataccaacaaaagcatatttcatattttaaattcgagttgcttatgggtctcaagcagaaataaatgaggactttgctacagaaggagcaaagtagactattagactcacctctactataaataaatttagaacatattcttaactattttttgtgcctattatagtcttttcataagtagggactgatgagaattggccacagtgactgttttatttcaaaggagcataactttttgtttgtaaataaaagtcaacttagaaatcatttaatttaccttcttaaattacatagatttgacagacagttaaacacacttaagaggttaataacattaaaactatagctagagagagccatataatactagtatctcattttgtaactaactagatagccaaaaaataacatgaaagatagaaaaaaatggtttcaggttttctaaatatacataatcatgcagagcaaaagcaaagctacctaggcagacatcgaccaacttttttatgctttgtgaaaatattccagaatcttggtcagaatgtgctttcttatgcaaaaacaaaaacaaaaacaaaaactcgtcatttaaaaagagttgctacctaaaaatgtgaaaaaaattttacatagcctaaacagactccataaattcaaattgtttcattttttttgcagtcatcattgacagatagacaacctatatgttcttttgctacaatttagtcactactttttaaaaactgtcatagaagtgatacatttattgtgcacgatgttttctatatatatatagtgcaatgtttcattataattaactaacacatgcattaccacatatattcttttttcttaatatctatcttcatttgaaggttttttttagtacagatagctttttatatggtaaatggatttgaggtttactcctttcttaaaatgggacttagcatgtggtaacaaatattagaccctcagtgcatttaaatattaaactttgtagagttgtcacttttctctctttattttctctcagcaaaatcctttgaaacacataaaatagtatcccccaaggcaaagcaatcagaagaaaggtatatctcacagatcagacttaaatgagcatcatctatttccagcctcaaatgagttgcagaggagttgctagtcagaaattgggaaataatttccaagcagtgctatattgacaatgacatcattaacattattaaagatattgaagagattctccaaatgaaatgtaaggataaaatttaaaaatctcaatgtcaaatgataacatctgtttttcatcaactgtcattttgaactattcttattgcatctatgagaatttatgaagacatttttgagaactgactacaatgtgatgcattaggatcttcaggacagttacatatagcctttataataacggggaaaaaagttgtattagttaatatgaataaggactccttattttcaagctgaagggaagtgcaattgttgcaaaaaatggtgagtagtttaattttttcaagtgattgtgattggaatttataataaaggttaatgaatagagaactgaaggacttgcttttcaaataacctgaaggattcaaattaaaaattcttacttagctgaggcactattaaattaacagttgtatggggcaggtgctctcaacttcttctattctctaactcttctgagagagatgacacatgccagtaaccatggctcaccacaaaagggatactaaaatggcagctactccctagaaaaggtacctcagtggattcttccctgtctgtctccactactacaaccctctgactcctccttcataatcactgaaataaggcttactacctgtaggttttaaagacttgctaagcaccatacactataaccttaggaagtagctggaggtcattctctcctactcagggaagaagatctctaatttgaaccaagtctatcaagggttctttaagaatacccaaagaaggaaactgggataagggaaaaactttagtgaatctgtggaaggaatgaagtgatcataaatagatttgaatggaaaagaatgttttgattttttttcctgatcactttgctcatttccaacatatatacctggtatactaaaatggactctgagaaacctagatttccctgtctttggaagccacacagataacaggatatgattctgggaaaagagaatgtggaactgactgctaaagcttccttctaatcttaacataaactaaaggaatctttgaggctaatgtatatgtgacagtctaccaagatgagaaaatagatgcatttaatgggccaaaaacctacgtagtaataaagacagttttagtcacaagatttctctgtgcatctttgttaactacatagggataacagtgaatacattaggcagctagctgttcaatataatgagatttctgtcctgcccagtggatttttttatcctcctctatgtaaatgaaaatgtagtaatatatgttacaataaaacgtttgccatttccccacactgacacaaattaagcaaatggaaatatatacaggcaaagaagagaattcctttgaaagactcagtaatgtttagaggagaatgatatgaatagtcagaaagtatatcttgtactggtttgaaggaattggagatagataacttctttgggtacattttgagggatgccattatggaaaggcactagatttgctcaatatggtgcacattttcaagggcaaaatcttaaagaagacatgtttttaatagctaaaaagaaatattttgaacaggattctttaaagatgggaaaagcagcattgagtggtaacaagcaggctatcacacatgtataggcaggtcaaaagtttctcagtgccctcccccaccacacaaacttacacatactgatgcatgatgtagacattcaaaacatgttcataagattccccacattttgctgaagggatccaataaatagattggatggcctgtagattatgtagtattttgccatattacttgaatacagaagaaacttgaatgtgaataaaggtaacaatgaatgaaatcaactatatcatgacaaaagtaaatcctatgaaaactttaagacattattttttagttacttttaaaatttcaacttctctcttaaatggtggatatataccagttatgttctgacatattgagaccttctgggctaggtggccactgtactggatttcataaaaaggactcaactatcagacatatagttataacagatgacctttaggaattcttccaaaacaaagatttttatcatactgcaacagaaatgaccagtggtctaccaaagatttgtgctctcctttaaaaacagaactgttgctccttagcactagtctaaccaaggatacatttcccagtcccattgcattctagatggggtcatttaactaattctccaatagaatgttaacagaagggatatttattaatactaagacaaaatagctaagaaatttttatatctttaccatgctctcattttttgtgctctggttaaaaggcaaaaattacattgttctagtggaaggtagagacataagactgaaggcatctgagaccatgagtcacattgtggaaggccaccaactttacaggcacattatagtaactgttatattgctgggaaatatatagttttattatattatgtcactaataatttggggttaattataacagtctaccttaagttataaaaattataataatttctcattttctaataaagtttaaagtatttcatatggtctggctctgtaataatattataatttattacatgctctattaatatatacatttatagaaatggaagaaatgtcaaaagagtaactttaagtaaaggctaccttttcaagtatgatcaactgatgattaggcctgggctttacttttgattattccagctttgtcatatttcttaaattccttttctttctcatatttaaatataaaaattttccttacaaaggggtgctgtagagtttcaaagcatattaaagtcttttgtctttgacaaattcaaagctctaattgcagacttgtgaaaaataataaatttatgtcattctaagacactaaatctgggagtgatttgttactcagtgaaagataaccgaaataagtatcataatcatctccctcacatagtaaattctgagtaaatcttgaactgtctagaagtctgttttactcatttctcactcttcttggtaatttcttacctcctgatcagaccactgtccaactctaatcctcatctatgagccaaattgaaaagtacaaggtttgaaatctcataatttcaagccaaaaaagtaaagatcttatggatattagttaactaaatttcagagcagtcattctgatgagttgttttaattatagaattatctgaaattctttgttaagctctgaataattgactaatctatagccagtttataaaaggagctaaagaggtggaagcagttggaaatgtctgatgagatctgattttgggtgagcactgacacctatcaggtgcagtgagttccatgaactagagttagctgatgaaataggaaggggtatctttgctcctgtgagtcttctaatctcatggaatattaagccatgtagatgaacatgttaaaagatgatgtagcagatgttaaatgtcatgctaaaattatagcatacattactttgaaatctttgatttgtcatattatagattatgtactccctctgctactagaattgtgaaaacggcccccaatagggaggtttagcttaataaatgtagcctctttgttctttaggctgctgatccaagtgattgattgacacttcatctcatccagggaggtgggagagtgtcataggcagccaactctaatttttgatgtctgacagagcaaatgacattcttgtgacagactttctctttccctctgaactgcatcaatgtttatttacgatgaaggggaagttgggtgaaaaaaaagcagtattgtttatcataaataatgatgttttacattctgccttataggaagaggaatgactgggccatggtatatttataacctcaatatttctttaatactttaaatacataaaacacaggaccaaaatcatctacaagctaattcgatagtactatttaatgtccttaaggtatcaataaaagattattattcattctctgtttgttttgtttttaaaactgtgtatatagttttcacattctgtaagaataagcttttacacatgtacctgattctctgagcttataataatttctcaggtttaacagtggtggtgtcttgataaaaagattctgtttgagatgttagcttatgggcacctattataatgggtggaattaaaaacctgaaagtgtgttgaatgattccctcaagtaatgaatgataaaaattttctttcaggatgtctgcagacctggaatccattcttttgagtgagataattccacattcttccaagcaaagatgactttgagaaaagattaaatatgaataacaaggagacattcactcctggaaatggggactgttgggaagatagcactcacaaatgaacactaataaccacagtggagaagtggatataacagtgtgattgaaaggcatttatatatgtataatcacttcattcaactttgttaaatagtctagaaagatgagaaaacaatatcatgcaatacctttaaaaaatatgaacattagatgataaagcatggacattatatagacgagaataatgaagcaacttgtaacatttctgttgtacaaaataataagccaaaatgaacctgaaggtgtgtatggatatatattatctagtttttaagaatgcattgcagtcgggtgcggtggctcacgcctataatcccagcaatttgggaggtcgaggtgggcggatcgcctgaggtcaggagttcgagaccagcctggccaacatggtgaaaccccatctccactaaaaatacaaaaactagctggctgtggtggcacacgactgtaatcccagctacttgagaggcggaggcacaagaattgcttgaacccaggaggcagaggttgcagtgagccaagatcatgccactttactccagccaggatgacacagcaagactctgtctcaaaaaagcataggggaagaagcatgtaaaagagtggcacattaaagagatcaacctaaaaaggcatagtaaatattagataacaaaaaatgacttaccaagtaatcttgaatataagacaaagaaacagtagtaacagtagttttgtttggttttcaatacttatgagtgaatgtaaattgaaggttaaatattagagtatgagtgagaggctgcgtgcaatggctcacgcctgtaatcccagcactttaggaggcctaggtgggtggaccacctgaggttaggagttcaagtccagcctggacaacatggtgaaaccctttctttactaaagatacaaaaattagccaggtatagtggtgggtgcctgtaatcccagttactcgggaggctgagacaggagaatcgcttgaacctgggaagtggaggctgcagtgagccaagatcatgtcactgcactccagcctgggcaacaaagtgagactctgtctcaaaaaataaagtaaaataaaataaaataaaataaaaattaaaataaagaaagaaagaacatgagtgagaatgggctgtgaaaaaaatactgagattacttgaatgagtttgtaacaagcattgtaagtgaaagaaggaaaggagggaaggacaagccctctatttctattgccttttatatgactttaggggatataatattttagattattaagagataatggaaaagttgtcaagaattataatgcttatcctaaaatagacaattgagtcagtgtgagcaagaaaattgtttacctttttttttttttttgagaaggagtttcgctcttattgcccatgcaggagtgcaatggtgccatctcgactcaccgcaacctctgcctcctgggttcaagtgattctcctgcctcagcctcctaagtagctgggattacaggcatgcaccaccacgcctggctaattttttttttttttttagtagagactagagacggggtttctccatgctggtcaggctggtatcgaactcccaacttcaggttatccacccatctcggcctcccaaagtgctgggattacaggcataagccaccatgcccggccaattgtttaccttttaaaagagttatataggtgtgaaactataagatagtggacaaatcattagacaagtgggatgttagaatgcccgtttgtgagagataaataaatgcacacgattaaatggaataaactctttgaagaaagaaatacgatgtttgaaattaaagggcttcttttctcaaagttgctgatataggagcaatagaaatatagtgactctgtgtgaatatgttctggttacaagtagcactaggtcttactgaataaatttacttaagagaaacacttggagtatactcaaaaaaaaaaacaaaccctcatgctctatgtagactctggtcagcacctcagatattctagattaatcagtataataagatctttagaaccaaagctgacatactacaacatctggctgaacttggtgttagagagaataatgaaggaatattctgataaagcacatatgagccaacacacacagtcaaaaggtctgaattagctaatggagttagataattgtactgatggtaaatattttaacatacatattttactaccaactttgaatgagaaaatttaatgtttcttcttggaatatattctcccataaaaggaaatattagtcacatatcatcaaacagcatgcatttaaaaaaataatttcaattcctattttagattcaggaatatacatgcagatttgttagacaggtatactgcttgagagcatgcattttaaaaggcacactttctgcaaatatttaataaatgcaatgagaaatacactagtacaaactcattacccttcgtaaattaaaatacaattgagaattaaggcatgaagaaatttgaattcaagacgctatgtggtaagccattctgaaatggtataaacaataatttagaaaacaaaaatgtttagagagagaggagataatatactgtctccaaagaagacattctgagttaacttctaacagtgttcctcaatatgacttgtattctacaatgttaactcgactgttctttgcctcgaatttggagttaattatgtcattttcgttttccttttcagctacttttaaaaaatttagtttatttccttttttaaaaaaatcttagcctgagtccgtctatgtgctttaaacataattttaaccttttattaatgattttccttctcaggccacagagtcatttttttctgttttttttttttgtttgtttatttgtttgtttaacttttattatttttctaatgacaagagcacatattttgtaaaatcatttactgttattattttcacaagttcattcttcttccaagtggttaagaggatagtgctcatttttatgcaattaatttaattttttatcttttccataagatgtcttccccatatttttttttttttttaatcttgtcatgatatcctggttaatgacatattgagcatatacctgctggccatttgtaagtcttctttgagaaaatgtctattcaggcactttggccatttttaaatcaggttgttttgttgctactgagttacacgtgtttcttatatataggatatgaattctttatcagacatatggtttgtaaatattttctcctattcagttgcctttttcactttgttggttgtatcccttgctgagcagaagctttttagtttgatattgttccacttacatttttgcttttgttgcctgtgtttttgccatcatatgcaaaaaatcattgccaagaccaatatcaagcagttttcccctcatggtttccttctggaagttttattgtttcaggtcttatgtttaagtcttcaatccattctgagttgatttttgtgtatggtgagagcagagggtaaactggtggttacaaaggactgcggtgagggggaaatggagagatgttggtgaaggggtacaaagtttcagttatgctggatgagtaagttctgaagatctaatgtgtagcattgtgaccataggtaacaactctctggtgtatacttgaaatgtgctaagaggatagatcctaagtgttgtcagcacacactgagaggtaactatgagagtttatggatctgttaatcagctaggttgtggtaattatttcacaacattaacacatatcaaatcatcaaggtgcacccttaatatatacaataaacaaacaagaaaaaattttctaactgaagaaaggaatgtgtgaattaatctttgcactcttgtcctctgggactgaaagaatataccacttcatggcagggttgagatgcagcgcttccagttcaatttccagcaatggccagaaatttatctagtatggttctgtgggatgaaggtatattttcttctgcccttcaatagttctttaactagggagagaagtatttatgtcctagtgaaattaaggccgtctataattctttgaccagaaaaatctctaaatgcctatggctcagcctatttctactgttctgcagaacattttatgctggaaatacacctccagaaggaaatgtgatgccatcaattccccctccattattcttgatgtctttgaattgttgacttactgatgatgggtgaaaggaaaacgactcttactttctcaagaaggattacctccgaaggctggcataggtcctggaggtttggggtataagacagtggcctggttttctccatagtacaggtcctgcatccccaagaatttaggaggctgggttgtactattttaaagcatgaagaattcctctcatattgtggttagtgtttaaccattagtttcacttttttttttttcagaattgagagatagatttttcaatcagtcgtcttccttccatcttttcctttcccttccttccttccttccttgcatccctccctccgtccctctcttcctccctcccttctctttctttcttccttccttccttctttccttccttccttctttcctgttttatttcttttctgctttctcctttgtgcaggtgtgggttttttttatttttatcagtaggagacagttgtaacaggatatattaaactcttaaagtgaaattacatattgaaaggaaaacttcaaattaactgcattttctttcattattctctgtctcaaacactattagtcttatcaaaattgttatggaattaataccgaaatgtactgatttatgtgttatggtagctgcttctcccaagttctataaaaatgctatgaagtagaattattttcagagtagtgaccagaaataggaaaagaagaatagaattaaatttttcaaaccaggcaatttatttttgaatgatcaagagtggatttctaaaacttaaagtataataataaaaaagagtggatttctcaatatagtagtggctgtctaccttaatttgtatctgttatttttaacttcaaaatttcaaaataaatattttcattgatctgattctaatatttaacgatgaaaggtgatatcattttcttcattctcagtcatcatcattattaaaattgactcctaaaagatttaattctctttttagatatgcctaatacagaaaatattctgaggacatcttgttcctgttttaggcattacaaactttgattctttaaatgatgataagtcataagtaaatacttttcctgctctgcctgtaaacatggatacacgaaggaaaaaaagagtaaagaaggtttgaaatgatttcaaaatagtctgaggattaagtagaaacaaaagaaaggttataactgagagaagaaatgtaaaacataagcactgtattacaacatttacaatttggtgtatttttgcctttctatttttagaaaaacattagacttacttatttagatgagacacagagaagagaggggaaagaattactataaaaaagggaaaaagatatataaatttttgcaaaattcataacgaaagatgaaaaagaaagttatagtaagtgttgggagataatatatataattttatacagtaatattttggcaactcatgaggctcatccaaggatgtgtcttctttagaagatgggatattacataatggcatgccatggtgtactgaaaacagaacccagggggcccctggttctaggtggtgattgtcaaatagactatgacaaaggataatatgagtatccctgatccattgttcgccttggaatgactctaaaaccacacaggccaataagtcccatcatcagaaatgcagacagctcaagcctgagagcatatattaatgttgtgcattgttgtccaaacacattaattataaacctttaaataagaaaggtatagattgctatttatttcacagagttttacatcctataaaggaattcctttcagtttgatttttttaaaagaatatcttcaaatattgttttttgaaatccgagggaataaattttgtacaagtgtaaaactgcttattagtaacaactctgttttaagaactcatcttacacaaatggcaatcattaacagctaagaggataggaccagggaggctagacatggagtcaaatcagaataaccctagagtttcctaattacttcaatgaaagagtcaaaattaaatactctcatcattccatgtagtccaagttaaaaaaatgtatgtgtgtgtgtgtgtgtgtgtgtgtgtgtatctactgtgagatggaagcacaaagccaaaacagtagggtccaggcagctgcaccaggaagaacatttggtcaaacttgttactcaaaatagaaataagaaagagaattgtaaagctcttagaacagaggggattcaaacctagaaataacaacgaagaacatgtcttagttttactaacagaatagcactgtgaaaaaatggaagcaatttaaattttctgtagtacatttatttctcaggaaaatggtttcccactgtgagcatcctctcctttacaggctctgtgctcagcagttcaaatatattcaagccccaagaatacctgtaaagattgtggattacagagtgaaccataagtaggcatcaaaaatgaaaaaaataaaaacgaaaaaaataaaaacaaaaaaagaccagaggtaggtatgtattgaaaagaactgagcaacatatgatccccattttatttttacgtgacatgaacgatactactgaagttcaaagctttccacttttcccagaaacccaatttaatttcaaagtgcactttgaaaggatcgaaacaacaataacaaaataaacccatagatgagtaatgtgctttcaggatagtccctgaaataaaatctgtaggatccctacataattgattgaggacagtaaattgttctaattagaaatatcttaaaagcaatgaagacaattcaacagctaacaatactttcaggtgagtgattttctttgccattaaaagaagcttaatacactctaattgctttcgtacctttaaatccaacttgcaagcgcggtggctcacgcctgtaaccccagcactttgggaggccgaggcgggtggatcacgaggtcaggagactgagaccatcctggctaacacggtgaaacccgtcgctactaaaaatacaaaaaattagctgggcgtggtggcgggcgcctgtagtcccagggactcgggaggctgaggcaggagaatgatgggaacctgggaagcggagcttgcagtgagcccagatcgtgccactgcactccagcctgggcgacagagagagactccgtcccaaaaaaaaaaaaaaaaagaaagaaaaaaaaggtgttctcaatacaactagtgattatgttaggtgaagcccacaaaggttggtaactaggaatgatggaaacagacaaaaagaataactgcttcatacggatgtttctccaaacttcctggatgttaacaattgccttaggtattttttaaaattctgccagaatataagttacatttaaaaatacaaactgttgttaaaattacaacttccacctaagagtcgctaactcagaatctcccagggaaagacaggaagctccgtgttcccaatgattactatcaatgtagaagttttggaaacactgacgtcatgcgaacaatgaagcattttttttttaaatggagcataaaaaaacaaatgactaaaataagtgacatttttgcctagaatgtttcaaaactaaataattatttggacttcttcttcatccatctctcatatggaagtgattgaacacgttagcaacatataaacatcagatgatcaaagcacatagagtttcaaaattgaactttactagcaaaattgagacatttatgtatcattgtggcttgccacaaaaattgtggaggagttaatgatcattttagaaaagaaatctttgtgtgtgtgtgtgtgcatgtgtgtgtattgcagaaataaactaaaatctaagacttggaaaggaacaagatcattcagttattcagtagtcctataattcctaaaaacccagctatataactgagggcaacaaacattttgtcatagaaaatagtttttagcaaatttatatctcaaattaaatttttattaaaattactttatttccttgtcccattccactgaaaaaattccttttaaaattagctatctacaatttcctgctagaaatcatatgaatgcttgcacccaaacatatagtgcaatgatggatattgtgtggactatatgtcttagcccttgtttacaggatattcacaatttaggtatagaatgaggggtcacagacatacaaaaaataaaatagcaaataataaaataaataatatgcaagattacaaataattgtacatcttacaacatataaatattgtgtatcatgcaaatgaagcacctgatgaaaaataaagtcaattgggtttcatgtgtgagccttgattgataagctctaccttcacataggaagtagtgactgaggagaactttgaaaaatgagaaaattcacatatgtaaagagaggggtaggggattatctggatgtaagagttcttaatttccaagcaaacttctgggaacagggtcatatacttagtattattaaaataatagataacattttaaaatcaccagttatgtgtcaaacattgtggcaggcacctttcatctcatttaatcatcatatttttgtttttgctttttgttattgttttgattgctttcctataataatgtagaggctcaaaggttcttctgattactccttatgtaatggcattactttagtttgtaatggatacaactttaaatatagtattttacttcatcacagtataattaatggccaaatactcattgagaggactgattaggatggattaccaatgggtataatctaagaatgttattacaatactcacaaacctctctagaacaattaatgaaagaaaaactgggtagtttagctttaaaattcatttctcacttactatgtacacacacacacacacacacacacacacacacacacacacacacagagcctctgttgctttgttggtatcagcagacataaatcagagctgactggacctgagatggaccaaaggtggatgtgagatccaggataaaataacacaagggataggaaaaattaatcaaattctctttctcacaagtatttgaattaaatatttaaattaatatttgaattaagggaaatcctaactaaagcaatcagacaagagaaagaaataaaggatatccaaataggaagagagggagtcaaactatctctctttgcaaatgacattattctgtatctagaaaaccccataatcttggcccaaaagctcctttggctgaaaaacatcaaagtttcagaataaaaaatcaatgtataaaaatcatcagcctgcctatgcatcaacaacagccaaatgagagcgaaatcataaaggcaatcccattcataattgccagaaaaaaaataaagtactcaagaacacagctaaccagggaggtgaaagatctccacaatgagaatcaccaaacactgctcaaagaaatcagagatgacacaaattgaaaaacatttcatgctcattgataggaataatcaatatcattaaaatggctatactgcccaaagaaatttacagactcaatgctattcctatcaaaataccaaagacattcttcacagaactagaaaaacgattttaaaactcatactgaacgaaaaaagctaaagcaatcctaagcaaacaaaacaaaacaaaacaaacaaaaaaataaaaacaaagccagagagccagagtcatcacattaccaaacttcaaactatactaaagggccacagtaaccaaaacagcatgatactggtacaaaaacaggcacctacatgaatggaacagaatagagagcccagaaataagtccacacacttagaaccacctgatcttcgacaaagctgacagaaaaaagtggagaaatgactccctattcaataaatggtgctgggataactggctgaagctggaccccatccttataccatacaggaaaattaaataaagagggattaaagacttaagggtaaaaccctaaactcacaaaaaccctggcagataacctaggcaataccatcctagagatagaaacaggcaaagatttcatgacaaagataccaaaagcaattgcaacaaaaggaaaaattgactagtgagatctaattgaactcaagagcttctgcacagcaaaagacattattaacagagtaaacagacaacctacagaatgaaagaaaatttctgcaatctattcatctgacaaaggtctaatatccagagtctacaaggaacttaaatttacaagaaaaaaaacaaacaaccccattaaaatgtaagcaaaggtcatgaacacatacatttcaaaagaagacatacatgtggccaagaagcatatgaaaaaaagctcattattactgatcattagagaaatacaaatcaaaaccacaatgagatatcatctcacaccagtcagaatggctattattaaaaagtcaaaaaataacagacgctggcaaggtggcagaaaaaaggggaaacttatccactgttactaggagtgaaaatagttcaaccattgtgtaaagcaggatggcgatttctcaaagagctaaaagcagcattatcatttgatccagaaatcccgttactgggtgtatatccagaggaataaaaatcgttctaccataaagacacatgcaggtgaatgttcattgcagcactattcacaatagcagacatggaatcaacttgaatgctcatcaatgacagattgtacaaggtacatatacaccatgaaatactatgtagtcataaaaaagaacaagatcatgtcttttgtgggaacatggatggagctggaggctattatgctcagcaaactagcacaagagcagaaaaccaaatactgcatgttcttacctataagtgggagctaaattatgagatcttataagcacaaaaagggaacaacagacactggggtgtatgtgagggtggagggtgggaggagggagaggagcagaaaatataactatggggtactgggcttaattcctgggtggcaaaataatctgtacaataaacccatgtgacatgagtctatctacgtaacaaagatttgcaggacccccacacggaatataaaagtaaaaaaaaaattggattaggaacaattaagtgattcttgttatataactgaggctgggatttacatccttatttgggtctatgtgaaaaccgaattgacagatggagagagataaaatagagataagcagatgagagagacagggagataacacatcaccaggtttatcctcaagaaacagagaagaaacttcttttccaattttccaatttcaattccagcctctctgtgacaaagctgtgcctcatttacaatacagggatgtccatgggataacttgatgccgcctttcaactcacattgtaatgaatgcgttctcattctttgaattacagggatacctttcaagaggactgttatttcaaagtgaagtctacaaaatcctcctctgaaatagatgtttagagcagcggggtggatgaggctttctgtacatacacatacacatgatatattggatattaatatattgataatatattactctcatgttaataacatattataatacaaaattatatatgcattcattcattctgcaggtaccttcagttttgctttctgacccttgcactttaccgggcacaatgtaagtaaaagaaggagttgaagagagaacaagaagggtaattgaattacttctagaaaaaacaaggccaagtgtttgagacacaccaccagctcagaggcagtgaactgaagtaattgtaactaaggaagatagtgaaggtgccactaaggaagtaactctattctttaaaatggaaccagaatcataaattactactctctcaacaaaagtcacaaagatttatgacaaatgcttgccaaaacactaaaaaggagaagccaaaataaggctggaagttagaggaggaaaaatagagcctcttagtatgtgagaaaggtttcctttaccctcatcaaagactaagcattattatgtaccaatggctgactatgggtagctgagattgctatgctagaatgcaaactgcatgtgctgcaggaatgaaaaaataactataaaagtttcaagcaaaaggaaatctgaaagtagagagacacaaatcttgtagcatgatatccaataaaagttcttgataaggcctctggggaaggagactgtcacctttcaccctcctccgttcattaatatgccctacaattgcatgaatgaggacattctttaaaggttttgatagcttgtcataattttcaacacccagaagtagataaagagacagcagaatgtagtgggtacattgaaagtctctgagagccattttgcttgggtatgaatcctcactcttctacctaccagctctttgaccttgggaaaatcatttagttttctgtgcctccgtttccttctctgtaaaatgagggataaatgaagttgttctgatgattcaataagtatgtgtgtgtgtgtttaaaacagagcctagtgcatttttgatgccaatatatcattttgtattatttaatattttaaccttgttgactggtcttatacaaaatgacccatacattttaactctgtacttaaaacaacagtaaaatgaaaactcagttaacacagtgtcattacttaatgaaatgtctgtatgaagatggagcagaaaatgggaaacactgggtaagaagttgaagaaacaagaccttatcctataataatgggtagttatggaaagtagtagcttacagaagtgacacattgacagtgatgtgggttttgcatttctacaaggtaagtacaggacagagacagctgaggagtggaaggcaatcagtacagtgttgcaatcctctaacaatccaagcatttctaggtgagtaacagtgacatagacagtcttaggatagcctcaaaccaacttcgtgagcccttttccagttatctaaggtcctgactatccgtaatcgtaaaaaatgtctcaaagaaagaaaagagtaatgaatagatttcttctttatgggagttaaaaactgaatataattatggcagcttcaaagtagacggacacatgttggttttgctgctcttcatcctgtgctgcagttgaaaagtctgaccccaattatttgtccctgtgtgctataaaattcttaatcagagctgagtagaataagtagtctttgtttctgaagcctattcaaagaaaggcttatgtgaataccaactctgattgtgatgaggactaagagttgagaccaaaattaatccaattctaaacgacacttaataagtcagcgaacacaaagataggctggaatccttagctgtgcccagcaaaacttcttcagacctcataaattgaatttcttatggtgttttttttttgtttaaataaggagttaaatagtattaaaatcaagcttaaaccagtgaggaaattttttaaagtatattttagttaaattcgacacctcttttggatataatggatataaatgccaggtgcattgcttttcacatgatttcatctcattgcaaactgtgtgagcatacaaggaatcttgagaatttactaggcaaataataatcatttaaattgcctttaaaatgtcaaacctgctccatactgagggctgaaaatttgaaaaaaatattttttcaggttttacatgaatgggaaaactctagaaataagtatgattctattctatctgattgctatatgcatgatatactccaaagaaatatgaaaattatatacgatgacctacataatagcataatataaatattcaaaaactgctaagtcaagaggcttatttaacattattttggattagatttggaaagaaatcagcattttctttttttttctttttttattattctttaagttttagggtacatgtgcacaatgtgcaggtttgttacatatgtatacatgtgccatgttggtgtgctgcacccattaactcatcatttaacattaggtatatctcctaatgctatccctccccactccccgaccccacaacaggccctggtgtgtgagttccccttcctgtgaccatgtgttctcattgttcagttcccacctatgagtgagaatatgcggtgtttggttttttgtccttgcaatagtttgctgagaatgatggtttccagcttcatccatgtccgtacaaaggacaagaactcatcatttttatggctgcatagtattccatggtgtatatgtgccacattttcttaatccagtctatcgttgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttttagttcaagatccctgaggaatcgccacactgacttccacaatggttgaactagtttacagtcccaccaacagtgtaaaagtgttcctatttctccacatcctctccagcacctgttgtttcctgacattttaatgatcgccattctaactggtgtcagcactttcatgttatattagaagggcagcctgaaagctaaaatctataaaaatacagaaactgggtatctgctatccccttctccacatctcttctctgtataaaagaaaggtaaaatgtccaaggagttgaaacagtcagtaaccccacaggcaggctcactgtaaggtcagctccatcacagtggcagctaggagattttgtgaggcttcctgtgggatagggtttttttttcatctttttatttatttatttatttttattttttttttgatgctttcaattctgggttacaagtgcagaacgtgcagttttgttacataggtatacacgtgccacggcggttcgctgcacccaccaacctgtcagctacattaggtatttctctaatactatccttcccccagcccccccaccccatgagaggccccactgtgtgatgttcccttccttatgtccatgtgttctcattgttcaactctcacttataggtgcgaacatgcggtgtttggttttctgatcttgtgacagtttgctgagaatgatggttgctagcttcatacatgtccctgcaaagggcatgaactcatccttttttatggctgcatagtattccatggtgtatatgtgccacattttcttaatccagtctatcattgatggacatttgggttggttccaagtctttgctattgtgaatagtgccacaataaacatatgtgtgcatgtgtctttatcgtagaatgatttataatcctttggatatatgcccagtagtgggattgctgggtagaatggtatttctagttctagatccttgaggaatagccacactgtcttccacaatggttgaactaatttacaatccctgtgggataggtttaatgggacttccattaaaggattacccaccatttctgtcaaaattaagaatgaaaaattatcccaggagtagctatttccagtggccaaattgtcatcaattaatgaaagcacggaagtgatgctgattttatacttagtaatgagactatttttcccttaaagtttataggaaattatcagggagtgaatttacatattatgatttaccagaaacagtggattcacttataagtgttatctgaaggttggtggcaatgggcagaaatatgggaagattatggacttctctacttggggtggtattggaggtgaggttgtaaattatactcaccactgttttagtgtcctcaaatattgtgagttgatagtgcaaggaataagtgtgtctgttttttttcttttgtatcttgccaggtacgtggtagatggctgttagaataaaaattaaagatgagggggagatattcatgagcattcttctgttcttgtgattaatggtattaatggagttttttttttttcactgacagactctggatgttgtcaccttaccatttttgcacagtctatgctaaatcacttagcagtgagaaagttgtaaaattgtcttgacatttaaaaaacagcactttatttctactctagattaaactagttacacatgttttaaaatcaagtaaatcaaaacgtggaagaaaaatcattatatgaaccaatctaagaaatacaattttaggaaaatgtttatttattcaaggaacaattatatcatgacagcattttcccccatttttagaactagtcttctctggcaaaatgctttctatttttaatttaaaaacatctagttttgcttacatggatttactcaattcaaataaaataactgataatagatgttgttatttggttagtgtgcaaataattctaaatttcaacattgcctcaatcctcttagtggcatatttactcattgggaattaatttagtaaaaaactctatgaaagcaaaaaaacatggaaagcttggaaagcaaaataattcttgtgttctttaagagttccaattttatataataataataattaactaaattggaagttaatagctgaaaaatcgtttatatcactttccaaataactttaagcttgttacaagaccaggcttgtacaaatagaatgtttatggtgttattatattttcagggaatactggataaaatgcttttcattcaaggcaatgtaatacagtggggaacaggaaataaatagaaaacaataatgtgaactatgtgattctttttcttccttttaattgtaagagtaacataacaaaactaatgataatccagaaaaagggagaaaaagtatacgcaatccactaccccagcacaattaattcattattagttattgcattttgagttactcctatatacatattttagctataaaataaatggtcatattcatagtatatacagtcatgtgttgattaatgacagggacacattctgagaaatgcatcactaggcaattctgtcattgtgcaaacatcatggactatacttacacaaacctagatggtctggcctactgcacacctaggttatatggcatagcctatcacgtctaggctacaaatctgtgcagcaagttactgtactgaatacttcaggcaattataacacaatggcattagtgtatctgaacatatctaaacaaagaaaaggtatactaaaatactgtattctaatcttatgaggccactgtctcgtgggaccacaagcagaccttgtctgcttccacgacaaggtaatgtaggtttagttaatgccagtggaggttagaatgaaatggttggagtggatttagtatattagccagccatgtcctagacatggtggcaacaaagaaagaagaaaataaggtgggggaacttgactatcatgaagcatagagggaaggggtgaagatgtttaatgcaagaagctgtggagagggctccttcttttaccagctggataactttaaaagcccgagcctccaattcctcagctgttgaatggagaaaattataatgatgcctacttcatggaatggttgtatgacttaatgagtttatacatgaagggtgattacaggagtgtctggcttttttttaaaaaactcaaaaatgttacttcttgttgatagtattctccaaccaattaaaaagacaattctacagttgtataactgagggttagaacccaggaggttgatttggggaaatgcgagtagaagcacatgaatgcccaatgggaggaaaaacctgcatgatccaggttatttataatagaggacacctgggcgcaaggtgtgccatgagtttatgaggataaatagaaggatatgaagaagcagctacaataggaagagtcaccaatcagagcaagtgtgaggtcacaggggcacagaccccactggctcagtccattggcagccctgctctgtggttctaattccactcattttgagtagttagagctaggggtctccctccaagtcacagagtatgacaggttccaaaaatatgccatggatgtaacaactctcacttattacataaactataacaatactaataaacaacttggatttatcatagccttagcagtgcctaagagaatatattgtactctaaagcaatttttgagagagcaaggcttttcgtgttttaaaatgaaattttttaaaaacaaaggcagaagtaaaaaagagaagcaccaataaacttcaataaattaatattaacctcttttaaatgtaaaaaacactatgaagaaaattgaaaagcaaaagacggggactgcaaaataaagagtgaaaagattaatattatgatatgtaaaaaggcttacaaagaaaattcccaaaatgaatactccaataaaaaaagaataagattatcatataaacagaactaaagacaaaaaacacataattatctcaatagacacagaaaaggccttcaataaaattcaatatcccttcatgttaaaaactctcaataaactagatattgaaagaacataactcaaaatattaagagccatgtatgacatatatgacaaaccataaccaatatcatactgaatgggtaaaagttggaagccttccccttgaaaacttgcacaagacaagtatgccctctctcaccactcctattcaacatagtactggaagttctggccagggcagttagccaagagaaataaataaagggtattcaaataggaagagaggaagtcaaattatatttgtttgcagatgacacgatcctatatctagaaaacccgactgtctcagcctaaaagcttcttaagctgataaacaacttcagcaaactctcaggatacaaaagacaatgtgcaaaaatcactagcattcctatacaccaataaaaggcaagatgagagccaaatcataaataaactccaattctaaactgatacaaagagaataaaatacctaggaatacagctaacatgggaactgaaggacatcttcaagaagaactcaaaccacttctcaaggaaatcagagaggacacaagcaaatggaaaaacattccatgttcatggataggaagaatcaatatcatgaaaatggccatatttcccaaagcaatttatagattcaatgctattcccattaaactaccactgacattcttcccagaattagaaaaaaaaagctaatttaaaatatatatggaaccaaaaatgagcctgtatagccaagacaatcctaagcaaaaagaacaaagctggaggcatcatgctacctcactttgaactatactacaatgctacagtaaccaaaacgtcacggtactggtccaaaaacagacccatggaccaatggaacagaatagagtactcagaaataagaccacatacctacaactatctgatctccgacaaccctgacaaaaacaagcaatggggaaaggattccctacttaatatatggtgctgggaactggctagccatatgcagaaaattgaaactggaccccttccttataccttatacaaaaattaactcaaatagattaaagacttaaatgtaaaacgcaaaactatagaaactctagaagaaaatctaggcaataccatcagtacttaggcgtgggtgaagatttcatgacgaaaatgccaaaagctattgcaacaaaagcaaaaattgacaaatgggggctaattaaactaaagagttcctgcacatcaaaaagaaactatcaacagagtaaacagatgacctacagaatgggagaaaatttttgcaatctatctatctgacaaaggtttaatatccagagtctataaggaacataaacaaatttaaagaaaaaacaaccccgttaaaaagtgagcaaaggacatgcacagacacttcttaaaagaagatattcatgtggccaagaaacatattgaaggtcaacttcactcatcattagagaaatgcaaatcagtaccacaatgagataccatcttgtgccagttagaatggcaattattaaaaagtcaagaaacaacagatactggcgaggttgtggagaaaaaggaacacttttaacactgttggtgggaatataaattagttcaaccattacagaagacagtgtggcaattcctcagagatgcagacagcagaaatatcatttgacccagcaatctcattactggctatatacccgaaagaatataaatcattctattataaggatacatgcacgtgtatgttcattgaagcattactgacaataaaaagacatggaatcaacgcaaaagcccatcaatgatagactggataaagaaaatgtggtacacagacaccatgtaatactatgcagccataaaaaggaatgagattatatcctttcagggacatagatggagctcgaagccattaccctcagcaaactaatgcaggaacagaaaatcaaacactgcatgttctcacttataagggggagctgaactatgagaacacatgaacacagtagtagagggaacaaaacacactggggcctgtcagggatcggggagcatcagaaagaacagaaaaggcatgctggacttaatacctaggtgatgggttgatcatatatcatgtttgtcatgtttgacatgtttgtgcagcaaacagccatgacatacgttttcacctatgcaacaaacctgtgcatcctgcacatgtaccctggaacttaaaagtttaagaataaaaataaaataaaagaataaacttaaagtaaaaaaaatcaatttaaaatcaatttaacaaattttaatagctaaaaagcatatataaaaatgttcaagctgagtattaggcaaagatccatgaatataaacaacttgccaaattatcaaaagtataacaatatgcacatatatgtgaaatctagtgttggacatgaagaaaagggcagtcacacttgctaggagtataaaatgtcaaaaatattcgagtgcacaattcaacaaaacttaacaaaactctcataaatgtttataaatttaatctagaatatcctaaacaataaaataatgttaaataagttttagagacacacgtaaacaacttaggtttttttttgtaaaataaagattgagacaaaataagtgcttactgataagaaatttgttaaggaaatgaatatatttgttaatcaaatatcatatgatgtcattgaatttgatctcaaaagtatttactggcctataaatatattcctgagtgaagaaaaaaaatagaaaacaaacacagtgaaactttttttttatggatacattttatataaatttgtgcctagaaaaaatctgagggacacagagtttatcatttagcatgagattatatatatttaaattagtcttattttccctaattcatgttttataaattttcagtaacaaatatggacatacgtgtatgggtatgtaatagagaaaatataattgaaaatataaaaacatgacttttgtacacagtcaaatctagcactgaaagccagttctgacatcaacgatcttctaaatctctttaatattcaatgttttcatctaataataacatctatatttcactgggcgtggtggctcatgcctgtaatcccagcactttgggaggccgaggcgggtgtatcaccggaggtcaggagttcgagatcagcctgaccaacatggtgaaaccccgtctctactaaaactgcaaaaatttgccgagcgtggtggcgcacgcctgtaatcccagctactggggaggttgaggcaggagaatcacttgaacccaggaggtgaaggttgcagtgagccgagatcgtgccattgcactccagcctgggtgacagagtgagcatctgtctcaaaataaataaataaaaataacatccacatttcaaaattattatattaaatgaaataattcatgtaaagtgcttgagacaaggattgatattcaatcagtattcaataaatacattttttttcagtttttagtcattttatttgtaagagctttaagattcaagatgttagaaaacatgtatttcaattttaatatctttggaacctaaagtagtgtcaagtagaaagtaattcattgtgaaatggaaggaagactgaatgcacgatatggaaagcaagctcccacttcattaatgtctcaaccagagtccatacgctgattcttctgattttgccaagtccttacccacgttttcatttatgaatctaactctgatttttgctttatgaagcttttgtctttacctgatttaagtaattactggttctcaactttgatttctatcttggacttaagttattcctgaatgccaaattatatgtaatatttgaccaaaggccctccagcatgacaatttcagtttctttgtgctaaccctctgtctgagatataagaatgatattcattcattcataagagagaaattctaatagaataaatatgtgagaaggatattgcctagctttaatcgagaaaaaaaactgtgacatcccagagagattcccacttacatgtgtcaagaaccctgtcagatcatcaagcaaacctctttcttttatagaggagaaaactttgtccctgaaggttaaggcacctgtccatgccaaaacagctaattagtaaaagaactcagttcagaccttcttattcccagactactgcccttcccaccgtatcttgctgcttttaaggtacttaaaaatagactcagtgctgctggaacatattatttttgttcttaaaatggacaagacttcttgtattctagttcacaatgccaaaggcaaaactcaaccttacatactttttctaaagaaaataaaagtttaaccttaaaaagtttcagttgactagtagaaatttagtcttcaatatgatttattagccaaacttcagtgcagagctttcttgtgttacttgaaggagacatatttttaacatgcagacatattgcatgtattctaaaagaacacattgatggccaaaacaaaaggttattcaatatcaaatgttgtattccatgatatttttattaaaaattcaattgtatttgaaaatattattattatttagagacaggatctctctctgtcacccaggctggagtgctatggcgctatcacaggtcaccgcagccttcacctcctggctcaagtgatcctcccacctcagcctcctgagagctgggactacaggtgcccgataccatgactggctaatttttgtatttttttgcagagatggggtttcaccatgttgcccaggctggtctcaaactcctgggctcaagcgatccacccacctcagcctcccaaagtgcttggactacggacatgagccactgcacctggttgcaaacattattttatatatgttttaatatacaagagcagtatctctcctagtgacccttctctgatgagggaaaacacattgagaaaaatctcctgtgagttagagattaagtggagaatgtttgaccaatggatgacagatcacgctaaatagatgagtgaaagacatggctttgaagaattagaaatcttttgacatcttgaagcctttgaaatgataagtagtttatgaggagcctcactttgggcttttcgtgggcaagtcagattttgcaatagttccatcaaaagaaaatatccacaatgcttattttaaaacaattagttccgagagtaacagtagcagactctttgtggtaacaatcttataaacatgttaaattttttctcaaacttaatttgcaaggtgatttgcatataataattactaaatcatgatataaagtcagaaataatttgaaatagataacatcttgtcttttgagatgtagggtgaaatgatgatgatttaaataataatattcaatctgaacataactgcttaatttttgaataaggcctaaatcacttcaaaagcaaggacttacagtgaagactacttacatacttttaatgctattgtccataaacccaaaggtgcaaagtgtgcaatctaatgaaggatctcttgcctcctcttggcatctaaccttactaaatcctgatataaagtcagaaataatttgaaatagataacatcttcccttttgagatgcagggtgaaatgatgatgatttaaataataatattcagtctgaacataattgcttaattttcaaagaaggcttaaatcacttcaaaaccaaggacttacagtgaagactacttacatacttttaatgctatagtccataaacccaaaggtgtaaactgtgcaatctaatgaaggatctcctgcttcttcttggcatctaaccttcattacagggatatttcatagaggcacttagtgacctacacatttattgattacttttggtgaaatgtttttctaaataaccattggtaatcattcaatatctgatgagtaaggaaaaaaaaaacaagcttttccagatactaattatttataacatctcctatattcattcccttagtgatggcatcaccttcccagctaaccacacaaaacctcagttatatttacaccaacaatttaccgcttccagttcctacaatacctcttaagtcaatcatgtctgttccatttctactttccttgccactgtataggttcacatcttaccttccaaaggttatgcaataatatcctttctattctctcttcctccaggttcatccctttcaaatttcatatgctaaactgggcacaaatatcataaataatgtggttcctttacaaaaaaatcaatgtttcgattatttagaaattatttcacacctaagtttttccttaatatttatttaaaaacttctaatgtatagctcaaactttggcatgtgtaaaattaattcataatcacacaaaatcaaacattttcagagagaagaactaaacatatcaaggtttacaaattcttagcttacagttaagccaagaactgcataatgttaaaatagtttctagtggtattttacataagcattggatgactattttaatatgccaaggaaattgttcctagcatgtcttctaagcctaagcagcaataatactataaaagtaatacttaacgatttatctacaataaagcaattttcaccaatagcaataacatttagttcccaattgcttttatgacttggcaaaaataattacaagaattaagatttcaagcaacaaatatcaataattccatattttttcctattaaaatacaacatattgtttactagacattaatattatttttaaaaatactattttcttgcatttttgccttttttttcaaaagtgatgaagatgcacttcattttctaattattgttcacagaagaagaaagaataaacttagtccaccagaagtggtccttaaatacctctagtggcttctgaaacctagcattgaagattcagcaaaatatttttgtggtgtgctataatatgaatctctatgaagaatgagatattgtaaattcttctgtaataggacaacgtgctattgtaaaaattctcaaattatagaatgattatatgattcatttttacactgatagggagaagcaccctggagaattgttctgatagtaataattaccttgctattataatggtaatcttcatcttgtacgagagtagaaatggataaagaaggggcaaaaaaccctgagaaattatgtctttatataagaacaggctaacacttaagaacaagtaatatcgctaaacagtacataaataatgacattgccacagcaaatacgagttaaccagatccagttcttgcctaagttattgtgatgctaagaaaagatactagccttattcctcctactcttttactccattttccacatataaagtgataagcgtaggaggaaatctgacttggcaaagaatcagtactatttccagagaggaaaaaaataatttcaacttagaaacttttaaaccaacatctaactgagtagactatcagagttttgtttgacaacatttacatgatacaccggtttacgggaaatgaaatttgcaaatgatatggtctgctcgtgatggaaaataagttttatagatgcaaggtattttgttcaacatattaatagcgaagaggaatgagttcttatagacactaatatcctgaactgctaatgtaatgtttctctgtgtcttgatacagatttaaagtagctctgcttcaaaaatatccaatctttgcctacagacaaaagtaatcaaattataccatagtcatacaatcacttatcagtgaccaaatggctcaaggactttttatgatccactaaattaagtcacatacgagaaatgatgttttgcttagtttctccatcctaggtaggaggcattcaaagacaaaaacatttatgggccagaaatgatttatatttgacttggaaatttggcaggaaaaataccgtatcagccttatttctccattggtgaaaattaaaatgctacaaaaaaatgcagttttcactagaagcaccacagattatttctgaaaaataaaaaatcccaactatccaaagtgtcctatatttgagttactatttaagtggtcagaagtaaagaaacagttaaaaacaggaggatattgttacccccaattcagtaatgttacaggtacacaggcaccgtgatatagaagtcttatttgacattttagtaagatattgtaaataatcagcagtctgaagtttgaagctagattttccagttagaatttatcatgggttgacaacagtgagtgaaatgtagctccacagttcgttcttaaagacattgtaatttccaggtgaaaagaaaacaaataaggaggctttagctcttgattcttaggctcccaggtgtgggagaaaattatatggtcccaggatgatagaaatttaggaaaagaggaatggagggaagtttccctaatataaaaaaggttgcaaagaattaattacaaagtttctgctacagggccattcaaaaagcagcattttgcatgactctggacatcattcaatttcttctcaacagtttttatcttcatactggaggaaacaccaaacggaaattagttccaggtctaagtaaaactatgacatagaacacataacctctgtctttcaccgggcttcagctgcctcattcagcacagagagcaatggactagagttcattctgactctgaaaaatgcagatgtatctaattttaaaatctaatgtttattttacaaaattgaattgaatctaaatttctagattatactacaaggaaacctgtgtcaaagacatgaaacctctctcttccttcttcattcattcatttattcactcaatattattgaccaccttctaattatcattctaactcctatgttgataagttatagtaagtaaggtaagatcagagagacttattaggagatttggcttgtaccaagatgtcactagcagaggtgataaaaattctagatgtattctggaggtcagattctagatatattctaaaaatataggcaagaagattttctgaaggatcggatggtggagtaatgaaaaaaaaaaaaagagaaaaggaaggaaagagacgttttgaattttttgtttctacatccccataccatgcccttctaatgcacttatttttcctgttcaagtttaaaataccacagtgaaaacattttactgaactgacattttatgacatactttcaagttttaaaaaataagtaatcttttttaaaaaaagtttttcatttatatttttttagatcatgacactcagaaacatcagttggagtatctttattgaccctatcttttcttttccacaattccaaaacatttaatatctattgtttaaaattggtaacttgtacttactgctattctacattacttttactttaagtgatcatatatttcagatattccatattgttcttcctcttccatttccactaacttccctgcctttgtcaagctttcaatcagaaactttgatgagcaagagcctgcttcattcaaagagacacaaacaatcatcataatcatgatcactagacttgccttttttatttcttttcgttcgtcctgtcccgtcattctcatgttcaaagctgactttcaactttgagaggcttcaattttaagactcactctaattatttatctgagaccttacatttccaacagttgcaacagaaaactgctctaaatcctgtctcacacagcatcaaggtccaccatgtatgtaaagagaagtacagatggtgacagacaaagctgaaagctcatgagtacatcacagaagtcaaaataacagtggctttccatctgttaacatattcatatttacctcattttcccacaagtactcctctctactttccactcacactggcaaatctcagcaggcagtgagtggttggcatctattttcatcttgtagtagttattgagtctccattttctaaacagcatgatattataaagacaagagctgaggacatattctagcccccaagaagtgctggagtattcccactcctcagcaatttttacttttgtctacccagtattggtaaaaagtacctgtggtgtcaaaactcttgagatacaaattttctctaatcagaaactgtttcatcctcattttcatagttttaaaaataagttttgtctaattaatttagtaaaacatattcaagggtaaataagttggagaaacctcaaaattaatagtaggtatatggctacatgcatatttctatttccttcacagatttatcactttttgatattttttgagatagctattttttacaaagttttagctttatactataaagccatatcagaattatgatataaaaattataagccaggaattaaaaaaacacatatatatgtaggaattacttccacggacacaactagatgtgaaatacatttggtcttcagttttcatacaaatatagagggatattttacaaggttgcaaaataaagtcaagtccatccaatagagcagcccttgatgacaatggtataattgaaatgaataattgctaaattagtgctttaaaagcaggggaaagattcatcagaagtgcagagatgtttgttaatgttagggaggattcactaactgaagattttcttaaaattgctaatggattcaatatcatcggttaattttgctctcctgcttggtgcaaaattcatggagatttctacagtccaaaacagctattcaaatttcacacagtgatatggtttgcatctctgtccccacctaaatctcatcttgtagctcctatacttcccagatgttgtgggagggaccccgtgggagatggctaaatcgtaggggcaggtctttcccatgctgttctcctaatagtgaatggctctcacgagagctgatggttttaaaaacaggagtttctctgcataagttctctttctttgcctgccaccatccatgtaggatgtgacttgctcctccttgccttccataatgattgtgaggcctccccagccatgtggaactgtcagtccaattaagcctcttattattttttatttttgcaaattgctcggcctcaggtatgtctttatcagcagcatgaaaacagactaatacagtaaattggtgccagtagagtggggcgctgctgaaaagacatccaaaaatgtgaaaatgactttggaactgggtaacaagcagaggttgaaacagtttggagggctcagaagacaggaaaatgtgctaaagtttggaacttcccagagacttgttgaatggctttgagaataatgctgatagtgatatgaacaataaggtccaggatgaggtggtctcagatggagatgagaaacttgttgggaactagagcaaaggtgactcttgttatgttttagcaaaagagactggttgcattttgccccaccctagaaatctgtggaactttgaacttgagagagtgatttagggcatatggtagaaggaatttctaagcactgaagcagttaagaggtaacttgactactgttaaagacattcagttttataagggaagcagagcacaaaagtttggaaattttgcagcctaacaatgcaataggaaagaaaatcccattttctgaggagaaattcgaaccagctgcagaaatttgcataagtaaggaggagccaaatgttaatccccaagacaatggaggaaatgtctccagggcatgtcacaggtcttcacagcagcccctcccatcacaggctcagaggcctaagaggaaaagtggtttcttgggctgggctcagggtccctgtgtgcaacctagggacttggtgccctgtgtcccagctgttccagctgcggctgaaaggggacaatgcagagcttgggccatggcttaaaggatgcaagccttaagccttggcagctcccacttagtgttgagcctgccaggacacagaagtcaaaaatttgggtttggaaatctctgcctagatttcagaagatgtatgaaaatccctggatgtccaggcagaagtttgctgcaggggcagggagggctctcatggagaacctctgctagggcagtgtggaagggaaatgtaaagttggagcccccacacagagtccctagtgaggcactgcctagtgcagctgtgagaagagtgccactgtcctccagaccccagaatggtagatccacggacagcctgcatcatgcgcctggaaaagctgcagacactcaatggcggtctgtgaaagcagccaggagggaggctataccctgcaaagccacaggggcagagctgaccaagactatgggaatccacctcttgcatcagcatgacctggatgtgagacatggaagcaaaggagatcattttgcaactttagattagactgccctgctggatttcagaattgcatggggcctgtagctcctttgtattggcaaatttctcccatttggcatcactgtatttacccaatgcctgtacctccatcgtatctaggaagtaactaacttgcttttgattttacagggtcataggtggaagggacttgtcttctcttggataagactttggactctggacttttgagttaatgctgaaatgagctgagactttaggggactgtggggaaggcatgattggttttgaaatgtaaagatatgagatttggggggtggccaggggcagaattatatggtttggctctatgtctccacccaagtctcatcatacagctcccataaatcccacatgtggaagggacccggtgggagactgaatcatcggggcaggtctttcccatgctgttctcataatagcgaatgggcctcacgagatctaatggttttaaaaatgggaatttctcttcacaagctttcttcctttgcttgctgccatccatgtaagacataacttgctcccccttgccttctgccatgattgtgaggcttcctcagccatgtggaactgtaaatccaattaaacctctttattttgtacattgtccagtctcagatatgtctttagcagcagcgtgaaaaaagactaatacacaaggggacagcaaattaatactgtgggttgttttcctttatcattcttatgtataaataagtttcagatagtttatgcatttattatcaattcacagtatcagaaacacaaaaatctcttcccttagctatgaaaaataactgctcattttgaatgattcctaatttcattgcaatcacttttccttagccaaaccttgagtaaacaagcagtatcacaggacccgttcaaaacaagggacataggtattttatgaaacactgctttattcatatcttcctgatgtatgttcagctgtatcaacattactgtggataatcccaatggagagtttatagaccacattcaatcagataaaaaactagaatccatctggatctgatttaaagaagatttagtatctttccacaataaggaatatgagtcatacattaataaaactcacaccttgggcagcttaccaaatatttctacaccttatttgtaaaataaaaattataaaccataagcaacagagttgtatgagttgaatgaaataaagtgaaagactatggcacagagaagactcacagaaaatgaaaactttcattatcactaacttcactgaatagtcataattattaatattcaatattcctagcactttggctttattattatgtcatctaaatgacttctttacagaatggaagaatggaaaagaatatcaggtaattatttgagcctgacatctcttaatgttaacttttaagtttattggttgcttatttctaaatttggaagcagtagcatacatagataatgcataatacctccttgttgtttaataaatcttaatttattgaaaattaacttttctttttagattttccaagaattattccttttcttagtcttggcaataacccccaaaatgtccattataacaagtctatatttatgtggctttttgggaaatgatttagattttaaattatcatttatttttatgtatcataccagaattttcttgcctatgaagcattgcagcagtaggaaaataaaattattggtgggttaggaatggttttttgaatgcaggctgtcttgtaggaactatttaatgctacacagccctggggctctctgggttatctcaatgctccaagtcacttgttttcgaccctggttagatcattgggcattttaagtttaaatgaatattttattgaatcgagtaggtcaccctataaggggtattgtcagatgtatgagtcgacatatgagatttcaaactaagatgatgtacttaggctagagaacgaatagaacttcataaatatccaaactatagtaagtaaaatctctttacaaaaccagtttttgcaaagcaagagacataagctgactagctacctttcccaaggaagcaaatggtctgtgcattttgttcatgcaccagattcagggaaattattatactctttgacatcccacctcctatatttctactactttgtgtgctttgtgactgatttagtcttaacaatgtatcatagaaatgaatgccacttcttttataaagttaacaatgattagcataatagattttaagggatatatgttgatgaattaaaactgtataaaaaagagcaaatgaaaaatgagcataagcaaggaatggatgaagaaacacctcataaatgcaaataagatcttagttttcattttaactgtcattattgattgtttattagagatttataagtaaatccaaaagttagtaaacaataaacaaataaaagcaggccatgtatggaactattgagagtatgtaataaatcaaggaatcaaggatgataattcataacactctgcacaacagaggttcactagaaaagtaaagaaaaatgtgctatgggaaacatgtttgtcataaccaggagaaacagacaaattactatagttttcctcttagataagaggaagtgttcctcatataacaggtaagacaaagttatgatctgataatttgcaaaacaacataattaaaaaactaatcaacataattaaaattaaacaacataattaaaaaattaatcttcttgtataccattctgagggctctctcagttatgcatatcagtcctggtatttatgatgatgtaggtttttctaaaaaaaagatgtggacaatttaagttccttgttagtctataataattttgaggactgacaagatttaataaacatataaatggataaagagaaattagtgcttctctgacacaaaaaaaaatttgaactgaaatcttaatcacaactagcactctcaaacacattttaaatgtttttctctccaaatttataaatgaaattcattaagttatggttgtatactgaatttatgataactttttcgtggcactcatttattactaaatgaaataggctttttagtttatgttttatccctgaacatcgtactcaaaaattgacagctaattaaactaactgacaggaataaacaagatatttcctacatgctacctttttttggtggcccgttttactttctgctccccatttatttgggggagatcatagtggtctgtgaaatgcataaaccaggtagtcaaaagaaaagaagcaaatggcactgataatccaaacagtaaatggactatataaaatttgcatgataaaattttaaattgttcaaggtttttaaaatgctatttatctgatagaaactctaagcattcagaactgttgccatcaccatcttataaagggaaaatcaaggcagcaaatggaatgctgccaatgtcatgcaagtactcaatgaaagagctgggtagcacttggttctcttcacagtttattacatttcaatatatcttcagttcactttttccccatgagtttcttttccttacatagctcaaactaatcatcagcattcctttgcatactagtgaatcactttctgaaaacaaggttactctcaagatcagaagttacttggtagtcttcatactcatatatacttttgtgggaagcctgttttctacaggattctaacaaagaataaagaatgactatatgcacctactttgaatttgaacaacaaaattgagacagtgattgctgccttaatgagatatagtgtgtcagcagtagaataaaatttattccccaagtgaatgcctacaatagtgagattagtcagcctttttgctaataaactgtgtaaagattccaactcttggggttagctcatataaagtatttttgcattctagttttctgtgcttgttactgttatttattcaaaatcactttcttacttgcagaaaagttgaactctactgactaccccagcactagtatgcatatatagagaaatcactttcagtaatttgaaaacattttatttaaagcaaatactatcaaagaacctaattaaatgaaatatttgagaaaagaatcttattctgaatacatttcaagaaaataagccgctgttcaataactagtgactaacagcatcatttaataactctttgaggactaaatgaagattcattttgaaatcaaatcaggtggtgtagtctgtctcctctacacacatcacattaactcagtaattgccaagttttactttcacaatcgtatacatattggcgagcataaaaggaggtgctaaaaagctataatagaagtaacattaaaggtgttaaattgtagaattttaagagaacaggaatatgatgtaagaatttacaaaggaagaaactttgaaaatctaaaaacataagtgataataaaaaatattatatcagctgtaataagtgaaatgtcatctagttacagggaactctgaagaatcccctccaagggttgtatgattccctgatcctccagtagaatgaattaaccttcttacgggaatcagttggctaggcctggcgtaggtatctctttcagtgatgagctgtgtatatgcaataagagggaacaacatttcacagaacctgtgacaagattgctgtcgaaagtcctcttttttgtctgttgaagaactggaagaattggcctttgatactcggacagtgggtagacaaacagatagaggattagatagataaacaaatctaatcacatgccaaggacaaatggatttttaggaaataattataacaaaatgttaagcagaattttttttgttatcctaaaattatcactaaggcttatagctaaacatgaaattcattaataagtctacatcctaaagcaatgtgtgagaccctcaagctgtgaccaaatgccttctacagaatcgattaagaagagcacaactggccctaaaaccactgaacaccaataaaccaacacctcctgagagtttctctgaaggtcttaggagtacagattttgccgtaaaaccacaaacattttaaagatttcctttcctctatgagaataaggggcgtgttgaactttatcctatttgaagccatatgaaagaggcaccaagatatcaacaataaagattaagaatgcctatacgaaggaaagactagatagtactttatctcccagaatctctgcttaagcagaagacttactccttagccaaagtatgcagaactcataataaaaaccatgaagatcaaaatggaggcctgagaaggtgtagttgttttgtttttgcttttttaagctgaactggtatcccagatatacagccatgattaagaaataattatctttttttctccccaagaataccaccaggatgataaatacctgtcaacaataaatactaactttggacaattgttattttacgtgtacgccacggtagttatgtgacaaatctgattgaaaaaaaaaagacattaaagctattattaattttcaaagtgtccaatagttattcctaaaaaaaattctaacataaagttatcacatttgaccacagtgttggggtagtgttttcatacatcctggtaatacacacttttcattctataattaaataaattatttttctatttatggcaatgacattgtctagaatctgagtttggtcggcaaatatatttgtctacagagcttccagcaatctgtgaccattcgagaacatttattctctttgaaccatgtaacacaaatataaattcttcttttctttcaaagcttcctcattccaagaaccctcaaatgaacccaattgtgcatttgcttacaactttaattaatctttaattttccactattaatatgttgaagttgatttcgatgcagaatgaacccaaagtgcgtatcaaatttgccatggtttttggtgtcaacaactaacacaatggacataaacagaaggtggagatgatatattcactcaatcatccattagacaaagatttaagtctctgtttaagtacaatgttcaatctttgttctgcagacaatgcaaatattaatcagacagatatcacactctcaatgagtttataatgagtgctcattttatatacgtgtgtgtgtgtttgtgtgtgtggatatacatatagatatacatatatatatctaaaattatgattcaggacagaaaatgagaaaaatgacaaaagaaattcagagaaactgttttgtactttagcagaggaaaagatcataaatcttataagttaattttcatcaccatagacaagttaaaatatgatcaatttcagatcacattatctgtgcttatttttactttgacaggacagttaagtattttaaagcactgcattaaatatagttcagtctataatattatcaggaacatacaagaaattttttttactgtcccaaaccccacccatgaccttgctaaattatatgagcaacaataaaagtattatttccatgacagacttgtgcaatatatacagtcttttggttcataattcaaggtgagacagttatatcttaaaagtatcaagccaaaaaccagaagaatacttactttacatgcatctagggaaattttgtttcattttattattttctctaatgctacatttatcttttaattattgttgatattcttgaagaaaatttaaaaaatcattctaataatacttattaccagtatcaaaataatacagtgcataggtatcatgaatgtggcttcctaacatttgttaattctacattttaaactatctttgcaatctttaaggtaagacctgtaataataagcagatatatagtacttaagccatccagttattccccatctctgaaagaattgaatagacatgtacaatattattaactaaaaatatttctgggactgttataacaaaatcatgtaaaatatatttatatataattttatataatataaaatatatatatatattttgagacaaggcctcactctgttacccagatgggagtgcaatgctgtgatcttggctcactgcaaccttcgcctcccaggctcaagcaattctcctgcatcagtctcctgaatagctggattacaggtgcgcaccactactgcctgggctgagttttgtatttttagtagagatgaagtttcaccgtgttgtccatggctggtcttgaactcctgacctcaaatgatccacccacctcggcctcccaaagtgctgggattacaggtgtgagccaccggacctggcctaaatcatctaaaatagtttttaagtatctgtttgaataatattatttcccaaaaagtaactatcgaatacttttaaaattccactttggagtatttttctctcccatagataattaagtatattatttaaacatttggcttatttttgtcattaccaatgcatataacaaatgcaatttttgatttataatttttcaataaatataaattctagaaagtcattctagcagtcattcaagagatatatatagatatagattgctgtgtggtatggtttggctgtgtcctcatccaaaatttcatcttgaattataacccgaattgtaatcgtcaagtgttggaggagggacctcgtgattaggtcataaggttggttcccccatgcttttcttgtgacagtaagtgagttatcatgagatctgatggttttataaggggctttaattctctttactctgcacttctccttcctgctgccatgtgaagaagtacatgtttgctttccctttcaccatgattgtaagtttcctgaggcttccccagccgtactgaactgtgtgaatcaattaaacctctttgctttataaattgcccagtcttggaaagatctttatagcagcatgagatcagactaatacattgtgtaacacatgaaattgagttttatagaaatgtttgtgcagggattggtatataaacttaatcttcctgaaactcattctataatcaccatagtttggctgctatcctactattttaaaattaaggctaacagccaaagctacattccctcaaagcatgcagaacaaagcctttagaaacacatttgcattgtttgcaaatattttctcccattctttaggttgtctgtttattctgatgattatttcttttgctgtgcagaagctttttagtttaattaagtcccatttgtttttgttgcattttcttttgagggtttagccataaattatttgtctagaccaatgcccagaaaagtttttcctaggttttcttctagaatttttatagtttcaggtcttacatctagttttttaatccaacttgagatgatgtttgtatatggtgagagagaggggtccatgttcatttttctgtatatggttatccaattttcccagcaccatttattgaatagggtgtctttctccagtgtatattttttcactttgtcaaagatcagttggctgtaggtatgaagcatctatcaactgttgactgaattttaaaatgtgattatatatatatatatatgtaaaatatatattgtgtatatgtgtatatatatattttacatatacacacacatatatatacacacgtcacattttcacatttattcagtagtattctatagtgtatgtatgtgtgtgtatacattaggtaatagattagatatttgtatgggtatatacacacatacatacatcatagaatactactcagccataaaaagaataaaattgtctcttttgcagcaacatgggtggaactggaagcaattatccttagtgaaatgactcagaagcagaaagtcaaaaaccacctgttctcacttataagtgggagtaaataatgcatacacatggacatacagagtgtaataatagacactggcgacttcaaaaggtaggtgggtgggtggttgggtggcatgaggggaaaaatactacttatttggtacaatgtacactatttgtgtgaagttcagattttaccattacacaatacatccatgtaacacaactccacttgtatccctaaatccagaaaaaaaaaataaaagaaagaaatttggcaatattgttatggaaaattagaaatcatgctgcttttactttatttataattcccccacaggtaatagtctaataaatcaaatcaaccaggtttggcctcagacaactctattttcaaattatataccccctatttgccatcttcatggttttgagcagttttatttactcctcgtagcctcaattttctatctgcaaaatgtgatagacctaccttcaaggaatgttatttgtggtgattaaacgctattgttatgtctaatgctgttgaataactattcgagtatttctcacagtgcatgtctattgaggatggtgatcatttaatagaaggaaagaaattatcattgcttcacacagatatttccaagttgcttttcaaagaagaacaaattttcattttcagtggcagtgtacataaatacccatttcattgttctttcaaaatcactaggttatctcttatttaaaaacatttcttaatttgatgttcgaaaaattatttcaccctaattttattttaatttctttgaaaattagtgagattgaatttttttcaaagctattggatatttgcatttttgggtaaattgcctcttcacatacttagtacatttaataattaaaatatattttttcattctacacattgaatatattaataattatttgcttgtcatatttttataatggaccaaaaatttttgaaccaaatgaatgaatgagttaatgctgtgataaattttccacaagcaggtggaagaaggaaaaataatatcttttgtacctatccatatgcttacaaaattttatttatttttacagacagagtttcatgctattgtccaggctggagtgcagtggtgcaatcatggttcactataatgtctaactcctagtctccaacaatcctaccacctcagcctcccaagtaggtgggtctacaagcacacaccaccaagcctggctaatttttaaatatttttgtagaaatggggtcaggctatgttgcccagactggtctcaaactcctggtcttaagcaattcccttggatcagcctcccaaagtgctgtgattacaggcatgagccaccttgcccaggcccctgattccccaccttttttatagaaaattttaactttcagttgtggaaaaatgaatgtggagaatttaccaaagaaattttaaaagaaagatatctgattggtgttggaattagagattaagtatgctgatatactgtttaattaattataatatatatattactgagcatacatatatgttactataatatgtataatatgctcagtaatctatacattttactataatatatataatatattatacatatatgctcagtaaaataaaacaatggtccccaacctttctggcaacagggactagttttctggaagaccagttttccatggactggtgttggcagggggatggtttggggatgaaactgttccacctcagatcatcaggcattagattctcataaggagcaggcaaattagacccctctcatgcacgtgcagtttagaatagggtttgtgctgatctgacagcaggtggagctaaggtggtaatgctcactcacacgctgctcacctcctgctgtgtggggcccagttgctaataggccatggactggtgccagtctgtgaccctgcgggttggagacccctgaaaaaggactgaagttcacatcagttattttttccacaggttatttatgttcataaatttagaaaccattaaaaatgttcattgagaatgagatttaactactgttaagattttcaatgttgagtctttttcatttttgagacagattcactgtcttgcccaggctgaagggcagtggcccaatctcggctcactgcaaccaccatctctctggctcaatcaattctcctgcctcagtctcctgagtaactgagattacaggcatgcaccaccacgcccagctaatttttctattttttagtagagaaggggtctcaccatgttggccaggctggtctcgaactcctaacctcaagtgatctgcccgcctcaacctcctaaagtgttgggattacaggcatgagccaccacacctggccaatattgagtcttttaatatacaaattcagttaatagactcgttaaacattaccgctgattggtttggtgagagatcctggataatttactgagtctgcttgtatgtcaatttaatagagggtttaaaaattgaacattacataaatagattatgctctagttaaagtaacataataataaaatttaaaaataaacatattagtgtgtaattattagtgttattggggtattttccctttataactactttatcagaacatttcctttaaattgtgattatctataatctaagaaatttctgttacccaatcagtaacttctgacgtctacaaatttgggaggcaataaaatttgcactgtcagaggctactgaaatttaaaaataaatcacaaacactatgtctgaaatgttaacataagtcaatggaaaaatacaatgtaattcacaaaaattcactttgtatgttactttctaataaatattcctttaagtaaggattaggtataatactctattttgggtactttttctgaaagttaagtaatcatctaacaggctccacatgggaggcagaaagcaaacagcagaaggagcagagatgaaactaggtctactggacaggaaacctggcatgttagttataaatctctaacttttctatcaatatccagataccagaatcttcctcatgtacctttctttgctgtaatataatccttttcatttccatagactattctgaggcagttaccctctcttatcaactctaattatatgcattgcaacttgttcactgagctaatattcctacaacaaaatgctgagcaaaggataaatatttttttttcatgaagctgttactggaacaaggcaggcatagaagatcttgatttttgctgttagactgtgctattatgaaggcatcctcattctaatctactgttagtatatacatgtgctcacagtgtctttcccatcattataggtacaagagaaatcatacttttgagtgaacacacgaaaactttccttcaggaattcaccaacaaaggttatatttctaacacactcaagtcaggaaaaaaataatggcattacttaaattgttatcgaatgcactggaacaagtatttccacattagcaatgtatatgaaataaaggggcccaatgcttaacaaaataaaaatattaggaaaaaatatttcaattcttgcactgaaaaggaaaagcatatagtactaatgagaaggattttggcatagcagtttttggcatatatatataccctgtgtattattacatattttggtccgaaaactttttataaaagcagtttccttatttattgttctgacatcaccatttataatttatgaaactacagtttataaatcatgtagcagggaagtagtcactcaatattttaatacttagctattctggcattttttttattctacaatatttattttccttgtattatatgccaatatgttcatatcactccaggatagctaatcagctaatcttagtccatatttgaaaccaaaggtgtgtgttcattttttaggcgtatttcttcctaattatttcagctggaactagtccataatataatataatggaacaaagttgcataaaatgtacctggctgtcttcccacttactggtctttgttagactgagatatcttaaatcccgagcaaatcttagcatattggagatatcaatactccaggatttgctataaaggtgagctttatcctttattgtagattttgcctatatatttgttaacattggaaaatcattgaaaactagtttatatgtctatgcaaatatagttctttctccccccattgatacagaattaaaatttaaccaggttaatgcccttctaccaatagtcacaatatacataaacactgttattccctattcttctagaccaagaaagtatttcataaattgtaaataggcaattaatttatttttatgtgcattgctagaatctgaacagtgcagttgtcctatagctccctaccactatcagcttatatacctacagcttccagcaatagagatgagcaaagattggctattccaaagataataagagaaataagaggcacaacagaagcagaacttatcttttgatgagttgttgtacttactaaatcacgacatccaggctctgtctccctagaaggggcagttcgtaggcactgcgattccatgcttgagaatttataaacagattttcattttcaatcggatctaatttattctactataattgtgcattctctcattttgtgtccaggcatttatctttgtccagataaccacagggatatatgtgtctatatttaatttgaagatgaaagaaaatgtgaaatttagtagtagacattgttggaaaatacaccaatactaaaagtgtttaaagcgatttaaaaaaaaatctgcatgtctacttcccctgaaaaatcatttgcatattttcacaaaacagtatgataaagtatacttgaaaacatgtataatccccacacataaatctgtgtggctcataccccttcaattcggtcaaaactatgttgaacacatttcctcatctgctcctgttgactgaactccttggatattttaaaagtctttcaaaaggtaaattaatcctgtgactgaacaattgaccatttagaggcctcagcccgtaacaggaattctttccctatttaggttattttgtatatgattacagttgtaaccaggggtcttctctatacattggtaataagaaaatcaacactacaaaagaacagaaagaaaactggtcatgaaaaatatatactgatttagatagctgagccagaaaatctgaaatgaaatttcattaaaattcaaaatttaacaactagcaccaagtttgtggtatccaaatactaattctcacttgaaccagtgcttcccagagaaatagctgacttttggactcttgggaggatacataaaagatgaacctggggcatgtgctgacaggcttggaagttgccagaaccaagcagaaggggttccaatgggtccagaatgcaacaattttagcattagaaataatcatgactacaattgatcaaaacacatcagacattttaaaatccatatattcacaaggagactaacgaaagttaatagaaccaattcattacaactgtagttagttagaagcaacttatattcaaagttggttaaaaaaagaaaaaatatcaaacattcaccctgctttttctgaataatttgggagagttcttctctattaaagattatagctaaaaatacaaaaagggtaataaaaattactattttgaaaccccagtgaaataataatagatctaggtaatgatcatcagtgaattttgttagattacatattaatgtatattttataatgcaaaaataagggtaaccatccctgaaaccaccgatgaattttatcctcactgaaagtggaatagtcagatattatgtgcttcatgatatgatgtaacatttaaaaaatctgaacttaaatatgatcaaacctctgaatattactaccagtttacgggtaagagatgatagtagaatgggttacatgacttcttaagaaatgattcagtcaaattcaaaatgcacaacattctatgggacaagtaaatcagtttcttgacaactgaagggcatttctaaaaaagaggatgagatagagtcctttacagaatgaaaaagacatcacaaataaatataatgagcagatattctttggctccaatatttcaaatatctactaagatattttagagcaaatcaaggaaacctgaataagaactggtattagatagtgttaaggattttgtaaataatggtgttagatagattaatgtttattatgagttgaactgtgtcaccccaaaatgatatatttgagtcctaactctcaatacctcagaatgtgggcttatttggatagaaagtcattacagaggtaaagttaaatgaggtcaattaacctcaagttaaaattaggtcattagagtgggcctttatccagtatgactgatgtcataaagggaaagatctggatacaaagattgacacaagtaaaagtaatatgatgtggagagacaccagaagacagctatctacaatccaaggaacagctctttccccagaactttcagaagtggcatggccttgctgaaaccttgatttcagatttgtaaactccagtactgtgaggcaatacttttctgctgttaagccatctcgtttatagtagtttttgatggcagccctagcaaactaacacaccattcaattgtctatattagttggaaatacattatataagtatttatacatgaaataacatgtgcaagatttccagtaaaattatctagcaaaaaagtgaaagagaagaaataagatgagagcctcataattactggagttatggatacatagaattaattatgctatattaatttataagttgacttaaaaggtccatttgaaaggtttaaaaaaagacaaaatagctgggcctgtagcctctgctactcaggaggctaaggaactttttctgaagcatccaggaatgtttgtaattatataatatatattaaaaagtatcccttacttttaggaggatcccttaagccaggagtttgagttacgatcatgtcaatgcaatccagactgggtgacagagtgagaccctcatttctaaaaattacaaataaaccaacaaatgaagaaagaataaatgcatatactcaatgatcacactgatgaaattaaggctccctcacagaactaaattctgtctcatgtgtaaaacaccaaaacataaaccaaagaacctagccagagaaatgccactcatcagttttatcatgaagatttgtatctcaagccataccttttaggatattgataagcccactctaataactaactttctgagaaggtttttattaaatactacacaaagaactgaaatagtttgtgaatccagtataacattttaaatctcaaagataatcctttgggggtttttttgttttattatttgtatttttttgggggggacagagtctcactgtgtcacccagtctgtagttgaagtgcagtggcgtgatcatagatcactgcagcttccaaacatctggactcaagcaatccttctgcctcagcctcccaagcagctgggagtgcagatgcttgtcaccatgcccgagtaatttattttaattattattttgtagagaaggggtctggctttgttgcccaggctggtctcaaactcctgactttaagtgatcctcctcctgcctcccaaagtgctggaattataggcttgagccactgtgtccagctaaacgatactttttaatatatattatgttattaaaatcatcctgcttcagaaaaagtttaaacacacatacacaaatgccccgtttaacatttaaaaattcaaattcatccttcaaagtagcacttggttacctgatgtttctccattatagtatggactgcaatgagacaatttagaccattttacttttttaaaaaatatgtacttgaaatataaatctgttttaaaatctgttgatgatcagtacagtggatatagctgggttccatgtccaaaattagttataggaaaagccaagaggtcagagagtaaaacatgctttaggtatcataaaaaaaaaaaggcatatttaggtggcttagtaaaagcagtcctagataagtgatatgattagcaaaattaattgattcaccactctctcactacattatcctctactaccttttttttttttttttttggagatggagtctcgctctgttgcccaggctggagtgcagtggcgcaatctcagctcctgggttcacgccattctcctgcctcagcctccctagtagctgggctacaggcacccgccaccacgcccagctaattttttgtatttttagtagagacagggtttcaccgtgttagccaggatggtctctctctcttgacctcgtgatctgcccgcctcggcctcccaaagggctgagattacaggcgtgagccactgcgcccggcctcctctactatcttaactttacccttgcttcttatccctttattttgttgtcaataccaatacaattttcctggttgccaataccaatgcatattctctggaatatggttgagtggtattgatgttcaagatgacatttactttctcctttttcactatgtatctgtgacattcttttaaaatgtggttaacctgtatctagtttgtgaatgcttagtcctagcttccctctctaagtaagggttctcatcttttatagagcctagtaccaaaaatagatgtacaaaatgtgtaaccctaatatctccttaataacctagaatacacggcaactttatgatgctttttatacagctaggtgacacaatacttattgattacattgtaataaaacgaatatatctggggttaaacgtgaagggagaccaaggatcaaattgctctaaaaaaatctaaatgaactctttcaaaactttggtgttttaattgctcagtaatccatattgccatattttcattctaaaaatggttttttaaaccataattattctttgtatgccgttgttaattttctccattattattccttggatgcagatgttaattttgaatactgagctatggactaggaacctgctataggtgaccagttttgataacatttacaacagttggtgggtaattttacatatacatatattttttttcaatgctcttcttctccatcacattatagtgaattatattgtaatattacaagagggagtacaaaaatgatgtctgacttcttcatgctatatccgaagtctcgagaatgtctgttgcagaaagatcttaatagacattttctaaaagaagacatacaaatggctaacaggtatattcaaaaatgcccattactgatcctgagggaaatgcaaatcaacaccacaatgagatacagcttccttccatttagaagggctatcataaaaaaaagaaaaaaaatgcaggcgaggatgtgtgaaaagggaacactaacaaactgtttatactgttcgtgggatagtaaactagtacagccattatggaaaacagtacggaagttccacacaaaactaaaaattcaactatcatatgatccagcaatcttagtagtggctacacatacaaagtaaatgaaatcaacatgctgaagagataaccacactcccatggttcattcagtattatttgtaatagccaatacatggaatcaacctagctgtccaccaacaaattaatggataaaaaaaatgtgctgtatacacaatggacttactattcagccatgaaaaagaatgaaatcctgtcatttacaataacatggatgaacctgcaggacatcaggttaagtaaaatagtaaaataagccagacacagaaaagcaaataccacataatctcactcatatgtggaatctttaaaaaagaaaaagtggacatcacagaaacagagagtagaacagtggttgtcagaaaggggagagggaagggaaagatggagaaaggttggtcaacaggtgcgaacttacaagtaggaggaataaattctggtgttttattgcatagtgatatgactaagattagcagtaaaatgttgtatattacagaatagctagaaaaggggcttttgaatgttctcaccgcaaaaaaataactgcgtgaggtcatgtatgcactaactaccctgactgactcattacacaacatagatctgtataaaaacatcaaattatactcataaataagtacaattaagatgtgtcaaaatatttttttaaaaaatgcctgttgcatcactatgtactcaagtgtttgtcaaatgaagaaatgaaccaattaatgtataattgatcaagtttttaataatccattctagtaaaaaatacactatttttatgtcattatttgcaaaatgtgtcctaattctcccttagttttcagttaacccccaaatttcaacttacactgccatttcttgcaacattaatacaaaatcaataaaaaatataatttgaattgaaatccagagttaatttatctatggaataattcataatctatggtaagaccttcatgtgttcggcatatatccattatgagtcttgtctattgattttttacttggttggacctaaatttagaaaaataataatcaatttactcacacattcaccaaatgagtactgagaagaaatgatgctcaaagcacattcttcacagtgaagtaggagaaaattatgaataggacacaggtcctattctctgtggacaaaaagtttgtaggagagataagacatgcacataaataactactaaaatacagagttactagtgatgacaggagcatagataaagagctatgagagttcagtaagttcctattgtctggaatgatcagcatcttctctataaagaaagtaattttttgagcacaaagtgtttaggcaaatggagtttggatgtcagagaagacatccaaatgggctaaccagtttgagcaaaggcgcataactaaggctgacacataagataaaataaatatgaaaaaatggaactgattaaaaaaacagctaattttcctctaaaaaaatctatttttcctacaaacacccatttagaagctttatttcccaaccttgttcacacccagatatggccacatgaacgacttcttgtcatggtacacaaatgcaagtgtcgtgtgcaaatttcttctcagtattttaaattaaattgcttgccccggacttcgtatgtttctctctcttttcctttataggctggaagtttctgacacttgactaggcttcactatgcatgtgagaacaatgtgttaaggtcactgcctctgcaacagtggccaccattccaggcctgtcctgtgctgtccagtatggtagccactagccaaacaggtggctattgaagacaagtcctaattgagatgtgttgcaaatataaaatacacacaggaatttccaacacttagtatgaaaaaagaatgcaggccgggcggggcagctcacgcctgtaatcccagcactttgggaagctgaggcgggaggatcatttgaggtcagaaggtgtgaagtcaaacaaaggatggaactgaggtccctggatggtttcctgcagcagagccagcctagatctctaaaatccagagtttattttatggctctggatgccagcgtgagtttagacttttttttttctgtttttatggtcactaggaggtagtggaagaagagacaaaaaggctgcttactttttttttttttttgcacattaccatgtaccatcattgtgctcttccaagttacttcactagaatttgataagaagcacttgttggcagttgagcatataatggattgaaatgaggatacatgataatatcaaatctacttaatatcataaatgaaaatataaaagagaacagagagataaattgcagagaatgtagaatcatggttataacaaaggactatccagctgccataggaacctaggagataatggagactggttactttcaaattaggtaatggaataaggaagaggatttagaagacagaattatgaacatggtttgtgaaaaaaaatacattcaatggtgatttaaacattcagaagatgaactaccaggagagcaggactgacacatcagtttagaaatccatttgcataaaaataaattgggaaaataagctcaatgtaatatcaattgtaaagagtgtacaaaacagaccagacctgaaaaggagagagaacaagatttcacatagccatgtttgatcctaactaaaaaagagctgataaacctctcacttttagtccctttcaagtagctataacatgttggctataaattatcagacactagaaaaagaaaggttttgaatagtgatttcaacttgtccctagtgatataggtaatgcattattctcttagtatttttctttatacttaaagaattcctcccagataatacttctatggatcttatcttcagtgtcagaactgcctaaacaattcatacaaaattttgtttctgctgagattatgtcaataactgaagaaaattaaatttgggcttaagatctttcagttgattgcttgggttactctttatactctgctgcaacacagaatctgagaactgaagcagggactgaaaaaacgactgcaactttaatgtagtccagctcatcctcatacatgaatcccactatgcctctcttgacaagtcttgcctctatctaaatatcactgggtacttcctgacatcagtgaaaaagaattctatttttgaatggctctatttgttaggaagtcttcctgatatagtagtgtaatcatttccattctctatggaagacttccaacataaggatagctacttttcaacaaggctacaattcaaatattcgaagaaagttatctctcctataaatcttacttccagactaaatatttccagttccttacactatttcttatatagctgtttgctctatttttactatactggtcctttattaaggagcatgcttcctgtaaaaatatctgagtaatgtagagttaattagtggcagccacatatttcctaatttgctgattgactctctctctctctctctctctctctctctgtatatatatatatttgctaccagtagtttttctgaatttttaaaaatatgaatgagaaacagaagggaaaaaagaataacacttactcccattgttgttataaaaacaaagtctccacgtataagtaagaaaggttatttgttgctgttgcattgattgtttttggtggttatttccatatggatatgaaatctagtgggtagcttagatatcctgactagaacaatataggaggcaataagataaacacagacatgaaaataagtcttgtgcataaaggaacacaacttttttgtttgtttgtttgtttttttgagacagagtctcacactgtcgcccaggctggagtgctgtggtgccatcacggctcactgcaagctccgcctcccgggttcatgccattctactgcctcagcctcccgagtagctgggactacaggcacccaccactatgcccggctaatttttaaatttttttttgtatttttagtagagacgaagttttaccgtgttagcaaggatggtctcgatctcctgacctcgtgatccacccgcctcggcctcccaaagtgctgggattacaggcgtgagctactgcaaccggccaaggaacacaccttcttatgagaatataggcaaagagttaagatggttgcagatacagacaggtttctatgaagaaagttgggttactcaacgttcacacacttcacacacacaagagaacatgagaaagtagctgccatttgtaccagaatgccgtgaaaaacagacatgtctagatgacagaatttagtctacattgagtaattaagtaaactataatacaaaaaagatagaatgctagaagcacctttgctgagatgggatgggatagtattgtgcgtgagtatattttgtaaaacccttgaaatgtttattctggaactaaggacaatgagttaaaaaatgagtttggagatcataagtggttatccatgaaagtggatcggatcattgaaggaaagtggtatgaaagcacagaagggggaagtgtggggagctcttttatttgaagtatgtaggcaaaaggagctgtgcccagcagagcactgggggcatggctgcctccacctacctttcaaaggatatgacgacctggcacagccacaggtgtgggactgcagcccagaatagctgtgggacctagacagagagccactggggtggggggccttcctaccaagccatgtggatgacattttcaccccagtgggcctggaaagcagagtatcaaatcaagaggattattcctaaggattaagatctcatgaaatttgtcttgcagtttggagttaggatccattacgtcttcttttctctatcccccttttggacaggaaatgtctatcttatgactgcctccaatgtttgtattttggaaacataacatgtttaatttcacagattcacagcttgacagcaatttgcctagggatgaatcgtaccttgagttacatccatgtctgatcaaatgatgtttagattagactttagtgttgatgctgggaagagttaaaacttttagggctgtggggatgttaatttattttgtgtatgtgaagaacatgaattttggggggacaggtgtgtaatgctatagtctgatatttgtgtctcatgaaaattcgtacgtcgaattcctaactctcaattgtgatggtaacaggaggtgggactttgggaggtgattaggccatgcaggcagagccctcctgaatgggattagcatcctcataaaaggggccccggagagctccctcaccctttctaccacataaggatgaagcaagaagacagcagtctgcaacctagaagagagccctcaccagaaaccatattaaaaccttgatttcaagcctgcagcctccggaactgtgagaaataaattcctgttgtttataagccacccagtctatagaactttattatagaaacccaaactaagacagaaatatacagtgagaactaaagagagttctccttgtttaacattttctaaataagacatgaaaagcccttttaagcaattctacaaaccttaacttatcttggcctttagcctttggatattagcttgagagttctgcctaattttatttattgtgattgtttaactcaatgtcttaaaaaaaatctgaggtaatcagaacatccttgaatagtcatgttgctgtttttagttattcctcccctcccttttcttcctgaaatggaagactgatatcacctaggtgatataaggataaatgggaagccttccagtgattttccattgtgattacaataaaatccaaactgcttgtggttgtcaataaatccttacaggagctggctcctgtctctctgatctcatcacagttaacctcccatcaatagtgattctttctgccctgctccaacatatgcctgcctgagagactttgcagttgtcatttactcagcccagaatgggagtgctttgctcccatagtgtggatctcagctcaaatgttttttctttggtacaggcctcattaagtatcttggcaaaaacagccttacctctacaagttgttgttctctattctgttgccctgtctcaactttattatggcagatattgtaatccacagttttcttatttttattggtttgtgttgtgtctaccaaccgacctacacatgttaactccatgaaggcaaaaactatatttcattcattagtgttccttcagatcttgggacagtacctatcaggaagaagaccttcagtaaacaaaccttactataatgaattaatgaatgaaggaagacaacttacattttggcccaaaagaaacctcattactggtggaaatgaaattgaattttgaaagactgtgtcataagttcagcattaaatatgtttatagaaaaaaacataaccacttctaatacagaacatatctattaaataattagacatttaaaaatttatatgatgtggaaacagctaacacataagaggttcttgtatttacatactgaatctattaaataaacatttaaaattattttatatttaaatagtatacatggaagagattgttttgtttataacacagaaagtatctattaaataactaaactgttttaaagtttctttttgtggaaacagttaatgtgcaagagggttgttttgtttgtttgttgcccttttcctattgtttcaattctaatggacttaaaacaggacttatattttcctgagtataaaaattgtttcgttcaagttattatttaaaatttttgtatattgcacacacctaagagaggaaaggtagcaaatgaagacagatacacagacaaaaacacttttaaactagaaatatcaatgcaactggtaaagcagccagttcaggcaggaagtctatcttcattgaattgaggagaaaggaagagcaggaagacagtgaaaaaggaatggtgaaggtgaacaacttatggcaacacagagtcaggtctaccgctcaaagaaacaggggtttgtgtgtgtgtgtatttaatgttaaacacttgcaggcctacatattccaaattgctctagccattttgcatacctaagcacaataacccacaaacagtaaactttggttcagtaaagtctttgtcaaggatcacagagctggcatgtgctactgtctcatggggcaccatgagaattactgaaaactgcccattgaacaccatgcatatcaactgacttagtattttattttctttctaagttcaggtggcatatgtggacacataaacatgttagagtgtaaaacgtttcctgtttatatctgattttgatgtccaacaatgaatttaaattaaataagtgtcagaatttttaaaaagtgaccttgaaactacccattgtagctttttcttctcatttttctgcattaggaaattttcagtaaaattttgggtatacatgataatttcctcattataaacatttaatgtgatctcaattcaactgtagttcaaaatcactcataaagactcaaatagaccccagagttgggggactataaaatcagaaatcaaattctccattttacttactgaaatggtatcacctttcaaatgccaaagatttgaatgacttattaagagatgctttgttctatcgacatcataaatctatcgtagtccatgccaaggtccatacttaatagtattttaactgtgaaatactaatttaaatccacagttcaatgattttcttaggagatgacagcataatcttgaaattattgatgtcagtctcttataaagtagattccctatagagccactcaaaatccatggctttttctcactgtgagggtgtcagccatctttgagctagatgaaagaatgggaagaaaataggtcccatgttttatcatcctcatttaacacacgatcttttctagctctcaaccagcattcagaggtgaacttcaaaactctgctgcgtttatacacaatgccacaaaaaattgactaaatagtattcaaggaaacttttaataatatccttacattcacaaagttagttattgtattatttatttgatgtacacttcatgtacctcatcttcaagataagaactgtttcaccatttgctattatatatagtcattccatgtcaatagcttatgctttttttctaacaaatctaaaatactgatgacttttacagaaacaatgtttcttatacagcagtgttactgaagtaaagctcatgatgaaagaaagcatcaccttaataaaataggaactattacaaattatataggagaagtattcagtctaattgctcaaatgtttattgaagactttctttcatttttttatatggctgatactgtagtgaacaaagcagtaatagtttatgtactagtggtgcttacaatgaaagaaatattctaaacaatcactttaatatatacatgggacaatttaatattttgtgcaagatctcctgatgtggaaaatgttgaatcatttaattctttcccacgagtatttttagtgacttttcctacccactcattcatctggaagaatgaatgggtaaatgagcatttcactagcaatttttagtgatttttttctacccacatagaaaaatagataattttatttacccattctggaaaaatgaatgggtaaataagcatttcaccagtaatagcagaatcaatcacaatgtaaacatttcttcggatacatattgttcctaaggctaagaaccataaataaatgatagctggagagtgaaatttaagaaactaaaagtacattaaattggcattccctatcatatattctgagttaaaaattaattgacctctgtttctaatgctgtaaaaattaatattaaatggtttctccaaattcagtaagtaactcacatatgaatcaattcaacaacatttattatgtaccttccctctttgtgtaagaactcagatactattggaatagtctaagatgaatatgtaacatctgaaataatgcaaaagctcaacaaatcttgttgatttctaggaataggctagtaggctaaaacattatgtagaatgtagtgacaccggagtggggagttgaaactcagaagttgacaacaaagccaccaacagcagacttaacaacaaggagttttggttttaacaaggtgaccaccttgacagccttttactgttttcaattcgtttgttttgtttttgagaaaggtggagggaagacttactacaattactagctgcagttgaagagaaaactccacttggcatatttttttttctcctttaaacaaccggcctcattttttaagtctaaaagagagatgggcaatgcccccaagttcctgagaaatgtgacactgacgagccatctttcatttgtgagctcctagttggacttaagaagcaagtaaaattagatcagaaagccactctagactaaaattaactcctggaattctgccctttgagttttctgtagtaataattggagaaggaggggtatttagatgtctctaatctttgttttacaaacaagaacacaggaaactcttgagatgtttttccataaatcacaaacctattgacaccagccctgggactagaatgatacccagtaattctaccatcagtatacttccattatatctcatgccttgcagtccattttatacagacggggtcttattttatacacatataaagtaaattgtcctttatacttgaaagatcacataggaataatagtcccaactaagggtgcttcctatccctccccttattttatccctcctctccaatgattagcaaaagacaactcatttatttctttgatactcttagatactgcttgtcagccaaaacatctgattacaagggggtcacatcatgacaatgctaagttctttcttctttcccacctctctagatattcttatgccagcaggggaccagtggccctgtcccatctcctgtgataagaagctctgtgtaatttaagcctagttatctctaaaatatagattaactatgttttgtctcttcatatacacaaagttctacctttgttcctatgctcactttgtattttcttataaactttactgaataaacaaattagttgaagaacagagtagaaaagtggctctgccagtcatagttagaaagtaatggtaaagagcttttgcagaaaaggaatttatttcagcatttagagtgactcctagacttgcacagcagactagagaattacgcctggatgaggggctggctagttgattataaagatgatgccacagcaatgaatatttaagatgcttcccctggcaacatcacagtaattttcagtaatgctgctggactctccatttggttaccactactgtgaataacctgtgaataccctgcacatatcaagatgtaaagttcacatctgataggccaagcttgtgtcgcatgttgacatcactgcagtcagtgagcagaatgtctgctatctttgtatagagatcaatggggcattgcttcctgattcttccggaatcttcacacactgaaaatagaatcaatgactatccagtggctgggtgccaaatatcaacaagtacttaagacagagatgagaggtgaatctaatctaacaccctagttaaaactaagggggttagttttaactctcagaataatatgctcagcagtacaaaaagataaataagccacggtgggcaagtctagaaacataagttatcaggtaccacaatatatttttaggaataaaaaaaggcccaactttgaaggacagtatatgcagcaattaagaacacagactgtacaggtataaataccatttctgtcacttactggctgtgtggccctggtcaaattcactgagttttctgcacctcagttttctcatctgcaaatagtacagaaccaatatctacatgtttatttcaaattctgaaacaccaaatacatttttgaatcataatcagttattaagttaaagactgcctgcattccactgtcaggaaattatatcaaagagaatgagactctttatttctaaagccagtggaaaataaccatagttcaatcattagccccagttcaaagacttagtacattttcttaggcacaaagtccatttatgcatagttttctggaaataagacctgacttgcaggtgatgcttatgtcccctgtttgcatattcatcagtcctttatagcacatatcctggaaccatatccttcctgtgcattaaattttaccaagtaaaaccatgagtttacaggaaattaaaaacaaaccagtgatcatttttcataaggagtgttgtaaaatggtcttttacaaatgacctgtagcagacatttattgtcaccttctcagcatgtaatccccatttctttcaccagtagcccccagatattcctctgccaaattcctttgaacttattcttagcgtgtggagccttagattcaaagggacacatgtttaaaccaggtactaaattactactgattaatagacttgaatatattcttgagtacagagtttgattcagggatgagtatctcagatgaagccaataagccataagaagatatttgttgggttttgcagtagagtaatctcaccatctttttaaggggaagtaccagaagaaatgctaatcttcctctgaacttcagctgccatgtgggaagctgacctggacattgtccctgttcatagggtcgggcatagctgaagcactgcagataagcaaagccaaacttcaaagatgacatcaggaacctttagatcaagatgtacatcaagttagaaaaatcttattttgcagatacgcaggcagaattatgatcttttaatttttaaagcccattttggttaagttttctaccacatgtaactgaaagacttctaattcaagggtaagctagaaaatgattagaaaatatactgttatccataagaacaaaaaaagtggacactttattgataataaaaaaattgccccatgcactatagatacattcattagagaaacagaagaaacaattggaaggaatcacagattgagactcagcatagttgtattattaacaaatagtttatatatgtcaataaatgttttcacatatgattatttatcctccttttagactgaaaataccagtcagataaaatgaatcttagattgaattttttaaattagtgcaaggaaaatatcatgcctgcaaaaaatgctttcagctgacttttatagtttaactctcaatgtgggagtcttttgatgactaaaatcaagagaagtcaagcttaaaacaccccagagctccgaaggaaaattatgatgttaaaatatatccttcagtaaaagttaatgcagagatattagcatgccatcatgtgaacactcatagcaaaagtacaaaatggcagaagaaaacaaaggatatttacagcaaaatatttagaaagtaagttataacttccaaaaatactatttttaatcttcattttaaaaaagcaatatgcaaatcacagatgagatttgaaaaaaaatcacatatatgtaaatttatattaaatgcaaaatatgatgttaaatgactcagtataaaattagtctattccagaaagatagaggcaatgtactcttagattctcccatgcaatcaactcaatgaacttgggcagctcatagacacctctgtccttcagttacccacatatttgtgcataaggctagagtgaactgacattactcaaacatcatgaagaatagcttatacttaaatacatgaaactgacaaaaaatgtttaataacctaatttacatgagttcatttgttcctatttatgaaactgttttttcaactagaaagctgaaaattttaatataaagaaaaagtgtgtcttaaatgttgtgtgtcttaaatttcctcactttgtaattcttctttcttttaaaaatatcaatagtgtaaaaaattaaagtgatgagtgcccatgatgaggagagaaaaatgtatatgctttatcgtgtgtggtcatgggggtggttatgtaatagaaataaagagatttttatattgtaggtgactggagcagtaaagagtgaagaggtatgggtgtgctaactgggcatgtatatgtatattactaaggtaggcaaagaaataattctttcacagcaactgactgatggtactctagatttctagaagcagaatactgtaaccagaaaaacttgctaaatttgtgagggtggaggatgggcgggtggtagtgagttcaccaggcttcacagatactgcaggagaacaaatgtgctaaatttctttttaataagaagagaacaataatgcaattttaaaaatatctatatagagataaataatttctaaaaaaacacacgttaatgttatatatgcatatgtgtgttgataaatatataaaacttggtataaactgttataagatactaattaattgcttagaataaaacaaaacattaagctttttattattgatctacatatcacatcacacacaaaatagataagaatatgctcataatttgcaacaatatgcaaaaagcatttgccaaaaaacattttgttattttatgtctacttttatgctttttcttcttatctaatattctataacattagatatctttatagggaaacattttaaaaagaaagttggatgactaacatgtttaagcctcttacaggaatctgacaataaagctacttaggagccataagccatctatagtatcagtctgctttatataaagtctggtgacactagaagctgtcaaacacacattcaggagacatagataattagctaagtgctaggctatcataatttttactgttttcattttccaacttttgcctcttttggaggccatatgcccttggttgttaaaaaatcaagttataggctgggcacagtggctcatacctgtaatcccagcattttgggaagctgaggcgggcagatcaactgaggtcaggagttcgagatcaaactggcaaacatggtgaaaccccgtctctactaaaaatacaaaaattggccaggagtggtggtgggtgcctgtaatcccagctacttgggaggctgaggcagggagaatcacttagacccgggaggcggaggttgcagtgagccgagatcacaccattttactccagcttgggcgatagagcaagactcagtctcaaaaacaaaacaaaacaaacaaacaaataaaaaacactaccaattaaaatatttttattttgtttttagttcttaatctattttatatttcatgcatacctacattctaatttaagcagctgattgttatttgtttctccacagttctcttcataggatggaaggtccacatgtcttaagtcacctgttttgttttcccctccatgcaattattttaaattgcaattttgtatacagcatatgactcaaaaatacaactcatgtggtcaattacattgttactctatcttagagagtttgaatttacatgtaatgcttaatggaaatagttgatggttttcttttaaaaatgatgagtaaacgcaagtataaaaacggcaaaggttaaattctcccaagtttttatttgattattttgtcagagggaagtggaaaaattttatccctctttaccctccctaattactttccaagtcacattgttttaatcttctggagtcatcttttcatttggaaaaaaaattatgagtttacaccatatatgggcattcttaccttaataagctataatttgtgagataatgatatccaaatgagtaaggactattttctcctcttttttggaattaagagataaaccaagagtccaaagacattttcccccatctcagtattacttcaggtaaataaagtgcactgagctagaaggtcattatgtttcttgataataaactctctcctctccatgaagccagataataaatcagtagagccactgcttgagaacaaggggaactattttggaacaacctcatatttttaaagtcatttcttatttggcaaatgccatgtctatacacctggcttaacagatagactaattccagatctcagatattatgaagtgcagacctctgagccatattccctaggaagcatcacatcatcaaatcacctacttcacttattctcaggagccactatgagctctctaaggatttgcattcacaatgtactattctctctttaatgatgttttcctctcttttgaaaagtcactctatccttctgactcaacaaatatacactttgagaaatcaagctaaatgcaatggatacctgcaacaaaaatgctgcctaaaatcataaaacactgaaaatgatcatccaaaagcacagttgctgctattatcccactacaagcaactcatgagattaatttcccagaagaggctgatgtcaatgataagtaaaactgcatattatgaacccatgtgaacttcctaacgtaaaaatctataatatggacattaaagtgtaagtacttttcaaggcctgagaaattatattagtcatttttttctatgacacatcacaagtaagtgtagtcagaaaacagatacagaacacagaacaggagaaagctgacattttattaacaattccattaaaataaatgagctcacgtccaagcaaaaatcaagaatcaataagtgttttaaattaagcacttgacgtgttggaaatgaatgtacactttagaacactgaaggaaccagtgaccactccttgaaatatgattccaatctattagattcattacatgaaaaacttgaataaacttcacttgagttaaagataaattcagatttaaactaatattgaccttcctcaaagtacaggaatggtgtcattcagaattaaggaacaataatttgtcaaacaatatcagtacaggatgaatttcaacttacacgagaattttatttcttttctaatgcttattgaagacattgatattttgtcattgatttaaatccaaggatagcaaaacctgtcatggataaaataattagtgaaaataacttccactttgaaggcacacacatacacagaaattaaaattgatttcccacattccctgaccccagtctttttaagggaagacttgcttcctccttccagagcatcttagtcattggttcaatgactgtaattttttatattcaattattgaataagaaactagaatctggatgtgggggatcagtttttagatgatatcacatgtacttctttcagtctttctcagggtaccttgcaaagttccctgactcatcattcatgcattaagagcagttttaacaagaacatttaccaggtgcagtgatgcactgctaagttatttacatatatcttattaaatcctgaccttgccattgccctctccaaaaaacaaacaaacaaataaacagaaaattctacagagcagtagtaattaggctcattttatgaatgaaaaaattgaggctcaaagagtttaataatttgtccaaagcaccaaaggtagtaatggtaggagctcaatatgagatgggatcatacaaattccaaaatgctatgaccactcttcaaaatatctttatgttattaaaaattgtgatttttatctccatacgcatgtttgttttttatttttatttttgagatggagtcttactctgtcacccaggctggagtgcaatggcacggtctcagctcaccacaacctctttctcctgggttcaagtgattctcctacctcagcctcccgagtagctgggataacaggtgcccaccaccacacctggctaatttttgtatttttagtagagacgaggtttcaccatgttggccaggctggtttcgaactcctgacctcaggtgatccgcccacctcagtctcccaaagtgctgggattacaaacgtgaaccaccgcacccagcccataggcatgtttatacttacttttcagacaaaacaaaacgaaacaaaaaactgtccttctagttcttaatatattaagcccctgaatgactctaaaaggaaaacattttccttttctatttctccttattttaaatactccactgaactaaaattaaacacattaactaatataaaccaatggttagaaaactttgcatttcactttctttatacaggtatgccaatgatttttctcttgcaatagaaatgcaagttaacatgtgaaatagattaatcaaaacaacataatgttgtgttttaattaaatatctagaatatatttatatgtgtgggtatatatatgtatatatttgtgtatgtgtgtatatatgtatatatatgtatatatgtgtatatatacacacacacacacaattaaatatcagtagaaatgctatgttcagttggaagtgttctctaaagaaactgccttctctttctgctttaaataattttatacatgcagttctgagtagttttgctaccatctgaccacagagaatgtctgaaactgtaaagttagaacaatccagaagaagtgaatgaggtagataataactagtgagggtgatatttctaagtttcaaattttaacagttatacaaggaatagaatcagcaataatagcagaggtatttccttcaaatgtaatagataaaataattctagtgctaaattaatttaaaagtaactattacattcagaagtttatccctactttatagtatttcgaaaacccattattctcatacagtacttccataactaggctgcattcattaagatgccagaatttcaatttcccaaaaagattgacactttcgggtaatctccacaattttagaggcaattcaatctattttgatttaaaattgattagcatctttggaaataatgtgtcacgaattgctgagctaatcaaggtaaatggggccatacattaaacattcaagaacgttattcaatcacaaaataacccacatttccaagctccagatcaacaaattaaagctgccctttgcaaagcttaatttctttggctcatcagtattgttgtgtacatttatatagttatcaaacattaacaacatgctcttgaaataggaaacagcctgtgctccctacctaggcatgccaaataagcaaaggccaaaaaggacgaaagaaaaataatgaaaatataatcaagtccatatttctcgcttattcaggtttcacatgacaaaacacccggtaagtacacaaagttattatggtaaaacctacgttaattagaatcaccaaaatagttctggatatacattagaagttcaacacaaaaagtagaggttaaatacaatttaattgatattgaccctgaattattatctattattttaattttaattttttataattttaaagtgatttggagaatgcccttagttctatgtgttagtatgcttttagcaaaatctatctgaagtggaaaaagtgatgacaaagagactggaattcagaatacttagaggttaacatctgtaatcgatccatggaatcttcaggttgtctcgatataaattcaaatgaaactgtgagggatgacaacaggtaaggaccattcagggaaacagatgaagcaaaggcacctgcactttgctctaatccccaggtgggctcagtctccaggtgactccaggcctgtctgcctgcctatatgtgagcctatagctagactaggggtgagttcattaagccttcagcacacgatcacaacagagatatctgtttttattttgctatccatcatattagaagctgcttttgccttagtttgtcactgaaacgaaatgtccctatttcttccttcagcagcttgcaagttgaaaggtgtatcaaatgggaacacagcgtcacagttgaaacatttattttcctccaaaaaccatcttcaggcagtggaactgacaatactttccagtaatgcttgagggcaaaatcaaggacagatagaacacaactgaggtatgtggtatttcttttatttcctcctccagtttaaaggtgcttttaaatgtaaagcatcttttctactagatgatagtttttaaaatagactttagtatgaaaagcatatttttgaagatttgtatccttatttcaaactacaacgtaagccaacccttcagcctagattattaaaataatgggatcaaggagtgttaaacctattagactgagtaggagaaaatgtttggggcaggaaataagtgcagaggattttactttaatggcacagaaaatacatttaaaaattactattaataacatctttcttctaccattacataaagacttatttgatcacttcacgccagaaaactggaatcattacactgacaactgaaacagaaagtagagatcattgaagaaatgaaagataatttaagataagaacattgaggctccaagtatggcttctagagaattaagctacagtatgctaagatcatctgagtgtcctgaaaagggttatatttatagcagttttgttcaatatatgacaaacagcacgtaatctcctctgtaaaaaggaataaaatacccatttagtggcgatgaattatcttttacactattcagctccattttaataatatatgtcctgtcttctctcgtactaagttacattatagtgacctgaataagttataaactctccagaataggctttctcatgtgcacaatcaaaataatgtcagggactgtgtcttatgcctcttggtagctccaatgcctgtgagggggccttccatgaggtgggtcttcagtaacacttgctaagttaatgactaaatgaatgatttcttaagcgagttgtggtcatgaaaatacaaccatcagtcactagaatgcacattacagaattatttaaccttcaagttacaaggagtcttacaggagtgctcattaaactcacattcaatttaagaataccttctacatttgtgaagctttgtcctctaaatcccagtttaaaaatctcaatgattggaagttcactgttccattttcattcagcttcatttgttaaacttgcctatgttgagtcacaaattgcttccttgcagcttgcatcctaactctgtcctctggataacacagaacaagaaaattgccttttcatcctgacaacactcgaaattttttaagactacggtaattgtctcacttactcgtttctggtttaacgttcccacatctctcacttttttatggttttctggtttccaggtccagtctcttggtcttttatgatctctggacacttgccactggatattctctactttttcagtcactttctataaatgtggaactcaaaatgaacaaaattaaaagagcctggctggccaggcacagtggttcagcctggaatcccagcactctgggaggccaaggcaggcagatcacctgaggtcaggagtttgagactagcctggtcaacatggtaaaatcctgcctctactaaaaatacaaaaattatccgggcgtggtggcacacagctgtggccccagctactcaggtggctaagacaggataatcacttgaacccggaaggcagaggttgcggtgaaccgagactgcaccactgcatttcaccctggacgacagtgagacaccgtctcaaaaaataaaataaaataataaaaaaaaagcttaattgattttaagttttttttttttctctctctctttttttgcagcagttttattatggtgtgtccagatgtgttttttttccattatatttaccctcctggagtgtacagactttggatttgtggcttaatcttcagtttaaattttttattgattctgtcccattctcttgctcttcactttctagaactctaaattatatatatgtaggcacatgtcaccagtttttaaatattcttcttcattttctaggcatttccttctttgagctttaatctggatatttctaggcactgatctttcagttcactaaccctctcctttgacttgccaaatctgttatgaatccatatattgaatttttaattttcaatcactgcatttttcagattccagttctttaagaaaattctccatctttttctctatttcttgaaaatattaatcatacttaggcgttcctgataactccaaaatctaaataatctattaaatatgtttttttcatttgtggtcatctgaacctgtttatcagcatgccaggtaattttaaatgaatattataaatagtacacaagatattgcacaaaagctctggttggtctgatttttctccaaatagaattttattttattctagaaggcaggtaaggtactgatatcttcagttaagtgtgagttttgggatttgttagggatggtgttttcttccagtttgctcttattcttggatcatagtacttttgggatcaaaactgtaagctagtggtatttaaaaggaccactccactttcctaggcactaaactctaacttctctctccccaggacgactggacggtgatatctttgctcagctatttggtctcccgggaacaggtttctgcttgatttcaaggagtttcaccctacacttgtgtagtgtaagaattggcaaatgccttcagaggaaatcacctactgcatattatttctggtttagttctctgagatttcttcttcaccctcaagtcctgatttacttggcagccctggctgtgacagtctctctctccaacccagcaagtctgttgtaagcgtctgactttatacttcctcctcaggctctcttctctttgctgaaaatagacagattttggtaagaaaaaagtagaacaattgttgagatcaccatggtgcactctcctctccagaatgttgttccaagccccatctgctttgagttttcacccacgtctcccaagattttggtatgtcattttaattgtagagagtgcagtgagcttatcacagtatcagcatgctcactgagtatttactaagtcccaagcaccatactgaacaacctacaaaggtgattaagacatggttcctgcccttcacttaattcacacagagggtaaggtcaagtgtgtgagatgattacgggagagtcaaacagggtatttattcttgagaataatcactatttctgtttgtttctagttggaaataattttgttttttacttctgactttaaagctaattcacattcattgtaaaataaatcagaaaataaataaaactataaaaagaaactagacacaatctcttggttcccactaggaaacagccattgttttgttgtgtatctgtcaagaattttatagatggattcttggaaggaacaaaagaaaggaggatggaaggagtagaaaaaggaagggcaggaggtaggaaagaaaggaaaagacagttattatagaggttgtgttaaaaatacttgcagtggaaaggataatctgtgaagcatgtgtacatgagaaaacaagtgagccaaaaactgagggcagaaccttggggaaagctaaagtatacagcaggagtgatgtggcgtgaggttgggtagttagaaaagaggaaactctgaagtctggagcaagagaacagagtttcaagaagtggatatgaggagaagcctcaaatgcagcaagaatttcttagaaataccctctgcatttgaccctcataatatcagccttggaggcttcaatggaactattttgagcacagcagtggtggcaatgccagactgcagagaggttaagcggaaatgagaaaggagaaattgaagacatccactaccaattatcctccttaataatttggacatgagagagaggaaagagataaaaggagtgggtaaaagccaaataagttctttagttttaatgctggagaaacttgagcatgtttacacactaagggcaaggagtaaacagaaggcaaaaacagaaaatgctggcaagagcatgaagctaacaaaataagactccttctttagatgttataatatgtaatacgattacccttgaccttttttgtatccacatttcagagcaagcacacatgaaacttaaggccaaataaaaccaccacatccttttcacaagaactgaggccaggtcaggcctgttcttctcagtgcctaagtcctctagaagcctttctcctgtacctaaacacggcactgctaacagtcacacctctgacccaccatgctctcattcaatcaaatttaatcagtgcttatcgtaggcagagcatgatgttagcatgcagaataaagcagtacaaaacaaactctgttctgccctctgagagcttatcttctagttgtttacagctcatgatatattatctcatcaaacagtcatcatacatattgataagaatccaaaatatggaagttctttggtcagtggctgttgaaacttgtggcaactttccaccttccaataaaagaaggagatcatggtctcttctgtcattgcctgagaatagatttccagtagatttgcaaataagactagaaaataataatccacaaaaagtatagacatattatggcaacaacattaagtaaaacaaatgttttaaaagctacatttaaccagtttttaaatgatctatataacggaaagtattgattagattaatatttatttgctttggggtgcattagtttttttagaccaaattgatcaaatcaaataattctcttctaactttacatagccttaaataaattctctctttttgcatctgattttgaaactcatgaataagatcatcaatatattttatcttgtaaaacaatctatctactacaccaagaaaataatctaaatatctactctcaggtacaaactatatatattccaaaaaataatttcagaaaactttctaggaaagggacatagatcattacctcctatagtgtcaagggagattttacaaactttaaacttttttttttttttgagatggagtctccctgtctcccaggctggagtgcagtggcacgatctgggctcactacaagctccgccccccgggttcacaccattctcctgtctcagcctcctgagtagctgggactacagatgcccgccaccacacctggctaattttttttttacaaacttttttataaactacatctgcaataaagctcattggtgcataactttagcgagtttattttcagataaccatcacagaaaaacttctataaatcatagacagatatcaactctatcctttcttagaaattctatcatgagcaattatcactttttaaatttatttttaattttgtgagtacatagcaggtatatatatttatgggagtacatgagatactttgatataggcatgcaatgcataataatcacatcagagtaaatgaagtatcccccccctcaggtatttatcttttgtgttacaaacaatccaattatatacttttagttattttattataatagagaagatttaattaaataataataaagaaaaacatgtattcttgtaaaggtaaaattaaaaatctctctttctaattttttttaaacattcttagtgatcattaacaaagaactctactccagcattctgaacccttgacttaaattgctgaattattttatttcatgaaacatactgagaatggtcagctagaactatacctggagaagcagttgttttgatgggtaggggtaagttacatgtttggctaaatgccgttatgcatgtcacagttagaaactttcctgaagactttttagaagttgtaggatatgtatgaatatgacatttatacagttccaagcatttttcaccattcctgtttgccatagtggttagactgtagggagaccccctgaaactactgctacggaataaaagatgaaatcctcctgattattgtaaatacaaaatagcatgcaggattgtgtaaaaacaatgccaggttgggctgccagaatgagccaacagtgcatgatgtgcttccccctgcagagagcctatgaacagacgtgtagtcagggaggtttcacatcaccaagattcctatcccaggaaagcagatgttcatagctctgggaatggaatgcaacccttgtggagagcctataaacagatgcatgaggggcgcctgttcatatggataagatagggctataaatgccctcatcttgccacggctcttctaggcctctttagggttaaggcatactcccttcggagaatttctggtctaaccagttgtctagcttcacgtcctgtttctactgattgtttgtaaccagcttttcctgccactgttactgctgattaatatcttgctaatcataggttatggaaagtctgtttctgttttaaggctctgttagaaattactgatatacacactatattgtaaattcttatctctgtatactgtacttctgcatacagatgttatgctaaagaattacttcatccccatgtgaccttctcacctcataatcaaacgatcctaaatccctcattaacttacccccatcctcactaaacttaataataaatgccggtataccaagtgcattggcggcatcgcaggaccagaaggcagtgacccccctggaccccctatcttgtgtgtgtctattacttctcgacctgccaatctgcctgggaacaaagaaagagtcatgttgcattgcaggctgctggctagatcccacaatagttagacgaatcacattttcacttgaattttttgctacttagaaacatgaatgagcaacatcaaaatgataggtaaaataaaacaaatattttttctagtgttcaccttacctaaattataagtaaattaagttcatgtaatctgcacacctttaagtttttagactaaagttaattttccgtataagatttaaaaacacctaggagctcatgcctgtaatcccagcactttgggaggccgaggtgggcggatcacaaggtcaggagattgagaccatcctggctaacacgatgaaaccccgtctctactaaaaatacaaaaagttagccaggcgtggtggtgggcgcctgtagtcccagctactcgggaggctgaggcaggagaatggcgtgaacccaggaggcagagcttgcagtgagccaagatcatgccactgcactccagcctgggcgacagagcgagactccacctcaaaacaaacaaacaaacaaaaaccacctaattaacattacattcccagtagaggatataattctttggatctggtatttctcctttagaaagacttcaaatatgatcactctcaaaatgaggatacaagacgcacaatcacataaaatgtgtatgtgttttatggtccttcaaaagacaatactagcagcgactcatattaaaagggaaaagaagtatttgacctattttaggcagccattagaaaatgtattattattatatatgtgacttaacctatctgaacttcaatcccttgcttgtaaaccttggataataataacatctgcacatagaattgttatgagaattaaatgaatttatctctaggagcatagcatgttcactgttgtcattctatagcactaaactaagcagtattctttcatcttagtcggggagactcttccttaaacccaagacatgttgataaagacttgtcaaatgttgactgcaacactgaatgcatttaccctttgaaattaaggaaataatggtttcttatttgaagcacttatttctatgtaggtaaaaaccatataaatttgaaaacatgtattctatttggttcagagaattgtgtgcatttatatttagaagtctataaaatcaagggagaaagattctgaaaataatttaatgaggaaaagaccaacaaacatattactacgatcaaagcaaatgttgtagaaaattgaccaccataagggttattcaacagaaaccaccacatctagattctctagtccacctcaggagctccttataagggtgctaagtctttcacataatttgaggctaacagtgcaaagtgaggggagatgagctacagactcttataattgcatcaaacagcagtcttcgcctctacatatttatgattaattaccaagccctttaaaggcagagaaaaatttccagttttcatcttccaagtcaattacgattgcagtcattagcattaaagaaatgcattagatctatccattttaattggcattataaatgtttctctttctttggtttttataaccttgacaggtcctgacttggtctttccttctttattattgccttcattatcttctcacccaccaattttgccctaacaataaatttttctcactaagtccactgcattttactgtttattatttgtgagttcatttctaatgaatttaactgtcatcttaatagttacccatagggccatacctctagccctgctctctcttctatttcagtccagtaattccagggaccaatagagcaaatcaagtttagtatatttccactacatcatattcacctccttgcactatcacattagaattaatctgtgcttttcagtgatactactttcttctaattttcttgctactgagctctttttcacaagtcataccactgaatatttttttctttgtatcagttaaaactttttattgctgccagtaacagtagaactaatccaaagtcattttttaagggaataattagctcaagcaaattaaaatccagatgtagtacagattaggttcaattctaggttttatccagtgcctcaaacaatgttatcagtgatctgattttgctatgctttcctgttcttccttccttggaataggctgcatcttaggctccatcctatggcctccaaaacatcatgccttcccttatggtagcaacatggctgcatcagccctagttctccaatccccatattacagctccgttgaagtcagcatcttttctgacagcatccacttaatcctgggattatttatttcttgtcctgatttaggtcacatatccatcattaaagtcaatcactgagaccagagatggttctattgagtcagtggtgtcctcaaatcttcccactacacatagcttagaatggtggcaggatgaatccttcaaaggaatatcagggtgctggaggaaggagaaataaacaccaggaaagaaagcaacatatgtctgagacatgcgccaattagattacaaactctgagcacagatcatgttgcatacattccagtcttccttattcttgtctgcccttccattcccacaatatccagcactgtggaagacccaccagctgattcttagtatatatgttgggatttattgattgatcaacaagtaaaattccaatctgaaagacacatattggatcaaacattttacataaattcatctgggactaagaggcttggaagatacagaaataggagatgatgtctctttccacacgtattgtctgcctccacacacatatggagaaggctcaaaacaccaccacatattagaatataatttgaaatcagcatatgctatcatgcctgtgtcctaatttggaattttaagaatagtgacctcattacactgactgtgtcacggtatcctcctatcactcctgtgtatttttaatggatatgtgtgtctttagtagactggacacttatttagaaaaaataagtaacttctgacttatcattttattagctccagagtttagcaaaagatatggtacacagtaggtcccaaatatctatttgttaaatagcattaattattatattgttatttgattagtaaagacagtaagcaaaaagtacaaatatggcattcccttatcatgataaatgcagcttaaaaggtaaaattcatcactataaaatatttataatctacatgaggtcctagtttaagcagcctaaaccttttccactatagtaattaaatgggtctggatatgtgtagggagcctcatgtaacttagaaaactactgggaaaaaaagtatccaatgggtgagacatggggctcaatagaagttcaaagacagtgagctaattttggttaggtaagagtgctttaaaataggggaaacatctattactcgggttgatttatagcccagtcttcatgaactcataatatttaaaccccagagtagaggtgtgattgagggagaagctggtagcttcaataaaagatcaagtaacaatgaaaagggctggctttagattcaatagctttggtgccaacaaaaatagcagctgtattagtccattctcacactgctataaagatactacccgagactgggtaatttataaagaaaagaggtttaattgactcacagttctggatggctgaggaggcctcagaaagcttaaaatcctggtggaaggggaagcaggcatgtcttacatagcagcaagtgagagagagccaggagaaaccgccacttacaaaaccatcagatctcgtgagaactcgctcattatcacaagaatagcatggaagaaaccaccctcatgctccaatcacctcccaccaagtccccccctccacatgtgggggttatagtttgagatgagatttgggtggggacccagagcctaaccatatcagtagcttcaaaagcacaggttgtcctggcactctgaaccaagtctggtatattgcggcaccaatagcagaaaaggtagacaatatcagataacacatgacaaattttagaactacagtgaaacatataatggaaaacctccccagtaactcccagactatctggagagaaactgaagcacctaaatgtctcacagatccgtttggacacagctgaaggaacacaatattgctgctcctgttgcagctgtttttgaatgccactcagctaaatcctaggaaaatccagattgtgtctcaaaattagaaactgaattgtgaaaagttctattttaatatgtcaacatgttttttacttctgtttcttcagaacctatttgtcaacgttaggatttccaggtgttgggtattcagtctgtattttaattcctaacaaaatgaaaaaaaaaaattaaaaagcagctatgtacattccatttatatcacttacacaatttctttcatataacaggacaattacttgcttttgatggttctaagagcagaaacacgatgtcctttttagggcaaattcattgttctggaagaagccattttgttttcctctcttgggcatgcagatgtaagttaggtactagtttatttaggttaacacctaactttgggaaattaagtcaaatgcaaacagtataaatggaatggaagtaatgtcatgtcttatattagcagtcaggcaaaggggctgcttttgtgaaagactttgagaggtaactggcagtcattgtgaggagtttgccatttttctccaagactacaggccagggtttagtcagctctgtgttagaaaggacgtggaagaagtggctctgagtcgggaaggagtgcatttcaataataaagtgacaggctaaaaatagaagcagataatggaactcagaagtggtgatgtttgatataagtaaattcaaacaaaaaggaggacacaaataaacatgaaataggtgcagactgaaatttttcatcttctttaacttccagtacaatagttctaaaggcagtgttcttcataataaaagccactgaatcaatcaaaattttagacacaaatgtgatacataacaaaccacccacaaactcagtggtttaaaacaacaattgtttattctcactcccatgactgccagtcggctggggattggctggtctaggctgctgtcagctagtcttgccttccaagagggcttcacatgtctcttttacttcttggaggaagaggttaactgagccctcatggcaatggcagaacccaggagggcaagcccaggcataccttgaaagtcattaagtgtgtccacatctgttaacatctcattgatccaaccaagtaacatggctgaactcaaatcaagaaatggaaccctccctctaggtggagaaactacaaagacccaaaacaatgggtgtggatgtaaggtagggtgaagaattagggtggaaaattcaatctatcacaaagacacagtcaagcaaatacaaattaccaaatgaaatatgtacaaatgaatcattaaaaacaaacttaaaggtatatttctcctccagatggtggttgtatatttatagagcacatctgtgatctgggggattgtatgtccaaaggtgatgtaaatattagcacaaagaaatgaataagtaataattgtcctatgttctgtctattctgaagtatggaggtaactgtgagtctcacattgctgcagcagatgggagtttccaagcattttgtcacttaagagttaagagtttacaagtcctctattgacttgttaatcacaccaatcaaccatcataccagttttaacaatggagaagaataagtaccagaatatatttataccgttgtaagaaataattgggagtttgtaatgaagtgaaaattatccagcaagacaatccagaactactactaactttttttttcctttgagatggagtctcgctctattgcactactactaacttctatgaatagtaaaaggattttacttaaaccatttcccctttgccctgataaatgagtactggcagcaggctgcactgtttctaaacaggaaatgggttaaataaccaatagttttaatagctaagcatatatattccatatagccttgccatcaagagatttcagaggtccaatttccctaaatgtatgaccttgccttaaagttagccacataacaaaagaagtagacatctttctgtctgttcaaaagtaaaatatgacactaaattcatgcatgtaattaaagcttatagaccactttatggaagaatggcagacttaactggttaatccatgaagaaaaaaagactttgaacagatgtcaagtgactgtgaaaaaatttgagaactgtagcatctagaaatggaagttccttcaaacgtgcaaccgttacaaattctgccaactgtcattctcagcaaactatcgcaaggacaaaaaaaccaaacaccgcatgttctcactcataggtgggaattgaacaatgagaacacatggacacaggaagaggaacatcacacaccagggcctgttgtcgggtggggggaggggggagggatagcattaggagatatacctaatgtaaatgacgagttaacgggtgcagcacaccaacatggcacatgtatacatatgtaacaaacctgcacgttgtgcacatgtaccctaaaacttagagtataataataaaaaaaaattctgccaactgttgtacatgaaagaaagatgctactatgcagctcaagagttaatctaaagaggaaacccagggctgctattatccactgttaccttctctctgttaaaaaaaaaaaaaaaaaaaaaaaaaaaaaaaaaaaaaaaacttaaaaataagcaaaagcttgttacagtactaaatgtgtcacattactgtttaaattcatcagagacagatggctaatttgactaaaccaacctttgtttacactggaactgatccattgatcctgtgcaaaagaattgtggtttaaacttccccctacttcagctaccacattaattccagggttcactgcatttcaaaagaacaagattaggatttccacatattccttatgaattaaagcaactggatgagttcatagtaataaatatttaggaaccagacttcccaaggacaacataatgaacaataaccatgtacagcacaggtgggcagttttataccttaatgtattatttatatgataaggaaaaatactgctaaatgcaaagtaattctaccagcactgatgtttaagacaatacagattcagataaatagaacctctatgtttttccatttgcaatttaaactataattgctagactcttttaagtcctaattatttaaaagaagcagtagttaaacaaatgtatgatgtttcgaatctgtgctagcacgttgtaaccatatgcaaatatgtgccctggatatatatggcttagtgataaaataaaattgagagcttttcctgccccaatattttattaaagtatgactaaataattgacatgagctttcaaatttgtgaattatttttttttctacaattaggagaatctggtcagtgcataatttcatgagtgttaagtaagcatctaaaaagtcgacttcattattcaactaccaggtgattcccagtaaattatagttctggaacaataatgggtaagtcaaagtgtttcagtctataacaagactaagcatctttagaaattatcttttgtgttgagatttcgtgttatatacaaagataacaacacaacaactcttgattgggtggtccttaaaggcagcgttttctcacactcaaaacatctctaactctccctatcagatgtacttgaccttcctattacatttactctgtcacttccatcataagtcttaccacatgatgtgattgtgtgtgtatatgtttctttctttttctctctctctcccactgaactctaagatatttgaaaggtaaaaatccccttgtctactctaccctatgtgattagcatagcaattatacagcacgtatctgggtgccagcacttaattagtgatacacacgtatgcatacacatattctctctctcccatatatattatataaatcagggctcattatatatctcaggggtaacggagtacctaagaaggaacaacttgggtaagtgggagacctccccaagtctaggattcagatcactggagaaggtatggctgcagcccggtagatagtggagaagtctgctgaattgtccagaccagaattgatccacatttgtctagcctagtggaaacttccctcagggtacaggctggtgagggctggttggtgcacacacaaatggagtcagagcattggagcttgctcaccagcagagcagcaggagaccaactgtacataggagaccatctataaaccagggacagccacagcaagaacctggtgccccggactgcatgcactgggtgtgtggctaaagcagagtgccaccggatgttcccatgcaggcattcttgcaatagtagcaaaaagcaaaaccaaatcacaccagaaccaggaaaagaaacccttttccttctgcaatgttgctttagtgccctctactgacaaagcttaattttaagatgtacaaaggagaaacacttggagggtctaactccattacagcggagcagataatgaagggtggctatggagctgacaggcagtgaatagatacccagaacatcactcaacaatcaaaagaggaatttgtactcaacaagcacccattttaagacctgatcatttctattctgttatctttgggacctacctgcatcctttcttccaaacaatcgatcacagtgaactatacagattgtttaaagagcacagtttacccttacttgtatctgagagaagtgggggatagttatataaggtaaatcatatccagcttcatggtgtagcttagagtagatttggcataaactcactttctttacagcctaatatttacagttatatatggttcataccacagtcagtgaaagctgaagtagtagcagtcacctgtaaggcgttccaaatctggacccttgttacttctcccactggttcattccatgctcaccacactggcctcgtcaaggttcctagaacacactagcaaatccattcagggcatctgcccttggttttgccctctgctcagaactcttttccttaaaagagccacagggatcatccactcattttctttttcttttttttttgagacggagtctcgctgccgcccaggctggagtgcggtggcacgatctcggctcactgcaggctccgccccccggggttcacgccattcatctgcctcagcctcccgagtagctgggactacaggcgcccgccacctcgcccggctaattttttgtatttttggtagagacggggtttcaccgtgttagccaggatcgtctcgatctcctgacctcgtgatccgcccgcctcggcctcccaaagtgctgggattacaggcgtgggccaccgtgcccggcccatccacttattttaaagtgactcaagtggtacttccacagtaagacttttcctaactatcctatttaaaatagcaagccactgatacttcctgtcccctttcctgctttttctcttaagcatttatcaccaacacacacactccgtccctcccctattttttctttctgtgtgtatacgtgtgtgtgtttgtatatgtatatgtatatgtgtgtgtgtgtgtgtgtgtatatatatatatgtatatatatacacacacacatagagagagagacaggatcttgctctttcactcaggctggagttcagtgtgtgctcatagctcactgtaacctcaaactcctgaggtcaagcaatcctcctgcctcagccttccaagctaggaccacaggtatgcacccccatgcctggctaattaaaaacatgtatttttttagatacagggtctcactatgtagtgcaggttggtcttgaactcctgatctcaagtaatcctcccagcttgacctcccaaagtgcaaggattacaggtatgaactactacacccaaccacactatatattttatttgattggtaattatctgccatgcacattaaaacacaatcaccatgaaggaatttttttctggtttcttcactatattatattttatgtcctagattactgcctgatcagtaaatacatgtcaaatgactcatcctacaatctaagattagattattgcttgctccttacttcagatttcaaaaaattcaaatccacctagataccaaggcagacaaatgactgaagcaggctggggtgagtccctgagtgaagtgatgaatgtgtgtctgaaaagagtaattatttatgatctctactgaaaattgtgaccatataggaataagaatcatgtattgtcattttcagacttttcaaaagtggaataaaatgagcactttggggtataatctagtctgtaaatgtaggcactaattcaatttgagaacaagaagaatccaaaaataaaaccaaaacactttgcaagacaaacgaaatatgtccagaggcagaaagcagtcacagcagttaggaggccacataattttcccatgcttggggtatattaatttaattcctcgtttggtttctaaatttaccctttctgtactgatgctcaaactcttaatgttgcagttctctctcttacccataagctcttgtccccataaagacatcactgtctcttccctttttcctctttacattctctattctttcagccttttctgccagtagcccacacatagtaaattttcagaaggaacatctgctttggaatcagaaaaaaagtggggaggggacagttgaattatagttttacctcttaatcgctctgagagcttgaagaaatgtcttcatctacaatctctaattttcttacagtgtttgagttcccctggaaaccactccattttatcctcttcttaagccttgcaatcacttcccaatactgttcttaggttgtcctccagggctctggctgctcctcccctgagcagcctgaatctgtcttctgctttatagggagaatcacacaaggctcctttgtcttcttcggaaagtaaaatactggtgctgtcactcattttaccacatactgttctggattactgaactgctctctcaacgcattatcatctactttccttacttcgtctaacacaaaagggaaagaagaagaaactgactaatatagagacacagagagagaaagagttaggaaaagagaaagacacaaagataggaaaaccatgaaggaggaggataaggaataagaaacaattattattttgttacgaattatccctcattcaaggcaaaagaatggatgatgtagccttaaagcataatcttaaagcaccacttgtgttccatgattctgcgactacatggtcataataaataattaagattgtattttatagggagccaaaatatttattttttgaaaagcacatgtttctccttaggatattctactcacaatatcttctgttattatgcctttaacagacatttaaaaactcatctttatttctgaaaagatttgtatttagacaatttcctgtgagttttgtaaaaacctctgagaagcaattcgatgaatcggttggtacacaatataagtcagaggttgattatgattagtgtagttgatgctttttcagtttttatttaattttagtgatatttatactcttactggtaaattcagagtcaagactgttactatatcctttacactctagtatagtttaaagagagacagtattttaagtcattagtaggttgaagacataataatatcatttaaaaattgctatgtacctacaagtcaactggagtaaaaataaaccagttaaatcagattttaaaaaaattttgacaaaacaattctaaggtgctattataaaaatgctactttatatacattttagtattgttttattttaattaacaagcaataattgcttcttatatttggcattaactaatttgtggatattgacaactggataatacaaagatgtgtcagacactgtgttgaattagaaaatagatgtataggctgggtgcactggctcacacctgtagttccaacacttcaggaggccaagctaggcaaattgcttgagcccaagactttgagaccttcctgagaaacatggcaaaaacctgtctttacaaaaaaatagaaaaattagccaggcatggtggtgcacatctgtagtcccagctacttgggagctgaggtggggcaatcacttgagcctgggaggtcgaagctgctgtaagccatgattgcaccactgcactccagcctaggtaacacagtaagaccctgtcccagcgacaacagcagagaaaatagatctataaaagtattttatcttttaggttatagagtaatgcacgcactctaaaaaaacaaaaagaatgggaagtagaaaaatatttaaaaaatgcagaaaataataattgcaattatgaaagtgtgacaaacaacatcaggaacggagttcactgtctcatggattattataatttgccttattgtcttaagatgtacaagcagaaagtaaacactaaccttgaaataaggagatggctggttaaatcgttgacacttcagtataaaagagtttaggacataagcatgatccaaagcaatgaactgaatataacttctgagcagatgacaccatcaattttctagtttttccacatggttaataagttaatgacccttgttcttgccacttcaaatgaatatactcagataattcaaaaatatcttgtgttcactcatgcaccctgctagaggtatagtcataaatcatctaatctagtcaccagacttcataaaaatctataaatcatcaagggagatgttttgaaagatgctatctaagagattaagcactaaaatatcatttggcaaagtgaaaactacagagcattagtccagtgagctttctaagtataaagaagagcaggggtcggtttcttaaccttctctgccagagtccagagtcccaaaatatgtaacatagaaaggctttgagaacatgtattgcaaaaaacctgattaactttgtttaatccagtgtctttccattatatttactaggaaacatttagccaaacttctttggtcctcctcaggcatatcttgaagctttgagaacgggtcttataaagttctaatactaaatatagtcaaaagaattaaagataatgtccacacatttgaaatataaagactatagaaagtatgtcagagactaaattttaagattaatatcaccagtgagaaaataactgttattaaaagtcaaattgtgttcatgcctaaccagtcatgagactacgtgtgtaagctccctgatttttaaaaaaaccattagcaggttaaagtgcattttactaacttgctttcctaaggtaaaatatacaattttcctatttaaaacttgtagttatgggctaacaactataataaaatatatgcttcctaaattgcatatttttttaattgccaggaaagctcaatgtgaggtaattgttgcctcttcaaatccaattctgaatgaatgggtggatgggatatgtcaatcatgtgtctgccaagcctaatactcccctctccagcaaagatgcttcctcgtaagatagtgctatgctgtttgtttttttgtgtgtgtttgctttgttgttaatgctattggttggtttattttttgtacagagggtagtcactgatgggtccagaggagtacactgaataccaggtcaactggttaatgacctgtgaagtgctgggctgtgaggactctgtcttcccacaagaggtgaggttaattagcaaagccaatcacattgtttctcccatccagtctgtactagataatacaaagaagactgtctaatgggatcaaacctgtagataccatgacagtaatattacagggccaatatgaaatagcttattcccagaaccctttagatcaccaaggatggctgcagtttcagactggatttatttttaaaagtaaaacaatcttttctaaatttaatctaatttactaacagaatgataccaaggtaagtgagtataaaattattatctaaattctgtgccaaccaaaattgattttaattttttaagaaagaagaatcattttcattattcaactatgcaacaccaagttcaatatttaaatgaaaaatgctggccttctattagtattgtgaaaatctgtcaggttctgtgacaaatgagtttcatatccatgaattaatctgaagtcactgttggctgtgtttaatacttgtgcaaaaaaagagaacaaaataggaaggctgatgccactaaaagctgatgtctaaatcctaaatgcatttaagtgtccatatttaatggttgagaagcagtttaaattgcacaacataaaatccatcaacacacactttcactaaagaggaaatctccattttgtggtcagatagactcaatatttggtttgaaaacatctcatgtttctatagatcacaaaagattagaaagaggggcagggatcatgtgagagaggtagaatacactttatttctcaaaaaagaacatgttcatgatttgatatacattataaagaagaatgaaagctatagattaaaggtctgcacataccaaaagcaaaggaaaactatgcagggttctacttataatgttttatttacacaggtgactttcttccaacaaagctttattccctaaaacacatttcaactctgtggtttcaatcaatgacatttaagaaatcgtcatggtcaaaggaaaaaagaagctgcttggattctaacatcaagtatttaataatgataataagaaaaaaaaacagcagcagtctcatgtacagtggtgggctacaaaaagaaatcaaggagatagtgtgggggcgtgaaagcaatgcccttcaagtgcatctgatcaatttaaaaatagtgtttattgagatgcctggctggaattaatgtagcccactttatgaacaggttgtattttaagtgttcatctcagtatgcagtgctgtgctaagcacttttgggaaacatttagatgctttaagcagaatttctgccttttaaatgactggtttaatggtggaatggagaaaaaagtactgtatttaggagaaaaacaaaactattatgccaagtagtatattggtatgctaaaataaatccaaacataattttatgataattcagaagaagagaagttacagatggggagaaaaatactttatatagaagcttcattttaacatgaacttggaaaacatgatttaagcagaatgatatagcttaacaggcatgagaatctagtaaggataggaaatagagactaataagatacagtgtgagagcagcatgtaactaggtatgctgcgaagaaaggagtcctgctggaaaacactcaagggggtcaggtggttgctctggggaaagattagaagacacagttattaatcaactaataatgtggactaattttgtgtaatatccacacacatacaggtatatgtttacctacagaatctactcatcatagtattattgaagcaggctacaatatttactgaatattgaatatgaagagaaccatcatatttctatgggaaaacaaattcaaggactgtatttggaccatcaggaagtaattccatacaaatgtagaagttttgctttgccactaactctatccaaagaacatgagaaatggaaaggctccaaaatgagacacacaggaaaatccctttggttttgaccagggatctggccatcaaagaagggttgtgggagctccagaaacaggggctgagtgtctgggatttcaaattaatttaaaaccttgagaatgtttcttggtctctctagctcctgggttattcccttttttaccttcagtggatctccagaaagtcagggagttaaatcttgttcactttagagcctgatgcctagaacagtacctgattcattttaggcacacagtaaatggaatgaattaatgttaaagctgtcagtaacttattttaaccaaggttatttgtcctccatgattcacaaaggaacaaaacaagttgttttttaaaaaaaattatccccagtgtatattttcctgaagcatgttatttaggcccattcagtttttaatgagggtgtctcacatgaattaccaaaaggaaatctagactaaaacagctctactttagtcctaacctaattttttcattattgataagacagtgacagcacaacaagattgaattaagactcttctatacatgaaagaaagactgcatccagtatatacagaagagggccagggcaacaataaaaggtaatgggcagaattgcagtcatcagttgccacatgcattcattacaggctttgaaacctttgaacactagccccttggtttttcatccttgcacctctattttgtatcactgttggtgctcaacagaatcaaaaactgaaggggagatcctaagaacatgatttctccaacttcctcatcttcctgttttcctttcctaggttttatgtgtttccatccagggtttggtctgaacggaatacaaagttgggaggacaggagttgggaatcagtcatgccaagtaagggtgacagtcagagaaactggctgcagctaagagagaaatagcatttttcacagctacttgacattcccaggtttgcccaggtaaaagcataaaagttgcttactgctttataaacttctttcaaagcctaaaatatgttaaacacagagattctcaaataagaagtcttggatttaaaatctggctctgtgcttactcttggtatgaccacgaacaagttagttaaattctataactgtaaattctgtaaagcatcaattgagcatttgtaaatgcataaaaattatatccctaggtttagatgtggttgttattattaaatacgattaatctaaaatcttaaccatctagttaaaattaataacaacttaatttccatgcaaaaactttgatccaatataactatgttcgcccctcccctgctttctgctattattgtcacacaaattacatccttatatatgataaatccaccaacccaatttctaaaactatactgttgccttttaaatcagataaaaaagttacaaactaaaatatatttgtactctcttttacatgcatgtgtagagtaacttttacctgcgttctttattacttcatgtggtctcaggttactgtctagagctctctcatttagtttattacatagtttcctttagtttggtgaacatatgtaaaataactaacttgaagtctttctcaattgaacccatcatctgaacttcctcaagaatagtttgttttgactttttttttaaacctctgtatgagcattgctttcctgtttcttgcgactttttttctttttttttggttgaaaacgggacaatttaagaaacagattcctccatccccatagtttgttgttgctgctgtttgcttaatgactaatttttttgcttaaggactaatccagaaagtctatatactttgttacatgcatccatagaagtctctgcttagttagcatatgagcagcaaatgatgagacagagatttcttaaatgcattgaaccagtaagtttcttagcttttgaataggagctctctgtgtgtattggaggtgtgttttcaaaattctaacatttaaaaactgtcttagacttcacttcttgtttgtgcaaagcctcgagatcagtcaagggtgagaaattaaggtcttctgaattcctttctgggcatgcacacaaccctgaatgtggccagcgtgcacatgcctgcggccttctagatctccagaagtatggcggacattatcatatctcctatggtcttctctttccttaaattgtcctttaaagttgtagtcagtctattgtttggcccaaatggtatcactacttcagacagcaacaatgttcacaactgcagctgaggttatttattttttttcaacaaactcctgagtgataggcctttcctcactgaatgagctctacgtgaggtaaaaaaacatagaacttgtgaatggggctttttcagggatctgccagacaggtcaaatagtgacaaatcagtgaggatggagttttttgaggggttccaaatctgttgtctctcaccaatggatgataccctgctggtttccatagctactgctttcaggaagctgctggttggtaagggagagtgggatgaacatagagaaagcaaaaaaatgccacaaagttctttgctctttttgaaattcaatgatttttctcaaataaatactctggattgttgcagctttttgagttacttctagaattctaaaaaagttcatgttgataggtttcaccagtattatctctctctctctctctctctctctctctgaagaacagttttttttggaggtcctttttccaccattccagtgtggttctctcatgatggcactttactacccagagtcaatggtttctcttagtcttcatcattctttactatcagacttttcctttggctcttatactcttatattttcaatatgcaaagcatcagcaattctacctattccttggctttgctgactattatgaacaaaattaagttccttccaaaattcataggttggacccctaatattcaatgtgactgtatttggagatatggcctataagaatgtaattgaggttaaatgaggtaataagggtgaagagccctgatctgataggactggttgtccttataagcagagacaccaaagagcactcttttgctctcatactgccaaccctccacatatgcatgcattaaggaaaggccccatgagcacacagcaagaaggtggctgtctataagccaagaagagagccctcaccagaaagcgactatgctgcaccctgatctgcgacttctggcctccagaactgtgagacaataattttgctgttgtttaagccatttaatctgtggtattttgttatggcagcccaagctgacaaacacagctactatccccaaatctccttctcaactcctaagctcacttgtgaattgttagcatactttaaaaaaacttcctgctgggtattgcttcattgatgttcttttgtcctcatgatttcaacaagttccaaaaagaactcataactaaatcagtacccctgcccccacgtctttcctaatttgagctaatgattcacactcccaggtactcaggttcatatactctagtaaagttaattttataaaatgtctttcaaagatatttagtgacaatttctaaactagatatttaaggctaaatagcattttattttctttactagtgacttctttgtgaataaaatgattataatcccactgtggctgtggctataggatacagtacaatatgtttggcaaaccacttcaatatgttaatattccttcacttatttcggaatcaacagtatcaagcatataaaagccatactctataaatataaaaccactatcacagacactgatattgcagagaatgtgtatgtgacactaaatgagtctacagtactgttgaacaacctatcagtagagtagatgatttggtgaagaaaatcacagaaattcttagatgttatgtaagttaatacatgattcattcactgttttttttttcacttttaaattcactatcctgaaaaaaagaaaagaccaaattcttgtctcactatatgagactgcatctttgtaaacactgcccctgcatttaataataaagcagaattcctgaaattatatgaatattgccagatgggacaatggttttgcttctgttaccagttataatcagttctgtttaggggaatcttatttttgataaccgggtaacacacaggaaaacactcccttgtttaatttaaagagcagaggttggcccagcattcacactgagagtggcagagtccaagtcaagttgcggccaccaggctgaattgatctctatggaacatgtaggaggcaaaccaacctagcctttttaaagcacaaatagagtcttattaatttacacttttgaagggcattcataaaggtgaaagtacttattaaaatgagaaagatatgtgtaatattaatgtattagtatatatgtaaatattaagttaaaatacaaatcaactttaataattgtttaatataattaagaggataatattgtttttgattaaaaaaatattttgaaatgcatagctctaaattctgcctccagactgcttaggtaggtggttttcctttagccttttatcacagaccagcctttaacttattagggtgatttctgatgaccagctcagaaataactgaagcctgttctttgcctggggataaacacttttgctttctatgcttttctgttctatcaaaacatatctactgcatgcagctgcacttcaggctaaatatcatgatgttctcacttcttcacaccatacctaaatacaaacatattgttcttctgggtttccatgaaacaccctgacattttatttaaataaaggatgtccatgccatcctacattaataatttcaacctttcccccaatttgatctcttattaatcactgatagacatctctgcattatcagacattttatatatcaatcctgcatctcccaagaattcacacaaaataaaaagcaatagaaatattaatagatgcaaagccaggtctcccaagaccttagtattacatgtggatatctattccttgacatattggaacacaaaacaaacaagttcaaaagaatttgtagccatatttaagaattttttttttcatgtaatacttacgaggtacaaatcaattcccatttgtcctttcccggtagatcttatctttattatttttggagcggtaagaggaaattaatatatgtgaaagaggaaagtgaaaaacagtaggagaaataacatcaacaatagtatttacaaaaggactccagttatttttctgttttccagcaagaaaggatacgttatttctgaaagatttatgatcatttggggcttattttaaaccagactaaaaataatatttcaagatatcaacttttctagttttctttcctcctcccttgccatttcatattaccctgcttttatctcaattcagtgaccctatatattgtagttctcccaggattagcccttgaccttcatttctactgtataagcactcactctgccagagatcttacctaggtccacagacttaaataccacctttgactgtcgtatgtatccctccagcctcaagctttcttctgaattccagacctgactatccaactgtctactcaatgactccacctggatattaaatgggcatttccaaactagtatgtccaaaactggctttgagctaaagctcttccacagtttaaccctccttaggaaattgcaactatgtcctttccattgttcaggccaaaaatattgaggaagttcctgaatactttctcttatactacagtatccaatctttcagcaaatcctatttattataatgtcaaaatacagttagaatctgatcacacctcataacttccaccacttttataatggtccaaaccatcaccatcttttcacccctgaactacaacagcctcctaactggtctttttctttctctctgttaaaaaaaaaatgtaagagaaaaagtcagatcatgtcactcctttggtaaaaacccaccaatggctttttaaaaaattttaaattcaaagtaatagtcaaattttttctttcttactaaaagcacaataacatctcttactacccctaatcttgccttttttcagtctccatgtgactcctttgtatacctcaaacacactaagcaagctcttgctacatcatctttgtacttacgttccttccccatggattgcttttccctcagctatctgctggctggttccctgacttcgttcagatatttactcaaatattaccctctcaggaagactttcactcatcaacctattttaaaaggcagccctaacctaaggcaggcctaacctgaggcaggtctaacctgaggcggccctaacctgaggcggccctaacctgaggcggccctaacctctgctttggcactctgtgccacctcgttgatttattttatctatacatttattatcatctgatgtactgcatatttattggcttctattatcattatctaactctccccgctagaatgtgaactttctgagggcaaagaattttgtgtactttttcactgcttctggcaacaagaaaagtgttcggcacagaatagatgtctaaaaaacattataactatggctatgacatgtgatgtctagaaatcaactagtatattatggtcagttccttggaactccttctaggcattcaacaatttctattattatgtaacatgaatagataattaacttgttaagtaatatctgaaatgaattatatctttattatttatttaatgtttaaatagctaattttttcaaataatagtgtggacatttgaaagcttttggaaaacactaaaaggtaaaagaaaatgtcacctctattttaatgttactgacattttgaaatatttattcctgatattttcctacatatacattgcatacatacaagtatgtgtatacatatgtgtgtgactgtaatgtatttatatatgtgtgtatgtgtatatatacttataaaaacaatactataggatatagttcataatagaaaaaatatggcataaaagtatatatgttgtcttatattttattgcatctctgaaacttgccaatattttgcacacgttaggtgttcaataaatatttatcagtaatgaagataatatctaactacctatactttcctaatagctaagtcacaggtgaaatgaaatgaagcattctgtttatttttcaggtgggaaaacagcagttctatgtattttcgtctgggttttgttgttttaatccttcctcctttccccgtccaccccccgttatcatttaagaaatccattttctttcaatgaatgttcagttgctgaaatcactctccattatggaagagcatttgattctctggatgcctatgtcctggattttggcgtgggagttccattagaggtgatattgatttgggctgtgttcctttctctgagctgcagtctgcatttgccatctgactgtctctgatgatgagtatatcacatacctagtagtttgtctctgttttattttccagaaaagcaaatatatggatatgaattttgctgctaggaaaaataactttgaagatattttttgaaatgcatgtttgttcgttttctcttatgtttttgtgtgatgcactcaaataatggcaaaaccttgaaaaattatcttgtcttcagagactaccctgacaacataagaactaactcattctggatgaatgaatatctggtggataggaatactaaacagcttagaagttggtaataattcttgggaaaatttccaaagaacagggtaattttattactagtacattttttaataaatctgtttccctaattgtattcatgataaataatttttaatgttacgtgttttgtttgaataatgagttgatccaatttcctaattttaatgacaaaaaatagttttccatttcacctaagagtctctggttgagactggactctttctattctaatccactacctctaaactttggttacattcaaatacagagtcttagaagacttagaatacagagtctttacactttggctttagcaatcacttccttcaaatgctttcttttatcagtgtggaaactgagaacaaaagttattcaccactagctgttatggacctatctgacctctcttttccttattcccatatttctcttttctaatttttcccagtggagttacagaataaggcaaagtccagacaagcaaataagttcaactaagccaaaatgacattctgaatcctgagttgtggcctataaacgttatgggaaaggagattattagaacagaatggctacctttgtcaaagtacaagctggcaacaagagatacaattcctattgtgtgtgttctcactgaccaaaaaaaaagcattaccaatgctttctctggctttcttagtcaagttgaaggcaaatatctctccaatatttttaaccaaggtcgtacaactatctagcagtagtactagaattagaactcagaaactttgattttcattgctttatattcaacaatgctgcaactttctcagtcactggagtctcattcttataagaactgagagtgtgtggctgtggagagtttgtaagttgtgtataagagagactgatgaaactggacatagaatggaactaagactatacactcctgagtctgggaaagacacagcattttattctgaccaatatgtgtgctggggatatttgatgatgccatactcagtgttgtcattaagttgccatgtatgttcaacttaaagtcataatcatcccatatcctcagaaggaagactcaagaggcaggaatgtaagtaacaatccaccacaatcatatttttaagagttaaaaatatttacactgcaagagacattttcccagaaaaatgaagataagaaaatagagcaatagtgaatcagcaaaaattagtcactagatcttctccacctcccacaattaaataattaagttgacaaaaactccactagatttcatttaaactgctccttctatcttcagtctcttctatccatctcgaccctttggtaattattttttccacaaacacaactctatcatttaccttcctttccatgtaagccctgcttgtaaaccctaagaaagctcctccatccccctagccatcagtgagagcaaactggttcttcaaacaggctgcaaacaaacaaaattgttgcttgggctttaaagtttcctttgcttaaaagttttgacatttctgaatttagggcctatcttgagctaggttcttaacattcactcttactgagtgactcccttccagacacctgacccccagttcttttgctcaagcttttctggctatattcgggtgggtagcttcactcaaatttcccagcatcagaccttaggttgtgcctggcttctaagttggttctgtcattgcaagtgacacatagcacagcttataggactctgttgcccacttaatcaaacacaaactccagacagtgacatttaagactccacaatctgatctatcccaactatcagaacctgtaattaattgcctcttcaattctctccagacatctgcaaaagtcattccaaatcctgcccaatacattcccactcctgatcctttcttcacacaatcccctgggtcaggaatgatcttctcagaaattcatctgcacttgttagaattctatgtattttccaaggttgcattttaaagacaatttttctggattacagccagaagtaaactcagcttccaaaatttcatcaccttgagcagaacaacagagaaactagattatgtaagtttggatccctaatacaccagctggaacagcctggtcaagttaagtttctttaacctttgcatcccagtctgcagaatggagaaaataatagttgcaacttcatacagttattgtaaaattatctgagtttaaaatgaaaagtgcctggcatataatacaagctcagtaaatagttgctattatagctctatggcacttttactaaaataaaactaaaacgtttaattggtacagttcctcgctccttctgtaagcttttctgggatgtttagtatctttatgtggtgtttgattatttgctaaaatttctgcattaaaaaatttaatgcacacaatagctctgtaatcgaggatttctccccagtttgctaataaagaaaagactgagagacaaagtgattgatccaaagacacatgtatccagtgaatgccacactctctgacactagcctcagcaagctccacaatggcatagcttctttgggagggaacaaccatgcatttggaatctttccattccccagggcgcatagttcattttatttttgtagaaagtaggtacataatacacatttcacaaattattattcaggagtaaaattgaactatccccagaatgactgtgtttcctggactaatttaaccaaggaagaaaaatggcactataagggaggcaagatttacaaatctaatggaagtaaaatttacagaactttgaggatggacacgttttagtattcaaatgattctaaagatcatgataaaatcaggaacatgtcagaaattggtgtgtcattttatctctgggaaaatttaagggtgtaatttgcaattataaaataaataggtttggttctacagttccttaggtctacagaacatcccagtagtctaggctgacaaatcaattgtgagaaaagaccctttcatgacaggtctttaagaaccagagaaagtgagagatttccaacatctggtaggaaagggaggggaggcagatacaatgttaaaaagcttgagtcaacattcaacagttcaaaatggagaaaaattttcacaaatgttatattgcatcaaactaaatccatttctcaatcaaaaaccttttactaagtacctgctatatggcatcatgttctacgtcaggcactatagatataatgtgaataaaagatttgttaggaatagtatccttagccctatgtctataacttgtattataaatgtatatgattgacttatgagtcatctttaacaaacatttgatttggcctccctttattaatttgtacattcaaaactcacctctccacattgttatataaaagagcttcaaacagatccataagatgggtaaatagatttttggattatccacatttgtcattataaatacttcacttatcttacatagttgagatatcagtgtgaatagtctactttctaataaatatgagtcatcatgactttaaaaagtagaatcctgtggaatagtcgacagtgaaaatgaaggcaagtggggagtgtggcaggaagaaggtatgactgacaccataatgccagagcacctagaaaaaaagactatggttgggtgaagactctattcccatctatgcctatggatacaaatgtaatgttttctaaaaataacattactcttcaaacagtatccaatcctggtttaaaataacctgtgatagggttgggcaggggtaagaaaagaattagtccactttgatatcctggagaaattttaggtctaggctaatataatgctagttttgattttaacccagcatctggaggaagttatattttcaatataaaagtaatgcttactgaaaatgactgactcactctgcagttttctgggggagtacattatttgtacctcaacaaatgaagaacaacagtcaagtttccaaaaataataagtaaacatctctggatttcagaaataaataagtgatgtaaattgacaaaataaaacaggcttttaagtagtggatttcataattagcctctgctttcagggagagcacacgtgcacatcctctttgtccatcttgacaagttttctgccttttatgaaataactgtttcctgccagtcaatgaaaacatgcttatcctttttataagtgcatataaatttaaccctttcaccaagggcagagaagaaatagatattaaataatgacaattataataaaatcttgggggtgtatttatgatgagaaatgattatttttaacaatagagcttctcacagaatgctgattagataattttctatcattcctgtttgatttttttaaagaagtaaaataggcagctataatctgtaaattttatattttctttaaaatttgaatatatacatacgatacacatatgattctgcaaaagagctttatattaaattgtttgagattttatacaggagtctcaaataataaagtactttaaaacattaatcaataagaccttagatgaaaagttgagatgaatttttaatctttttttaaacttttaggttcaagggtacacgtgcagatttattacataggtaaattgcgtgttgcaagggtttggtgtatagattattttttcacccaggtaataagcatagtacacggcagacagtttttcaatcttcaccctcctccctccctctaccatcaagtaggtcccagtagtctgttgttcccttctttgtgtccatatatacttgatgtttagctgtggtttataagagcaagtggtatttggttttctgttgctgtgttagttcacttaggataatggcttccagctccatccatgttcctcctgcaaagcgcaaaggacatgatcttgttcttttttatggctattctatggtgtatatgcatcacattttctttatccattctactattcatgggcatttgggttaatctcgtgtctttgctactgtgaatggtgctgtgatgaacatatgagtacaagtttttttttcttttctttttttttttttttagacaaagtctcactctgtcgcccaggctggagtgcaatggcacgatcttggctcactgcaacccccgcctcccgggttcaagcaattctcctacctcagcctcccgagtagctaggattacaggtgcccaccaccacgcccagctaatttttgtatttttagcagagacgaagtttcaccatgttggtcaggctggtctcaaactcctgacctcaggtgatccacccgcctaggcctcccaaagtgctgggattacaggcatgagccaccatgcccagccaagtatttttatggtggaatgatttatattcctttgggaatatatgcagtaatgggattgctgggtcaaatggcacgtctaagttctttgaaaaatcgcaacattgttttccacaatggctgaactaatttacacttctgccaacagtgaataagtgttcccttttctctgcaacctcactggcatctgttatcttaggattttttttttttttagacggagtctcgttctgtcgcccagcctggagtgcagtggtgctatctcgggtcactgcaagctccacctcccgggttcacgccattctcctgcgtcagccttccgagtagctgggactacaggcgcccgccaccacgcccgactaattttttttttgcatttttagtagaaacggggtttcaccgtgttagccaggatggtctcgacctcctgacctcgtgatctgcccgcctcggcctcccaaagtgctgggattacaggcgttagccaccgcgcccagcctattttaggattttttaataataggctttctgactgttgtgaggtggtatctcattgtggttttgatttgcatttctcttataattagtgatattgagcatttttcatgtttcttggtcatgtttatgtcttcttttgaaaagtgtctgttcatgtccttggcccgctttttaatgtggttgtttgttttttgcttgtaaatttgctttgtaaagttgcttatagattctggatattagacctttgtcaggtgcacagtttgcaaatatttttctcttattctgtaggctgtttactctgttgatagtttcttttgctgtgcagaagctctttagtttaattagatcctagttgtcaatttttgtttttgttgaaattgcttttggcatcttcatcatgaaatctttgccaggtcctatatcctaggtaatcctccaaggttttcacagttttaggttttacatttaagttgttagtacatcttgaattgattttttatatatggggtaaggaaggggttcagtttcaatcttctgcatttggctagccaattatcccagcatcatttattgaatacagaatttttctccattgcttgtttttgtcaattttgttgaagatttgatggttataggtgtgcagcattatttctgggccctctattctgttccattgttctgcatgtctgattctgtattgtgccacgctattttggttactttggccctatagtatagtttgaaataggctagcatgatacctctatctttgtttttttttttgttttgttttgtttttttgtttgtttgtttttttttgcttaggattgccttaactaatctggctcttttttgtttccatatcaattttaaaatagtttgttctagttttgtgaagaatgtcattggtagttttacagaaatagcattgaatctgtaaattactttgggcagcatagccattttaacgatattgaatcttcccatccatgagcatggaatgttttcctaattgttcatatcgctgattcctttcagcagtgttttgtaattgtcattatagagatccctcacctccccggttaactgtattcttagttattttattctttttctaagttttgtgagtgggattacattcttgatttggctcccagcttgcacgttgttggtgtatgggaatgctactgatttatgtacattgattttgtcctgaaactttgctgaagttgtttatccagtcaaggagcttttgggcagagaccatggggttttctaggtgttgaatcatatagtctgcaaacaggaatagtttgacttcctctcttcctattttgatgccttttgtttctttaccttgcttgattgcactgtccaggacttgcagtactatgttgaacaggagtggtgagggaggacatccttgtcttgttccagttttgaaggggaatatttctagcttttgcccatttagcatgatgttagctgtaaatctgtcatagatggctcttattattttaaagtatattccttcaatgcctagtttgttgagggtttttaacatgaggagatgttgaaatttaccaaaaaccttttccacatctattaagatgatcatgtgatttttgtttttagttctgtctacaggataaatcccatttactgatttgcaaatattgaaccaactttgcatcccacggataaagtctacttcatcatggtagattaacttcttcatgtgttgctggattcagtttggtagtattttgttgagggttttggcatctaagttcttcaaggatagcagcctgaagttgtatttttttgttgttgtgtctgccaggttttggtatcagcatggtgctggcctcatagagtgagttagggaggattccctccttctcaatgttttggaatagtttcagtaggaatggtactagatcttcttgatacagctggcagaatttggttgtaaatccatcttgtcctgggagtttgtttgtttgtttggttggttggcaggctttttattactgattcaatatcagaactcattattggtatccagggattctatttcttcctggttcagtcttggaaggttgtgtgtgtccaggaattcatcagtttcttctaggttttctagcttgtgtgcactgaggtgttcatcacagcctctgaggatttttgtatttctgggggattggtggtaatgtctcatgttttatttccgattacgtttagttgaatcttttttcctttattggtctagctagtgttctgtttatcttaattttctcaaaaagcaaagtcctgaatttgttgctttggtgtgggtttttgcatttcaatttccttcagttcaactttgattttggttgtttcttgtcttctgctagctttggggttggtttgctcttgtttctccaattcctccacttgtgatgttaggttgttaatttgagactctgctatctttttttggtgggagtttagtgctataaatgtccgtcttaacactgccttagctgtgtcccagtaatgctggtatattgtatcttatcgttgttctcattaattttaaagaatttcttgatctctgccttaatctcattatttactcaaaagtcattcaggagcaggctgttgaatttccatataatgttatggttttgagtcatttttttagtatcaatttctatttccattgcattgtggtctgaaagcatggttggtatgatttcatttttttaaaaaaaaatttctgaggattgcttgatgtctgattatgtgattaattttacaatatgtgttatgtgcagataagaggaatgtatattctgttgtttttgggtggagtgttctttagatgtctattaggtcaattttgtcaaatgtcaaattcaggccctgaatatttttgttagttttctgcctcaatgatctgtaatactgtcaatgggcatgctgcagtctcccactattattttgtagtgacctaagtatcttcataggtttctaagaacttgctttatgaatctgggtgctcctgtgttaggtgcatatatatttaggatggttagttaggtcttcctgttgaatttattcctttactattaagcaatgcccttcttcacctttaaaaaaatttttgttggtttaaagtctgttttgtctgaaattagaatagcaacccctgcttttttctgtttttttttttttttttttttttttttttttgcttggtagattttttttttccatctctttactttgagcctatgatgtcaccacacgtgagatgggtctcacataccactgaatcttgcttttttatccaacttgccattctgtgccttttaattgggccatttagcccctttaaattaaaagttaatatcgatatatacagatttgttcctgtcatcatgttgttagctggttatcatgcagacttgtttgtgtggttgctttatggtatcactggtttatgtactgtatgtgtttttgtagcagtgagtaatgttctttcccttccatgtttagcactcccctcaggatctcttgcaagacaattctagtggtattgaaatcctttagcacttgcttgtctgaaaagaatcttatttctctccacttatgaagcttagtttggctgtttgtgaaattattggttggaaactattttcttcaagaatgatgaatataggccctcatctcttttggcttgtaggttttctgctaaaaggtccactgttagcctgatggggttccctttgtaggtggctgccccttctctctagctgtctttaacattttttctttcactttgaccttggagaatctgatgactatatgtcttggggatggtcttttgtagtatttcacatgggttctctgcattttctgaatttgactgttgatgtattagtctgtttccatgctgctgacaaaggcatacctgaggctgggcaatttgctaaagaaagaggcttaatctacttatggttccacgaggctggggaagcctcacaatcatggtggaaggcaaggaagagcaggtcacgtctttcacagatggcagcaggcaaagagagccaagcaaaaggggtttctccttataaaaccctcaaatctcaggagaattattcactaccatgaaagcagtatggcagaaattgctcccatgatttaattatctcccaccaggtccctcccacatgtgagaattatggaagttcaattcaagatcagatttgggtggggacacagagccaaaccatatcagctggcgtctgtagtgaggaaattttcatgaacaatatactgaaatatgttgtccacattgcttgttttctctccctctctgtcggggatgtcaatgagtcacagatttggtctctttacatcatccaatatttctcagaggttttgttcattcttctttattctttattttttgtctcactgagttattgaggagagctggtcttcaagctctgagattctttcctcagcttggtggattttgctgttaatacctgtgattgtattttgaaattcttgttgagtttttcaactccatcagctcagtttggctctttcttaaaatggccacttttttttttctcatctcctgtatagttttattgtattctgtagaatccttggattgggtttcaactctttcctggatgttgattatctttgctcctatctgtattctgaattctgttttggttatttcagccatttcagcctagttaagaaccactgctctggggaagtagtgcagtcatttggaggtgagaagactctcttgctttttgagttgccagagttcttgtgctggttctttctcattgtgtgggctgatgttccttcaatctttcaagttgctgccttttggattgttgttgttattttgttttgttttgtttgcttttctatcttctttgatgtccttggcagtttgattgtggcataaggtaggtccagttgactggctttgtttcttgtaggtttttgagggccaaggttcagctcagtattattgggctgtgtactttaactttggggggctgttatcaggcccccagctttgttctctggctggaggttggaaacctgctgagctggaggggccgagtgagtccgcattcccaaaccgttggtcacaattctctgagggtggtgccagacaaagttctttgttgagtagtagcagcaggatctgacttccttgcttcttgtgccaccagttgtggccatacgacagagtgcatgctcattggatggggtgagattctggtgggtcctgggcaccagtctccataaggttgttggcagtggtggcataggcagccctgggggctgaatccactggggtccatgtgcacacattcatacccatggccgtgctggcatggggacagggcactggcaggtgtagggctggcaatttctgtccaggtgttcgtgccagcagctgtgacaatgtggggcagggaatgggggtgcggatgtccttgtgttcattcactctggcagcaatggtagtttggagtgggggtggtgttgctggtgtctgtgcatgtgtttgcgccagcaatggcagcatcgtgatgcagggcaggtggtgcactcacaacagcagcaatggcatggtgggtgcacatacatccacatgccagcagggaaggagaggcaaggtttgcctgcacatatgcacacaagcaaagtgatgggtgatgactgtggatgagtgtgtgccagtgaagtaacacgggcagctgtggtggaagaaggacatgtgtaggctggtgtgtgtcagcaagggctgctctactagagctctctgatggtaaggtatggtctgctagtacaggagctatgatgtatgcccttgaaaggcacctcaattgggcatccaaggctgtacagcaagcaggcacatccaggctgggatcccaggagaggtcagcagacagaagcatgctcaggtcagactggccctgtctcacaggcaagatcaccctggtctcttcaggtctgacagttcacttaaagctagagtatcccaggggagcaaggcaatcctaggagatgaatgtccctggatgtgctccctggcacatgttcccacattaaaccctctgggctgcacacatgctggagtcttgcacttgtcacttctctaagtagctcttcctgccagtttccctcaagtttccatgggggttggggagacttctcctgccagggttccagaggtctgtgcatgagcaggttgcaccatgcctgcttaacacactcattccccaggagtcactgggggccaggaactagtcctagtatgtggtagccccttgcagagttcccagcttcctccctcttcagcccagcatctgtgtcctccctctgtccactctcaatgccttccgtgtgcagatctgcttggagtatgctagtcttcctggtgtcccagttccttggtggtagactctcctccttgttgcatctagtcatccatcttcctttttttttttcttttttttgagagaaggttttgctctgttgccaagattgaaatgcagtggcgtgatcacagcacattgcagcctcaaactcctggaagtgatcttcctgcctcagcatcctgagtaaatcagactacaggcatgtgccactacgcccagctatctttttttaatttttgtagagatggggtctcactatattgcccaggttggaactcatgggctcaagtgatcctcccacctcagcctcccaaagtgctgggactataggcctgagtcatcatgcccagcccaataaagtattattttaaaatattttagaagatatccatccaaacatctatcatatgtaattatttgcaattcatgtttattatagaacctgtgacaaaaagtatctgtaatggaataagatggtaagctttacttatggcaagctaaaatgaggaacataacaactgaaggaaaaacacttatcatacattatcctagaaatgctacatgttgaatgacacactctagcaaccattcaacatttgcttgcccaaacaagcagcaatactgtttgtctagaaactaaatttcatctttctgagctcattccaactatgacagagaatgccttcatatgcaaaacacttgtaggtaaggtaaaattaagtcttccattatgagatccagtgtctacagcatttgtgggagggctgaacacatgctcttctggggtagctgctatcatctgcatttgcttgacccagaaaatgcctagacttccaattccacttccctaacacccctgtttcttattgggccagggaacctgatctaagagtgttccactaaactaaggccttaactctatgtatagtttttgtttattttgattttaacattcacctcatcaacaaaaagtacaaaattttatttgttgtacttccaggcatggctgaaattcactatgaattgtcagattgtctaaaacctcgtattcctctgcttgctggcatgttccaaacacctggatatgtttttggacgttctgggctactcccatgctagctcccaataagaatctagccttacaggtttcctgggctcactcccatgtgtccactaaatcccattttccttcttttcttcattagtcagtactgctggggccctaataatatggattatgttccagcttgcctgaattatgacacagcgaggttattaaagttagaagttttaaaatcacatgtggattttatggaactcatgctgtctatatagactaaagtcatcaaccaactgctgttctgggggattttactccagtaccgcaagtaagaatgttaaagctcttcagcatcccttattcctgtccacttaaagcattcatcagcagtcattcttttaatataacatataaaacttaatgaatcatacaaatataacaaaatgcagttattttggaattcattttttgacaagtacaactaaatactgaatatgactgcatggactacggattaataaccaatttttagcaaaaatacatcaccaagataaaagagcattttcttcacagtaaagagaaatttcaaatatgtctttagagaaggtggcatggatgatttacaccacttaaagtctgtttaactgatcatttattccaatttaaatttcatagatattgccccaaacactattaagcttatattttctaaggagaataaagttaaagagtatttaaataatttctgttaagaaatatttgtagattggtaaaattatctttctgccaatcgttatagtctataaaaaataatcctgttatattgtaaattgttgctggggtcagaatattttttaatgcagaatttttttcatgatcaacttttgatgacatttactttgctggctataaaacatgtacttccaatttttttttaagtttgcactgatgtttatgaagtaagcttctatttggagagtttttaactttcttttggtagggtaatttcttccctcacatcttactaaaacataaaattaatgtcttttttttttttaacagagtctcagtatgttgcccaggctggttttgaacttactatcacatttattgtcatttttgatataaaatcggctgattactgaaataaataatatatctaaccttgtggagttttttgtttttaatacctttatttgcttttcaaaataacactctctgtcagcaccataagacagggtgagaaaaaaacaaaacaaaattcaactctttgataatcagagatcttatataaaaactaaggttgaaactcacattaatactggattatgaaataatatgtgtttttagtgtccagggccaaaatctaataatcattctcctcattttaatccacaattttgttcatgcatcttccccacaactgcctccaggggatggatcttgagtactgctggcttgcaccagtgcatggcattaacatggcaactgcagttaatctggtccagtcaggttaaaaaaattatttacatttcgtgattggggaacagattttctgtctctcattgactatgaagaaaaacccaacacagtcccaggtcaagttctcagccatcttgcaagcacaatggaaaccagccaaaggaagaaactatacaccaaaaatggtagggcagtaagtagagaggtcctgatgctatggttcagtcaacaatcaattatcgagcactgagaaattctggagataagaaattctcttcttatttaggccagttctgtcagaatttccattactacagctcacagtgtcctaattcattcagtttactaaaagaataatccaatggataaatcaaacttaagtatatttcaggtacagattattcatttgttgttttgtattccacttatgtacaattaataacttctaatgttttaatttcaaaaaggtcacttttaaagaaaggttcatcttaagcatgaggaactgtaaatctgcttttaaagatctatggttacattcatagagcaaaaactttaatgaagtattgaataaaatgtttaggcaaaataaatcttcattgttgaagataggaaaatatttaaactggaattaagtgtaacctcacacattgatcaaatctaatgaataaaggaaaaggttttttttaaatcaatatataatattagaatgtgtccagataagatgccataaaatattaaccttaaaaatgttatcttctttctcaaatatgccacagaattaattacaaaaactaaaattaaaagaaagaatgcttttctacttaaagaaataatagacataggacccacttagtatcctcaatatattatattcttggtgcaaatgtaattgcggtttttgccattactttcaatggcaaaaccaacctaacgtgaacattctctaaaccaaagctgctactatcatattcaaataagcacagattttggagttagagatatatgttcaacttagacaagttctttaacctctttaagtcagtatactcatgtgcaaaatgaggataataattttcctttcatggagttgttagaagattaaatgatatattactttgtaagtgatacttttttctgtatttccatttcatattatcaaccaaaggtatatattctcttaaaaatatacagccccagaaacaacactacacatctacaaccatctgatatttgacaaaccttacagaaacaagcaatggggaaaggattccctatttaataaatggtgttgggaaaactgtctagccatatgcagaaagctgaaactggatcccttccttacaccttatacaaaaattaattcaagatggattaaagactgaaacataagacctaaaaccataaaaaccctagaagaaaacctaggcaataccattcaggacataggcataggcaaagacttcatgactaaaatacaaaagcaatgggaacaaaagtcaaaattgacaaatgggacctgattaaactacagagcttccgcacagcaaaagaaactatcatcagagtgaacaggcaacctacagaatgggagaaaatttttgcaatccatccatctgaaaaagggctagtatccagaatctacaaagaacttaaaccaatttacaagaaaaaaacaaacaaccccatcaaaaagtaggtgaaggatataaacaggcacttctcaaaagaagacatttatgcagccaacaaacatgaaaaaaacttcatcatcactggtcgttacagaaatgcaaatcaaaaccacaatgagataccatctcatgctggttagaattgtgatcattaaaaagccaggaaacaatagatgctggagaagatgtggagaaataggaatgcttttacactgttggtgggagtgtaaattagttcaaccattgtggaagacagtgtggcaattcctcaaggatctagaagtagaaataccatttgacacagcaatcccattactgggtatatacccaaaggattataaatcattctactataaagtcacatgcacacgtatatttattgtgacactattcacaatagcaaagacttgggaccaacccaaatgtccattaatgatagactggattaagaaaatgtggcacatatacaccatggaatactatgcagccataaaaaaggatgagttcatgtcctttgcagggacatggatgaagctggaaaccatcattctcagcaaactaacacaagaacagaaaaccaaacactgcatgttctcattcataagtgggaattgatcaatgagaacacatggacataaggcggggaacatcacacagtggggcctgtcggggggcggtcgggggataggggaggcatagcattaggagaaatacctaatgtagatgacgggttgatgggtgcagcaaaccaccagggcacgtgtatacctatgtaacaaacctgcaagttccacacacgtatcccagaacttaaagtataattaaaaaaatactgcatacattcacacaaacacacctgaacagtacattcttatgcacacacatacatactttgctcatttgttaaataaaagtatatgcagtcagaatacagaatctggtttttggtctccaccatttattcttattactccttccacatagcatgtcttccatgtctgttttactgcagaaagaagttccaaatagaatctgaggctattcaatcccatcccttgctgttccaaattgttgcactgcttgtggcatttatgatttattacattgctgatttttcttctctacaaaatacaaggtatgtgcgtgtacagtgactatgaacaacaattttgacttccatgtgctctcttattactttataaaagccgcttgtatatttttaatgtccccacacaaactttatctaaatcatgggccatattttatgtattagattaactgctagctgtacatcttgcttaaatcagaaatatttgggatcatgttattaattataacaattgcttgaatatgattaaggctattaaactttgattgcataattttaaacaaattctgacccgattcaaacataagaatcgatcatcaaaaatgtttaagggatgaattggtggtatcccctaggtcaatactcaggtttttgcagagttggcttacaaaggaccaaatatttcaggtagaaattccaccaaatcctaaaataggcagcatgtcttctctaggtcctctgggaggaactctctacctccaatggtactactcaagagaggcagccaagtttctgggaaggcaactagctggacttaggaatacagacctcagaaacagtaatatattttttcacaatggaaaattaactggcccatatataaatggaaccagaaattctggcctcagcagcacaatccaatagtgtaaaccaatcagaacagcagactaatttaaacttcatatatgaaacaaatttacccgactttgattagaattttaatataaatgctctttattttttggttattttaatattttctttctagttcagtgtaaagcaataattaaaggcagaaattatgctaagaaacagacaatctaattcatttaccacagtcttctgttttttttagcagatccctatgaaacaataccaacgaccaacccctctgcaactgattatttctctaatttaatgcgtaatcccataaccaaatatatccattaaggaatttgcttctccgactcattttacacccctggaaacattaacagatataagttccatcaaaatatcaatgaaaagatgagagttgattaagataacaacactgaagaaatgagcattattcttttggggagtgttttccaagcagttgagtatgaactgttggttagagaatccagcataatatacatagactattactagctctgaaaaagtagcttgctatcagccacattataatcttttggataatactggcagcaatgttattacatttctcatttccagggccctgaggacttgccatatcactagacagcacgttttttcacaaacccagtgttcatcttacacactggtctttaaccattagagtctaatagaaaacaaatctttctcacgctcagtttccttatctgtgaaatgggggaaaagtaataattacctaatgtgctcgggtattctgtggtttaactaattagaggttgtaaagcctgataaagcaccaagtggtattaaatgtctatataacatgcatttactggccaacttgtgctccagctgcttaaacacagctgctcttaataagcaggagaaaatcagctaaaagcatatgaagagctgattggaagaaatgacatggaaggagtgttttacaactcatgcatttgttaaccttattttaaaaattaagaagtgatttcattgtagaatgctgctgttttcagaaattccagaaaggtgaaacagtagagagtaaaacttcaaagttaatagaaaaaaaaaatactttcaattctatggactgcatcaaaagtgctttgaatcaaaatgaacattttttgtctttattcgctattctcttttctctttgttatgctgataataaacttcacatggtgtatataagtacaagcaaaaacattaggttatatatggcaagttcttatggagaagaaaatgggttctgtggatcgtggctttttttacatgctagagtcagaccaaggaagagagcagattaaacccaagtaggtattaggcgattcaaacactattgtccttgctgaagatcagcaactgtggccctatccatatcacaagcctaagtaaaggtactttactactcctttgcggtcttacttcctgggctgcttgccaaggtccccatgccagaatcctatacactggccagctttgcaagtgcatctttcctctcctgggttcctgggcttggcccagcaacggaactttcatatgctttgtccctggcttcccttatattcagccacccttatattccaactctgtatttcttagtccagtttgatggactaaatacaattttcaaatattctttttgctttcatattcttaactatgaattgtaccctaattctagttaatccagtcatgacaggtcaattgtaatatctgatttctgcctttaaaatgaagaatgttctttgccttcatgtctagtaccactgctattattactaataataaaaataatagataaaatttattcagtgcttattatgaatgagaaaaacttcttaatactttacatatactaattatttaacctgaacaccaacactgtaaggtagttgctactgttagctctgtttacagatggcaaaactgaggcactaaagagcaaataatctgcccaaagttatgaagccagtcactagagctggaatttgaagccagcaagtctggccccagagtctgtgctcctcactgctctattccagctgctatgtggccctgggctacccacaccctctatcttctatcattaaggggcataagtgcatgagtatacgtgggtctgtgtgtataaagtgtacataggtctgtgtgtataaagtttatataggtaggtgtcttctatttttggaacacccatggcttattttagtatgagtgacttctgagtttactcttccagattacttttctgagtagataatttctaatcattgtgtccattttacaaaacgcaatcaatatattaactttgcaaatggacaactgtagtaaacgaaataatggagaggacattttattagataattgaaaaacagaaaaaaatcaaatcccagtactacagtgaagagtaatttccttttaaatactgatgatatgattttcatcattttaatgaacagctttcatataaaatagcaagcaaaaaaatctggtcccattatctaaatatttgaagaaatgagtcacacattaattctatcaaaagcataaacatattttctggcaaataaccaaaaccatctagtctatctttaaaactgtgtagactctgagagaaattccaccatgtcacttggaactgctgattgactggccgaacatgctgactattaatacaagttttaaagtatttccaggcaaaaattacttttgccatgccaacctcataggtaatcattagaaaataaaactttggatgttttgccatctactatccatgaaggacaagaagtaatgtttagggaacatgtgtgtgagccaccctttcccttggtactttaaattttatcagagatcaagatcagctactgtaaggatttgaatttcaattacataaattttgtccctcacagaatcaactttactaaaagacaatttaatattgtgcttctaattttgaaggtcacataaaatatacataaaatttaatactgatattatgtaaaaatataatttaggacatttcctatcaatttatatttagcacacaaaaacccacatgatgcattttggaattcagtgctaaagaaatctgggcttcctctgaagaactattatatatattcctttatcagtgttataaattacataattacatcatgtttgcttcctccttaaccccaactccagtttcctagaagctgaagtacaaatctgaatgtcaatcacagagactgtttatatgtatgcttataacttggcttctatatatttgaaacagattttctaacttaatttctattttcccatttcattacagatactatttttaaaccagtatcaaagtttttatgaaatatttaagctgtaagcaaaaacaaaaaacataaaaatcagcttactctagaaagaattaaatatgtatttctacagtatagaccagtattgttaaaactgcttccataatggagttttaatgtgaattactggtatgattttaaaaacaactaaaaatagagagattccttccacatgaatttggctcttcatttccctgcttttgtcatatctcagaattaaggtatgcatgatggtgcaaatgtcaaatcaatcattataaaaacaaacagccatatttccccagtgttcaatctccaaagtcaatctgtactgtattggaagagtacaaatttaaaggagccaatgaggtgcatacatgagaagggagccttgcaaaaatatactagtttattactgtgggtgaagacaaatgttagtattgataataacaaaaatagtataaatggcttactatgggccaaatactcatttaactgataacttctttagctcatctcaaaaatctaagatatattttctatctctagtctgtgcatcagtgtatcagtgccttaggaggcagattctcattctgtcacccaggctgcgatttcagctcactgcagcctcgacctcccaggcctaagcaatcctcctgcctcagcctcctaagtatctgggaccacgggcatgtgccactatacccccctaattttgtttatttttttatagagatgtggtctcactatattgcccaggctggtctcaaatgcctatgtttaagcaaccctcttgcctctgcctcccaaagtgctaagattacaagcacgagccaccatgcccagcctagactattcttaaagaaagatggtaaagttaatcatgttactgtgcatatttctgtaaaggaggaagatatatgagacaggagacaaaagtagagtaaagagtagaaataagctgcttgacaatggggaaaggattccctatttaataaatggtgctgggaaaactggctagctatatgcagaaaattgaagctgaatcccttccttacacctcatacattttatataaaaattaactccagatgggttaaagacgtaaatgtaaaaccccaaaccataaaaaccctagaagaaaacctaggcaatagcattcaggacataggcacgggcaaagacttcatgatgcaaacgccaaaagcaattgcaatacaagccaaaactgacaaataggatctaattaaactaaaaagcttctgcacagcaaaagaaactatcatcagagggaacagacaacctacagaatgggagaaaatttgtgcaatctacccatgtgacaaaggtctagtatccagaatctacaagtaacttaaacaaatttacaagaaaaaacaaccccatcaaaaagtgggcaaaggatatgaacagatacttctcaaaagaagacatttatgcagccaacaaacatatggaaaaaagctcaacatcactgatcattagagaaatgcaaatcaaaactgcacgccagtcagaatggcgattattaaaaattcaataaacaatagatgctggcaaggctgtttagaaatagaaatgctttaattctgttggtaggaatgtaaattagttcaaccactgcagaagacagtgtggtgattcctcaaagatctagaaccagaaataccatttgactgagcaatcccattactgggtatatacccaaaggaatataaaccatcctacggcaaagacacatgcacacttgtttactggagagctatttacaatagcaaagacatagaacccacccaaatgtccatcaatgatagactggataaagaaaaagcagtatatatacaccatggaatactatgcagccataaaaaggaatgagatcatgtccttttcatggacatggatgaagctgggagtcattatcctccacaaactaacacagaaacagaaaaccaaacactacatgttctcactcgtaagtgagacagatggacacagagaggggaacaacacacatcagagccagtcagggggtgggggtgaggggaaggagagcattaggacaaatagctaatgcatgtggggcctaaaacctagatgacaggttgataggcccagcacaccattgcacacatatacctatgtaacaaacctacacattctgcacttgtatcttggaacttaaagtaaaataaaaaatttaaaaaaagaaataaactgcttgagcaaaatgatgtcccaatacacaatgtcccaaaagtatggtgaatttccatcttactctatggaaattatcaaaatctaaattcagttccccagccaagcaatgacgatagtgagacatcaccaaaatagggcaaaattaagtttgctagttttactaattgtctttcttctcaaataatggaaaaacagcagagttaatatttttctttttaattcatccactaccataattcctacaaaaagtactgacttattaagttcttttggattctttaaatgttgtttttagtcaacatcagaagtgtttttctaagtttgcatgatcttcataactatcattgttagaggctacatgatgtgctatgctgttgatacatcacaatttatcaaagcattccctatgttatccagttagcttgtttacattttgtactgcaatgaatttattcttgctttagttgaaagattttcttaaggcaaacttctgggagtaccatgttaggtcaaagtatatgaatatcttacccttagcattccaggaaaaataatcatcaccatttgctatttgggttcaattttttaatacaaatatcttaaatatatttttaagttttatgaataatttacagaacaggaaagacaattgaaaagttacaatttgtaaaaatattgaaacatactaacctcttttccaaatgaattcttggataaaaatattacaaaagataaccttttatcaaaatagaatggatcaagtttttgtagtaaagtatgacatgataatgtccttccagttgaatgactaatgaagtgagaatgccatatttatttttgtccttaaaaagatattattcatccacttattcttgattttgagaaaattcatctaggatatggtaatctgaagattcatggtttgagattttgcttagaaatttcagcaacataatcaaagtctatagtgctgctgtttcttttcactcatttaataattgcagattatcttcccttttaattgtattttttagtaattttatgatagttgaacattaatgatgaataaagaaataatccctaggaatgatgaaacagcaatgtgtttcaagatacaggaaaaatgataccgctaaaatcccataatatatcttaaatttataataagggccaatggactgatatgataatttaaaaagatagggtaagttttattctcacttttaaaatgaaatatgtgttctctttgtgctttggaagacatctaaaaataataaaaatcatgatacatcaatctttacagaaagttaggattgctctcaaaagacactaaaatctacaattgaatccagtagactcaacgctatacagagggaaggtagtccttgctacacatccattttccaggtgaaaacattttttaaaaagtgatagcaatcactaaaactattggatacccattattagtattattacatgttactatgctatgtgaatatatgtatttacatctaatttacatagtaggttcaaagagggaggaattattattcttatattacagatgtgaaagcagatccaaagagattgtttttctttgtcaaattcacaccccaattaaatggtagagcaaaaacttgaacccagctctattgaatactctccaaagctcaagtttttacatgtaaattaatgtcttagtttgttcctactactataataaaatatcttagactgggtaatttatacacaacagaaatttattgcttacgtttctgaggcagggaagtccaagatcaagacacaagattcagtgtcttgtgagggcccactcctcatagatttttgccttctatgtcctcatgtggtgaaggagcaaagaagctccctcacacctcttttataaagctgctaatcccattcatgagggcattgcccttatgatctaatctcctcctaatggctccatctcttaatcattttgcatttggtagtaggtttcaacatatcaattttgagggtatacaaatatctagaccacagcaatgagtctttacaaaatgtcaccatatcaacaagattccattcgagccactattttaagctctatcaacagaagatctgagattgtagaaacagaaatttaaaggggaaatattccacctgccagtaatctctgaaaagaggagactacatggagtctctatatatttgaaagcacaaagaaaaaaaaagccagtatgtctcttggaagtcatttttttttctttgaaacaatatgtatttacaatttcctgaggctttacatcagaacaaggcactggttttcttactctatggtttgcaattatgggaaataatgcttccactacataacatgctgcctgtttcctcttagccaacttggtgacaatggccgtctccacaggttacacatcaaaggagcatatatcaacagtagttggctggcttaccagatttctctaacttgtgtcattttagaaaagaaaaatgattgctaataagtttgaatagctcaaccacactgagcaaagcaaaattttaatcacgtgaaatcaggaaagcacttacaacttatcaaaatgccttaaatttcttcaataatttgctttaaaagcttttatcccttcatccagctttcaagctcatgaaagccctaagcatgtattttcatgaacatacaggaaagagaattctctctccaacctctcctttattactttctgcatttgagctcacttactgacttgagaaaagtagcatttttagaaagtagttctcaacaggatttgagaataagagtcagataaaaaagcatcatttccacattacctctgcctgctaacttcactcaatcctcattttcaataatccaagctctggtaaaggatgactgttttgattatttgaggatataagaattgggaattgtgaacaatcaagtttttatggaaatatgttcaaatatagtcttttaaaaagaatcaaataatctgggggatacactttagaatgaacttagctgagtaacatggaaagaacatagaaagttctaccgtatgaaatacgtacagtgcatattcccactctaaatccttatattttgttgtcccattgattttggacttggtcacatgacttgtgttgataaccagaacctgagcagaggtgaccatttgccaattcagagtaaagccttctttagtaggtataaaactcttcttctcttttgcttcttcgtggaaagaacatgccccagtggccaatggtcccaaaatgaaaacacaggcgcaacaacctgaatttatgcaggaaagtaaatgtttaccattataagtctctgaaattttgttgttagttagcgctttctagcatataacctggctaatacacactgggtttcaaaaattattttacatagctgtttccctcattctgcccagtgctgcattcattattgtaggtaaagaaacagcagttaagcatgcaagttctgaaataaaatggaccttcagtaaattaacttctgcaagcttattcaattgtaaaactgacataataatattatctatctcatattgttattgttagtgccaagtaagataacagacttaaaattcttagtacagtgtttgatatacagtaaagattcactaaacattagctatggtgttgttgttttttcattacttatgtcttaattcctgacacagtattatggcacacactgctcttaaaggtctaagtaggatatgagacataaaagagggaggaagaaaggaatgctcttccaacggccagtcctccataatagtgtcatgaaaatggacctctatatttcattcaagatttttcataaaacatgcaacagcaaagatggaatcacaatcaattcatgttttaaaaatgtgatgagaatggcttttacatgtggctgaatctgatatttacactgaaattattttcagtccttttgatggaaatgtctcaatttatatgctaaaccttgcttgttcagtgtacggactttttggaaacctaatcatcttcgatgactccatgtcttagtttcttattaatttttagtgattataatattttgtattttcaatatagagtgtcagcactgattctagagcaaacattatggcttctacttctaaatcaaatcacatacaatcttttccattgtttagcttaaatatcaaagcaggatgtatcgatgctaggcttgtgctacagtgctacataaccattattctacccagataaatcaatcaaaggaagcagcagttttccttggggtttgtttatattctcaataaaattgtactttattcatcagtactctttgatgatatagaattattcaaaacatcttctcttaatccagaattagtaacaacttcaacctctttgtcaggttcaactcagtctctcactgcataagcttctaattaccgcaagtgagcaaatgtacatcttatcgtgaatgccacagcactctctttgatgggtaaataacaccaaattgtaaaagcttaagatatttcttctaaagacaatccaaattatgattttgattcataactcattaattcaatcaaattttactgggaacacataatgtatggtttttgacactggagagagataagtaagccagacagaaaaggtctctattctcacagagcttgaggtgaaacagacaatgtgcaagtaaataaatgagcaagtgtagtgtaatgcagagacttaagatagaatgacgtgagggagaatggctagattagactgtatggtcaggaaggacctgtctatcaggagatgagattaaagctgagctctgaatgacaagaagcagctagccagtgagaacagagaactttgcaactcctgatttaaatggcaatatgagcctttgattcaccttgacaattctcattaaaagcatttaattgatttctcatttattttcagagactttcagctgtcagactttgggatgttgaataatcaagattttcttgaaatatatttcaaatacgtatgttgagttctctcaaccttgaaaaattgataaatatcttaacacccagcaataaagctaattatctgcctttaactttctggaggatggagaaaatgataaattttacattatgtctgtttattaataactacctgttctttatttaaatctctgtatttggatcttggattaaaatcatctaaaactccttctgtcttcaggctggaatctggtccccagatgatatgtgattacttttaaagacaacttctttattagctgtctttagaatttgaaatgattaccttatgtgtaaacagcattttctccgaagagcttagtcgtccctttagtcttttatttttaattactttaaatccacataatcctcaacacattttagttatgtaaagggaagacaatcttatccctactgtgctaatgcgtaaactgaggcactaggcaattaagttacttattctgattactctatctcctgcattttcacggtcacaaagtgtctggtaaaaagtaagcacctagccagttatccctctgatgacaatatatttgagaaacttgtaaatgtttatttaaataataaaatcatccatattttataaaacgctttaatttttaattcagtgattccatgaaatttgttaatatttcactcacccattgaacaagcatttactatgtaccttctattatctgcacattgtgctaggtactgaggatacaaatgtgaatcaaatgtgttctcttctggcaatcaagtcactgatttttttaatgtaatatgttatacaatgtaaaacatgatcacacttgtgaataactatctgtttgctacagattaaccttaaatctgagaacatgatggttgttcaatcaatacttgatgactgattatattttgttatgtagatataatttaagtagcagaaccataaataagacagagctttatgtagagaaaagcactgttctgtcgttgtagtacagataaccaaatttcatatttcttaaatatcttaaaaactctcatacgcatcctttccattccttctgctatggcactgattcagaaatttagagcctcctgcctggattatcacaaaatctcctaaatctcccctattgcataaatcaaaatcatcctccatttttaaaggtttatcttcttatgccatctttgtgaatatccaatcttcagtgatttctttttccctactaataaaattcaaacttcttataatcccatagaagttcctccatgaattaatcattgcctacatcccattaataccccacaactcagccaagctgttacagtttccataacactcattttgtttcatggcttcatacccttcccacttgctccctgtccttagaatgccttcctcttcaacctgaatggtacacatttattcatatcaggatgacactcaataaagctttttctgaatcccacttccccattcaagcaaaactttatttcctacttaatgttccttataacagttaatatcaacttaagttgtaatgcccagactctaacatacttttagaaacatatatgcatacaggagtgtctattcctggttgaatataatttgctaaggtttacagtcttaactgtttattccaaataggtaatttggcactaaatgaaaatatattgagtgactatttgaaagacagtatagaggtcctgtaggaaacaaaaatatatgtaaaataggatggctgccttttccccaactctccagatgttggttcacccaatagcttctctgcagcattagcaccactcagcttccagaataatgatgggttaccacagaacttgtactttatgtttaagatcctgcttctactgataacaacaaaaaaacttgagcaaattactgatctctaaccccagttttcttatctataaaattgagtaataacaatacacatttcggaaagtgctataaggattaaatgagaatacaaacacagggcttataagaaagtatggcgtacggtaatgcgcaggaaagagagatattgacagttaagagtctctcaggtgcaactgattactcaatgtaagccaacagaagccaaaaggagagtgattcaccggctcccataactaggaagtataaggcatctaataggctgccataatttcttaattctctttcactttcagactcgatctacccatctccctctctctacctattcccctttcatccttcccttatacataaatatattttcctaatattcctatgtacattttttccaattgtcttccactgtgtatcaccttcctcagtccgggagctctcagcttacacatcattcaatcttagcaaaacaagaggcaagaaacattttcttccttcatctcagtatatacagtctctgggaaggcctctgactggtcagctctgaagcaattattgcagatgggaggagaagtaactacaacttgttcaacctaggtcacatgtttactcctgagttctggaggctgatgtctgttaccagaacgggaaaggaggtatattggacagatgtaaatagtatttattattttattcttctcaataatatctccatttcccacttggtcttagttaaattaagcttgtttcaatgattcattttaattgactactccctaaagaattggtgtatagcattaaccgtcaacacgagactgcacttaatactactactaccataaccctgaccaacaacacaatgtcttcacactctacctgaccacctatgttagtcaatgagatttagtttgtcattctgattgttctgtaatgtcttcactcatggttcctgtttcagtggtatctaaaactttttttattcagatgcagacccaaaatactgggatttgagtatagctgagtctttgctaggatgatcttagaaagcttagaataaaataaagcaagacaatgaatgcaagtcagccaacatgataggcatcaaagaacaggttatatctgcagacatcaggactcaagtccactgggcacatctgggaaatggtctaccactcttcccagagttgttgtttccaaagaatagaaaatcagggaatatttatcctccagcattcatttggcagtggttgagggcagctctagggtatgtctgtccccaagcatttcctcacacccaccctccatgagggttgaaagaaagcccttcaaaagccaaagtcacagaagcttgcaggaggacagcaacataaggaaattgagtacctagcagacatgggctgaaccacacaaaatcatctataagtggtctccacatgctttgctctgtccaagcactctttcatcatgaacatctgtccgtttccagtgatgttcaaacttccttagtagtcattgtccattgcattgtctttctttcagaggtcagtaccttagacttaactacaaatagctattaattcttggatttttttagttttggtcacgcagctgaatttatgctatgtgctcctacaataatgaaggcatcaggaccagaaaatcaaacactgcctgttctcacttacaaatggaagctaaataatgagaacacagggacacatagaaggtaacaaaatacgctggggcctatcagaggttggaggggatgaggaaaaataacaaatgggtactaggcttaatacctgggtgaggaaataatctgtacaaaaacgacccatttcacaagtttacctacgaaacaacctgcacgtgtaccccagaacttaaaataaaacttaaaataaaaacctgagatatttttggaatatatatttattactttttttaaaaaaagtaataaacatattcatgttaaaattgaaaaaatatatataatgagggcatctagctattcctgttggcttcactgtgccatttatacacccttgaactgtctattttatctgacactgtgtctcccaaaaatgcacttcttgttgttagggaggtcactggctacaagagaatatgagtaaacaaattattttatgttcctacttagatatctcttctataaagaagtctttcataacaacccgagtcatgttgaggtagcactcctaagttatggaaatacttgcatgtttctgttcaaagtattcattgccctgaattttattttttaacatatttttaataacagctctactcagatacaatctgcaagccataaacttcacaattttgtgtacaattcaggagtctttgtttagtatattcgcagaattctgcatccattgccacaatctaattccagaatgttttcatcatcccaaaagaaactccatactcaataacaatctctttccatttctcttgccacccattagacactccttgcacctcttatctactgtcttttcctatgaatttgcctattccaaacatttcatataaatgaattcatataagaaatgccatttatgtctggtttctttcacttaacttgttttcaaggttcatccatattgtggcatatattattactgcatttctttctattactgaataatattcaattatataaatggcccatattttatttatctacttataggtggatgaacattttgttgtttctacatttgaagtattatgaataatgctgtcatgaacagtcatatacaaattttgtgtaaaactatattttcaaatctcttggagatagatagatatatatatatatatatatatatacacacacacacacacacacacacacaaattggtggctcataagtaatttaatgattaacattttgaaaaaccactgttttccaaaatggccaaaacattttatatttctaccaacaatgtatgagggtatcaatttctaacatccttgtcaacattgctattgttcatcattttcattacagtcatcctagtgcatgaattgcatgtccttaatgaacaataatgttggatatctttccatatgcctattaacaatctgtgtatcttccttgaagaagatagtcaaattctttggccattttttaattgagtaatttatctttttcttgttgagttttaaagttctttatattttctacatgtgagtccctcatcagataatgattttcaaatatttgctcccatttttgaagttgtcctttcactcgcttgatgttgtcctttgaagcacaaatggttcaattctaatgaagtccaatttatctatatatattaggtttctattgttgctgtaataaattaccacaaacctaatggctgaaactaatacagaattatcatattacagttctaggcaaaatggatctcactcaaatttggcaggactgcatgacttctggaggctctaggaaagtatctgtttccttgtccattcagctctagaggctgcatgtattggcttttggccctgcatcattccaccctctggttccatctttacatttcctcctctgattacaactctcctgccttgttttttctcttgtaatcttgaggttacattgggctcacctagataatcaaggattatctccccatgttgagatccctaacttaatcacatccacaaagtcccttttatcatgtaagataattgcaggctttgaagattcaaatgtcgacatctttgtggggcagttattttaacaatcacactctattttttcttttgtcacttatgcttttgatgttgtttctaagaaatcattgcctaacctaaactcatgaagatttaggcctacattttcttctaaaagttgtatagttttagttcttacatttaggtctataattcatttggcattaatttctgcatatggtgtaaaggacaagtccaatgtcattcttttgcatgtgcacatccatttgtcccagtaccattattagttcagaagactgcttttctcatagaattgtcttagcacccttatgaaaaatcaacttaccaaaaatatgagtttattgccagactctaatccattgatctatgctacatatcatatcacattttcttgattactgcagttttgtagtaagtttttatatcaggtcacatgaatcctccaaatttgttagtcttttgcaacactgttttaggtattctgggtccttcaaattttcatttgagtttttgaattagcttgttaatttctgcaaaaaaggcagagggggttttgatgtagattgtatggaagctatagattaatttgagaattactgtcatcttaataagagtaagtcttccaatccacgaacacgagatatttttctatgtatttaggtattctttaacttctttcaataatattttgtagttttcagtgtacaaatcttgcacttttgtgagatttactcttaagtactttattcttttttcatggtgttataaatgcaattgctttcttaataccatttttggattgttcatttgccagtgtataaaaacatgagtgatttttgtgtattgatcttgtaccctacaaacttaatgaactagtttattagttctaattttgtgtgtgtgtatttgtgtgtgtgtgcgtgtgtgtattccttacggttttctataaacaaaagcatgttgtctatttacagagatagctttacttcttcctttccaatctagataccatttctttctttcttttatttgcttaactgctctagccacaccctacagtataatgttaaccagaagtagtaggagcagataccactttttattttaattgtaaaaagcaaaacataaaaaatgccaaaagaaagatgcaattagacatttcaggagatgtagttatcacttattagtagaaataaaagaccatggcctagatccctaaggatgagttggaatttgacaaagtaagacacattcaaggtagagggaaaggtgtaaaaaaatacatttagaaagaaaatacagggcatgattatgaatactaggtacaatttttacagatcagaaaaattggaggtctgtcttcattttattaaatttaattattaaaataccaagaatataatatagattgtttaagtcaagatatctgatagcactacagggtaactacagtcaacaataatttattgtacattttaaaataactaaaagattataattggattgtttgtaacaaaaacaaaggataaatgcttgacatgatggctgatgtgattattgtacattgtatgcctgtattgaaatatctcatgtaccccataaatatacaagcctactatgtaaccacaaaaatttttctgaatagaataaaataaagaaaatttcataagcagtatttcaggagaattatattagcactgcattaaacaatattttccagtatgttcactgatcaaccacagtcagaaggataattttccattgacttcacaaagtaacattttctaaatttgatgactaatcaacaaataatgatgaattgttagaaaaaaaaagtcaatttaacccaattacagcctaactctggaacaggacaggacatttcacctttaaactggcaatgaatagaactttgataagtcaaaagaaatgattctagtctatggaatcttataacattttagtaccagctttacaaaggagaatttctctctctgctcatccttacggcaaaagaaaaccgctaatgtctgatgtgaaaattcaggtttaaattctgggattgtacatctcccattcatgctctcacacttatttgttaaagtttggcagaaattcaaacaagctgaaaagctcactgccatgcaaaggcagcagtttagttaagacagcatgacatttatagctgaattctaccagaggtacaaagaggagctggtaccatttcttctgaaaccattccaaacaatttaaatggagtgacttcttcctaactcattttatgaagccagcaacatactgatacccaaacctggcagagatacaacaaaaaaagaaaacttcaagccaatatccctgataaacatcgatgtgaaaatccccaataaagtactggcaaaccgaatccagcagcacatcaaaaagcttctaccatgatcaagttggcttcatctccaggatgcaagtctggttcaaaatacgcaaatcaataaacataattcatcacataaacaaaactaaagacaatatctcaatagactcagaaagagccttcaataaaattcaacatcccttcatgttaaaaattctcaataaactaggcattgatgtaacatatgtcaaaataataagagccatatatgacaaaccctcagccaatatcatattgaatgggcaaaagctaaaagcattccttttgaaaaccggcacaagacaaagatgccctctctcactcctattcaacatagtattggaaattctggccagggcaatcaggcaatagaaagaaataaagtgtattcaaatagaaagagaaagttgaagtgtgcccataatcctagtccaaaagcttcttaagctgataagcaacttcaacaaaatctaaggaaaaaaaatcgatgtgcaaaaatcacaagtattcctataaaccaacaacagacaagcagagagccaaatcatgaatgaactcccattcattactgccgcaaagagaataaaatacctaggaatacaacaaacaatggaagtgaagaacctcttctaggagaactacaaaccactgctcaaggaaatcaaagagcacacaaacaaatggaaaaacattccatgctcatggataggaagaatcaatatcatgaaaatggccatatttcccaaagcaatttatacattcgatgctattcccattaaactaccattgccattctttacagaataaaaaaaaaactttaaaattcatacagaaccaaaacagagcctgtatagccaagacaatcctaagcaaaaagaacaaagctggaggcatcctgttacctgacttcaaactataccacaaggctacagtaaccaaaagagcatggtattggtatgaaaacagacacaccaatgggatggaatagagatctcagaagtaagactatacatctacaacaatctgatcttcgacaaacctgacaaaaacaagcaatggggaaaggattccctatttaataaatggtgctgggaaaactggctagccatatgcagaaaattgaaactgaaccatttccttacaccttacacaaaaattaactcaagatggattaaaaacttaaatgtaaaaccgaaagctataaaaaccctggaaaaataatctaggcaataccatctgggacataggcatgggcaaagatttcatgacgaaaatgtcaaaagtaattgcaacaaaagtaaaaactggcaaatgatatctaattaaactaaagaacttctgcacagcaaaagtaactctcactggagtgaacaaacaatctatacagtgggagaaaatttttgcaatctatccatctgacaaagggctcatatcctgaatctacaaggaactcaaacaaatttacaagaaaaaaaaatccattaatagtgggcaaaggatatgaacagacacttctcaaaagaagacatttacaaagccaacaaacacatgaataaaagttcaacgtcgctaattatttgagaaatgcaaatcagaacctcagtgagataccatttcacgcccgtctgaatggcaattactaaaaagtcaagaaacaacagatgctggcaaggctgtggagaaacaggaatgcttttacactgttggtgggaatgtaaattagttcaaacattgtagaagacaatgtggcaattcctcaaagacctagaaccagaaataccatttgacccatcaatcccattactgggtgtatacccaaaggaatgtatcattctattataaagatacatgcatgcgtttgttcacgccacgctattcacattaacaaggacatggaatgaaactaaatgtccatcaatgatagactggataaagaaaatgtggtacatagacaccatggaatactatgcagccagaaaaggaacgagaccatgtcctttgcagggacatggatggagttggaagccattattctcagccaactaccacaggaacagaaaatcaaacaccacatgttctcactcataagtgtgaactgaacaatgagaacacatgacccagggaggggaacaacacacactagggcctgttgggggatgggggagggtgagcatcaggataaatagctaatggatgcaggccttaatacctaggtgaagggctgatctgtgcagcaaaccaccatggcacacgtttacctatctaacaaacctgcacgtcctgcacatgtatcccgtaatttaaaataaaataaaataacataaaatacttgttaaaaacaaaactttgccgatttgtgaggttagttactgcaaatatttcttgcagagagatttgtgtcagtgactttcacattttaaatatttaaaatataactgaatgactagcaaaactgtagaagtgctaggacttttcaggataaaacttacaattttttcaaaataaatcaatcagcgcacttttctccctcagaaaagaatttagattcagcatagagtgaagcaatagtcctcgtacaaagtataattaattcctaaattaaggcttgctccctttaaagaatttctgattttgtgtaggacaaacattagagtaggtggtcatactgttaaagacccagtttgttagaacatggtgaggagatggagatgaatattttcctctattttaacatattttctcccatacatttataatagctactgctggtgataactaatcctactgtgattttcatcattaagtgttagcataatgtcttgagagcatgtgcataaattcaacagtcccaagaaagcaaagcttcatgtacagatttctctgaaggacccacagagttgttttcattggaaaggtataataaattaatagacacattaagtttcaatttgagcaaaagaggactctttcattttatgaaatactctaggtccagtgctcctcaaaagttagaggaggaaatactgccccctaagtgttgctggtattctcagaagtcagaaacaattgtgctagttacttaaagactctttaaccatgattcttcaccaggtaggtactgtagattcagagccattcccactaggcctagttcccactgcgaggtgccatgcaccctttcatttttaaaccaatatgtattgagtgccaactgtgtaaccagaactgtgctagatgctggtgatcaaatggagccaaaaagcatctttgttcttaagttgcttgtagcacaatgggtaagaaagactgtatggtgtagatcacaaattatctatcaactccctgatttcctccatctccctcaaaccttttggcctttattagtacttattctcctcaccagtgaatgcttccccactcctcgtaattaaaaccttccccactttcaaggtacagctaaacatttttttcacaaatcccagactgatatacacgtgcttatctagaacaaagcctgtaacaagttactctcttatccccgaaagagactaacaaaaagtttgcatactataaaggcctgttgtatttggacatggcaagtgactaatgtaataattggggagagattttcaagccatttttcttgcagatctatagcattagagaaaaaaaaaaagaaaaactgatatactttaagaaattagtaatcccagccctttgggaggccaaggcgggcagattacctgaggtcaggagtttgagatcagcgtggccaatttggcgaaaccccttttctactaaaaatacaaaaatagctgggcacggtggtgggcgcctgtaatcccagctactcgggaggctgaggcacgagaatcgcttgaacctgggaggtggaggtttcagtgagccaagatcacaccatcacgctccagcctaggtgacgagtgaaactccttctaaaaaaaccaaaaaacaaaaaaaaacaaaaaaaaaaaaaacccagcaacccataaaaactcatcctactatgtttttagctgaatcgaagtgaaggattcactgaaggacatgacagcataatgaagtgagaggcatgaattatattctttgaaggagccaccctcagccatgaatcttaaatgtttattacctggaatgagtcactgggaaagtgcccactctaggcaagggcataaggcatatagtgacatatagtgatctctgccccataactcaatgttcttatatgattaggtagttttcaaagccccaagtaaagaaacagacatctgcataaggtgtaatgttttttctatgggaacaaatctgactttaataagatccccatagggaatgaaacaagccaaatatgaaaggttatattctatttaattacatttttataaaatcatagaacacagaaaactaatctataattctggaaagtaggtaagttgcttcctgaggccaggttggggaacctggctgcaaaggaaagctagataatttggggacataatggaagtattctatattttcaccgtgagggtagttacacagatgtacacatttgtcaaaactcatgggcctacaaacttaaaataagtgcattttattgcatgctaattatatctaaatgaaatttaaagttaaataaaaaggaagccaaaacacatacagttttgttctagtaattctagagtcaagaagtaggactttcatgagaattaactaactttaagcatttgactcaccctaagaactgaaacctgaaaacagataaagatttagctcttcatcatcttcagaaagcatttctgactcattctggaaagtccattttagaggcttatttccatatttatgtttttctttgatgtttcatatattcagggaccacagtaaaagtatcatgcacgtgacgtttgtttttgaccattatccagcttcactttcagcctcaccttccccactctgtctcctcccaggaagcccgttttatccttggctgtcctgaagggctccttgtgacataaataaacagcaagtgcctagaaattgtacttttctgttttccttctatcctcatacccctaccaaaaattactaccaatatgattaacagctaatactacctaaacatgtaacatctcccaggcattctgctaagtggagtggtttatttaatttttaaaatatccttgtgaggttagtattttgttattcccctttgtgcagatgaagaaactagtcctgtagaggttaggaagctttcctaactcctaaaaattagtaagtcatggagtcttgattcaagtccaaatcaagagcctgtatccataactaatatatcctggtagataagcccattctgtaagagccctgctctgccttaatcagtagctaaataaaatcaaggattcatgctaaggtgttagcgactcactgtgttactacactgagaccatacattcaaaatcccatcaaaaccttcttactatatagatgactgagagtttctgtgatagaggggtatgttcaagcagttatgagacactttcattactaaactctggtcatgaaaatttccccttaaaggttaaatcttctgggtaatcggtttaaaaaatctaagagaatcattaaaataaattcaagattatgtatcacagatttatcaagattgggtaatcaataaatgatatatatgaagtaatctatccaacttttaaacaaaatgaatattttaattaaagaaattactttttttcttcagtaaaactgaagtcaattgggaaaaatattataggtgacaatttcctgtattttttttctttccagcaaattcaccaaaattctttttcaataatgaacgtaagttaataatgttggtaaaattttccaactataatatgactagccccgggggtgtcatggaatacattaagtcttttaactttgtatttttatatctcagaaattggaaaatgtaaaaaataactttataatatctccctttcttttatattcattgcttatgaatataaatatgacaagtttatagtcatttgaatcacaatagacctttgccaaacacctttctcctaattattataacaactttaaaatactttcacacatctttggttgggtttagtagttgctactatggcttcctttaaaaaatatagtcaattatagtttattttagagagagttaaatatatggaagattccttaaacacacacagagacgcacaccacacacacatacacacacacacacacacacacacacacacacacacacaaaacacagagtctggacttgccacttctagatataattacccaagaaaaaaacattgattgattaagacattgagcgtgcgtataaacctttacaagtaaagtgtctataagacatagtcataaagtgtgctttagtatacatgctggaaaaacaagctgccataaccatgcaaaaaggcattcaacatcattattcattaaggcaatgcaaaccagagccacaaagctaggacttcacaaattcacacctattatgaaggttatcattttaaaaagaatagaaaataacaaatgttagtaaggatattgaaaaattgcaatccttatgtattgttgatgaaaacataaaatattacagctgctgtggaaaacagtctggtgcttcctcaaaaggttaaacatagaactactacatagcccgtcaattctactcccaggtacatattcaaaataactgaaagcaggaatttgaacaaatatttgtacactggtgtttgtagctgcattattcacaatagccaaatgttgaaaacaactcaagtatccatccacagataaatggataaatagaaagtgatatatacatacaatcaagtattgttcagccataaaaataatgaaattttgatacatgtgacaacatggatagaccttgaaaacatgtttagtgaataattcagacacaaaagtacaaatattctgtgacttcactcacatgaggtatctggaataggcaaattcacagagacagaaagtagaatagagataaccaaaggctaggaggaaaaagggaaggggaagttattgtttaatgggtacagtttatgttagagataatttctgaaaagatttgggtatagatagtggtgatggttgcacaacactgtgagtgtatttaatgccactgaatctgtatactgacaaagaattaaaatgataaacagtatgttctatgtatttcaagctacaactgtctctacactcttccccacctaaataaggttcaaagactttctccacagaaacaataattaggagaactaactgatatgagatacattgtaaggaagtgttattttaaaaatctagacacaatacctagtgaatatatacctagtttagtagaaagtgtctgagttcaaattacgaatctcgtgtgctacaaccaccatatgtcattctctatttgtttcccatcagtttatttcatctcctaaactagatactaagaccatttgggaagacattatgcctgtcctcttctagtatgcctcaaaatatcattatgcacaaagaagatattctgtaattgagtcaatgattttaacttaaaacgaatctgttaagccattccatctaaaacataactacatagaaaatctgctatcaggaaagaatgaagtcagttggaaactaagacaaatgctgtttttttttttgcattttattcaaatggcatcaaatcaaattaagataattactgatgtatacttaggcacaaaaggaaaaggcaatatatggaactcaaagcacttacacacagctatttactgcattcaatattttatttattctaagaagtagtagaaagtagcacttgcttagaataaggagtcatgagattttcatttgaccccaccaatgaatttgatcccataccaaacaataggccttaaaaaagttactgactttgcctccatttccccctttgacaacatttcctgcatacattttgcgagtttctggtctaaaattatactaatgtagaactggaatagatttttaaaaataagtgtgtccccatctcttcctttcacagataaataaggacaagagcatgtaaattacattctcaaggttgctctgctggtcagtgagtgggtcagtgctagagccagggctcggaatcaagtctactgatggattattctgtgtcatcgtcccttcaactctgtgttttaaaatgaagaagaggtctttttggaatgtataaaatatatacaaattaaagatttaatatatttatatagacaacctactgcatatttcacatatcctcaataatgtcactccacagagccaaaataagagctgatttggttgttagtttacactatacagaataaagaagtgtaattcaaattttcaaggaaatgtgacatacatgacttatagccatatagacgacatggctacattgaattttctcttctataatattgcatatgggccaggcgcggtggctcatgcttctaatcccagcactttgggaggctgaggtaggtggattgcttgagctcaggagtttgagactagcctcgccaacatggtgaaaccctgtctgcactaaaaatacaaaaaagcagctttttgtattttttcgtattttgtattttttggggattgcaggtggtggcgtccacctgcaatcccagctactagagaggctgaggcatgagaaacacttgaatccgggagacagagtttgcagtcagcggcaatcacgccaccacactccagctcggatgacagagcaagatattgtctcaaaaaaaattttaaaaatatcgtatatggttgtcccaggaaaatagtctaatacttgacctaattcttattgaatgaatgtctacatggttccttttaaaggtagtaagaattgtgtccaaactttttccaggactctctgtagtcttgatttattggagttctatgctgttgagataaaaggaatgcatctaaacccacaggtgaggatgcttatgtttcacaactccaacctcagtcatccttgtcctggtaaactacacgagttgtgtcttttctcatcggatcattaaaaaaaaaaaaagtagggaagagtgcactgcacttcaattatcaatccatccctactgccaaaaggcagctttcaactgtctgtctgattgctcagaagtcatctccaagtaatgaaaaaagtaatgttagccagtaggtttcccatgatttaatgagcaactttaacaagaattttaaatttagtgataccaaaattgtatgctgttaatatagcactttcttacaacatacagagatatgtggtacaaaatatctactgtttataagactgtatagctatctagagtaacagtataagtatgttttcagaagttttttagagtacaggctgacaaaatattttatatgaagtcaaacagaaatcctaagcatcttaatttaacaaatatttttgagcactgactatgttgtatattggcaacctccttttgctctgtcgaataaatactagtcagggccatcagctaaatagagatgaggagtgagacaggaggcatgaagaaagtagtgaaggtctctaatatttaaagagaacaatgaagagaggctgtttggaacagctgtggttatagggcaagataaaggactcctttgaggtgacaggccatgaagtgaatacttttgtgactttcttcaccagtctctacatcctaggtttagaagcaaatttttttaaaaaaaaatctgtattgatcaaaggcagttatctttctggaagatgacaaaggattaaaaagaaatagtttaaggtatgacccttaaactataaaggatgcttacatataaagctattttctgttactagtgtaggataaaacagctctattcatttccttttccattattcaacagtgaaatgaaatggttttatttaaaacatttcttattttaaataagaaagacaatagcatgtcagagttatatacatagttgagataaaactaaaatgttgttcctaaaaaatgtgggtaaaagattttttcattcccatttcagtggcatctgagacaaggtcaaagggtcatgttttagctacatcagtgaatagtgtttagatctgttagcccagtgcatatgaaagcgagtctgtgtatgtatgggcctatgctaaaagacattctttaatgaaagttgaacttgatttaactacaaggaaatctattgaatccataaaagtacaaaaattatattctctcccccagcttcggagttttgatttaggcttattttcctggagtcgctatgcactgttttatgtatggctactataggaaatttactcattcagaaacaatgatacatttatgatgcagaataaatgatacaatctacgctacattattaacctaagaaagctcctctcgggactgaaaacttgtgactattttgaatgctaacaaactatttttttaaagtaagtgacacatattttgcttccatcttctaccagcaatgtaatgtttctatgaaatgaccatgttaaacaaccaatcgacagacccagtcacaaaagtgccctatgagtgccagtcattctaaaatccaaaaacacgggtaagacctagagtcccagcatggagtgagtgcactaaaagcactaattaatgcctgcttccagatcatggtgagccaagagaaatgaacagcattaactctgatcagatgaatcactcattaaaacagtagaataattcaactttattttacagggtgtttacagagctctgaagctctttatttaaaaaaaaaaatcacaatttttctaaaaacaacaggaaaaaagagaccacctatgttccttctctttttaggttgaaatgtgcatatttttagtttcctgcaatgtctctatcaaaaactatttacagtaaggaagagtttgcacaggaatttctttttgcccccttggaggataaaagtgacagacagaaaattgttagactttttccttgaggcctccaatggcaggaaaacttaccaccagtttgtctgtagcatgcaaaccagacaaaagagagagcttggtgaaaagtagcccaacatatacatttcccttattcagggctcaaggactgtgaaatacgttgtactatatagagaaatggctccacagtgcggaacgttaggattagtcctgcataacacttctgaactttgttctgattgaatatatcactggagtccaagtgaagtacttggtacgtctgaatggctaaagttatcaataagaaggaaacaagatggaccatcagtcctacattaagtagagcctatataggacttccagttgttgcccacacaaagccttgggagcctgcttcttcttacaagttcatctagccaatttaggggtttaaattgatgagtctatatataatctaccccaataagaattgggaccacaactctctaagtaacaacacagtctgtctgccaagatgcagagacaggcaatatttttactttttccaccttcaaagatttaaataaaggaatcctaatttttcctgtctcactactaattgactttgcttttataatcctttcttagtcattaatgaaactatcggatttcatttgaatgctttattacacgaatagatcagtctgcactacttccacataatgatgtatcagtccaaaacatcagagtacatcttcaaattgtataccatagacataaaatcatcactgtcgaaagactagcttcttcaaagggggtcatatttgatatcacactgcaaagtgctatgcccggtcattccaccgaactaacaagatacctatattctgcataatgctgattagcaaatacttttattttgtccaatgattgagctaaaattagaatgaggatttgtttccagttcccccacttatccctcatagtctctctctctctctctctgtttctcttgttctctctttctgctctcttcccttcctcgtttccttctcctacccagcacccatagtctctgatatgatttggatgtgtcccctctaaatatcatgttgaaatgtaatctccaattctggaggcagggccgggtgaggggtgactggatcacaggggcagatccagtggatggcttagcaccatccccttggtaacgagtgctttctatttgtgagttcacgcaagatctggttgtttagaagtgtgtggtaccttccctgctctctttcttgctcctgctcttgccatgtgaagtgcctgctccctcttcaccttccaccttaggtaaaagcttccttgaggcttccccagaagctgagcaggtgccggtgccatgcttgtacacagcctgcggaaccatgagtcaaataaatgtcttttatttctttataaattacctggtcacaggtattactttatagcaatatgaaaacagccaaacacagcctccaagcctttggaagacttttcttaacttacatatggctgattaacagaataaaacttggaaggaatatttgtaaccttcatgttggcagttcaaatgtcactttctcctttccttcccacctccatccctttctctcccctccaccactctcatcccatgtttattatttttctttagtttttatttttatttttttaagagatggggtcttgctctgtcacccaggctggagttcagtggcacaatcttagctctctgcagccttaaactgctggactcaagctatcctctcacctcagcttaccaagtagctggaactataggcgtgttccaccattcacagcttccccacccccccccaccctcacccccctataaagacaagatctttctttgttgccatggctggtctcaaactcctggcttcaagtgatcctctagtctcagcctcccaaaagtgctaggattacaggtgtgagccaccacacccaacctagtcttcaatcttggttttactctctctcaaattttaaaggaccacatattctttgcagccccttttgtcaagaacgggaatttatttccacatccttttagtctgggctggttctatgactttcagtggaaatgatcttgcaatttccaaaaagacctcattctcaaccttttggtactttgagattgcctgctctcaggaagcctgctctggctttctttttgaggctgaaatgccacatagagaaaagcccagccatcccagctgacctacctgcacaggactgctcattacacagtacaagcaagaccagcagaagaaccaccacaccattcacaaattcatggtttttttttaaaccactaaacttggttggggggggtgtatgctgtgaacgcatgcataactgaaagactccattttcagtgtctcattttcttttactcctcctctctcttttcccccatagtttaaaatgccctgtgctaccaatgctacagacatttgtctagtcataagagttcccttaggtttatttatttgcctttggcaaatcattttttttcaatgagtaacacagcacttgaccaggaccccatgaattcatttaaattttcaacgagacagatgaaggcaatcattctttttcacttatagataagaagaaaaatagttaagtggcaatatttgtgtgtttgtatatgtgtgcatatggatgcacatgcacacactttttattatagctacaaggactttatgtactaaaatgtagaagtcctaactacaagagagatgtatagacacacgggaatggatgactcagctggtaaacagaagatcagaaactgctgtatctttcacatttttctataaacattacagatagaataagatcacttgccagaatggagaaaatcacatcaaatcagcccagcaaatattcaaggcaggaaaattaaggcaatgcccaatgttcccatagtgttatagataagctttataatggttacaatgaaaaaaaaaagattaatcagaattcctcaaaatcactttaagttctgaaggacgtttgtggaatacctttccaaaaattgaggactgataatcccccacaaaaggcaaatttgattttacagtaggttttcaaaatctctattgccatttgatcatacggtatacacatatttcataatgtaatgcccccagtaatccaattccttccccatctctccttatctcccttcccactctttagtgtggccttggtttatctcaaatatgctcagtccacacaaagggccatctcctggtcatcatccaagtctcttccttcatggtgctgaatcaaagaggccgtcttcaaacaccatatctaatggtgcctgttgcccaaattagtgtgttaaatattaatctgatacactattttacataacacatatcattagctgaaattaccttgcattttaatttgttgacttatttattatttatttccctccaactaaattaatagtttatgagatcaaggaccttcctttccatactcactattatgtccttagtatctagaacatatgtgtttgttgcatgaactggacaaatgaactagatatagaaagtgcaaagttgatctaccagccaggctaaagtatttaatcccacgtaatttcttcctgacacataatttggaatctcttgcttttctgtcaacatcagtactccaaaaagaaagctaaattttgatatgggcctaatgaaactttttaaattgtatctattgtgtggaacacaatttaattcaaaagctaaatatatattctatatgtttaaatgtatttattatatttatcacatgtcagaacatgagatacctgcacttctccatcagtaggggtaattgagacctgactgtgtgtagcaatcttggaatcatggcctccagctaaaaacttacatctgaggctaaatactaaaggtactgtttgccttgtgtcagcagatccaccatattactttgaaaatgcaccacccttccctacagtgcacagtatacttataaagatgtatgatatgatctgtttcccactgggaagaaatggtttgtaggacaaaaagagctgctgtgagtgagtcagaaagcatgcatcttctgtaaaactgaaatgcctcgctccatgaagcacagagaattttgtaaaataattcaccggttttccctactgcttaaactttgccattttattagcagcttaatgagtaatacaaaaaatgtcctgtataggtaaaagttacaacattaggatgcctgaataaagaaaacacacgcactggtgtaactaattttttctaaattttaaatggtagaggaaaatttttcaacaccttaattttaaaaaatttgcactattgtttgctaaagattatttggtcaatgactagcaagagtcaaattactttgaaagttaagatttgttataagatataaatacccaaggaaaaaaacctatggttctctattatattgcacactttagcagaacacaaattgcctgacattcatctccagatatgtgctgcttccaaatctctgtaacttctttactctcctatgaaagagatcagcatggggaaaagaagaaaataaagtgcatatttacaaagataggtatttcaatttcatttatagtttaagaaaacattacaactagtgatatatgaaccttgttcatccacttatttttcacctttcttgaattttactgcagctaagaaggaaaatataaggttattttagttgctatatatcaacataactattccttaggcaaaataaaaatttaaatacaatcttctgtgcctttagttttaaaataaacattttaaactgggaaatggttcaaattgtatggttggacaccaaagatcaatggcagcagttttggttcataacatacaagtcaatgagctgaattttgagggcatagagggcagggggttagagggtccttgcaagcaatagggtagtgaggtcatcagatcaatggacaaagcaggaagttccttgcatccagagtaagtggttttgattgcatcatgtaggccagaggggatatgggatatgtattttataaaactggttaataagcaaacttaattcagtatgttcaaataagtagtcaatggctatctgaatacttaaaagaggttaatactcttgtgtatattagaaatggcctaatccagccccacaggaaaagtgttcataatatgataaaagcaagcattgtggtaatactttgaattgcatcacagccatttttttttctgataaacttacatttattgttttttcctaataataaaaaatacaaagctctaaaagacttgtcattatttaaattactatgattttcttttacatttccatgaccacaatgtcactggtaatggtttgagagacataatgtaagcccaataaaataacagtttaatctccattgagtaatacctttaactcatggtgggaaagatatcactgaatgatgcatagcatgtatcatttctcatagacactggcttaggaataagcacaagtagttcctcgtgaattgcgcatcttttattaagacttttccacttttttctggacagaactgtgagaaacaaataatcctaattatgtaacatgatcctcagacagacatcagtaaggcaacttatatgtcaacttttgtgtaggtcccactaaatccatacattcttgcaaaaatatttgagagcatatgatgttcacgagaaaattctaagtgaggctcgtagggaagaacattcaaacaaagggaataacaaatacaaataaaaaggctgtgaaatgggtgaatgcacgtccatatatgaagaacactgagcagaaagtccaggtggctatattagtaggagataggcactgtaaaaaggaaattcagaggcaacaagggcctgatcatatagaactgctatgccactgtaaagatctttggcttttctctgaataagacaaggagtcactggaaagttctaagcagctgaaagatgtaaaagtaagttttaaaagaatcactctggctgctgtactgaaaacagactggaggggcacagggaagaagcaggagactagttaggatcttgtctgtgattcagttgacaggtgatgacatgtgacttggatgagggtagtagcagagaaaccggctggattctggatatttgtagaagcagaactatgctgacaggttggaatttggtctggagagaaaaaagggagtcaaggtttttgacctgagcaactaaaagaatgaatttatcacttactgagaaaaaaacaaaagtctagaagagcaggtccagtgagggaaaatcaggcattcagttctttttttatttttatcttttttatttttccataggttattggggtgcaggtggtatttggttacatgagtaagttctttagtggtgattggtgaggttttggagcacccatcacccaagcagtatacgctgcacagtatttgttgtcttttatccctcacctccctcctactcgtcttctcaagtccccaaagttcattgtattgtatcattcttatgcttttgcgtcctcatagcttagctgaaacatatctgtgagaacatacaatgtttggttttccattcctgagttacttcacatagaataatagtctccactcttatccaggtcactgtaaatgctgtcaattcattccttttctatggctgagtagtattccatcatatatatatatatatatatatatatatatatatataagtttctttatctacttgttgattgatgggcatttgggttggttccatgattttgcaattgtgaattgtgctgctataaaaatgtgtgtgctagtatcttttttgtataatggcttcttttcctctgggtagatacccagtagtgggattgctggatcaaatggtagttctactttcagctctttaaggaatctccacactgttttccatagtggctgtagtagtttccattcccaccagcagtgtagaagtgttccccaatcaccgcatccacatcaacatctaggatcagatggattcacagcagaattctaccagacattcaatgaagaattgctaccaatcctattgacactattccacaagacagagacagagggaaccctccctaattcattctatgaagccagcatcaccctaatgctaaaaccaggaaaggatacaaccaaaaaagaaaactactgactgatatccctgatgaacatagatgctaaaatccttaacacaatactagctaacggaatccaccatgatcaagtgggtttcataccagggaagtcaataaatgtgatgcaccatataaacagaattaaaaacaaaaatcacatgatcatctcaatagatgcagaaaaagcattccataaaatccagcaccctttatgattaaaactctcagcaaaatcggcataaaagggatatacctcaatgtaataaaagtcatctatgacaaactcactaccaacataatactgaatggggaaaagctgaaagcattccctctgagaactggaacaagataagatgtccactctcaccactcctcttcaacatagtactggaagtcctagccagagtaatcagacaagagaaagtaagggcatccaaactggtaaagaggaagtcaaactgtcacagtttgctgatgatatgatcgtttatcgtgaaaaccctaatgactcttccagaaagctcctagaataaaataattgagcaaagtttccggatacaagactaacgtacaaaaatcagtagttctcctatacaccaacagcaaccaagcggagaatcaaatcaagaactcaaccccttttacaatagctaaaaacaaacaaacaacaacaacaacaacaacaacaaaaacttaggaatatacctaaccaaggaggtgtaagacctccacaaggaaaactataaaacactcctgaaagaaataatagatgacacaaacaaatggaaacacatcccatgctcatggatggggagaatcaatattgtgaaggacggggagaatcaatatggtgaaaataaccatactgccaaagccaatctacaaattcaatgcaatccccatcaaaataccaccataattcttcacagaattagaaaaaaactattctaaaattcatatgaaaccaaaaaagagcccgcatagccaaagcaagacaaagcaaaaaggacaaatctgagggcatcacactacctgatttcaaactatactataaggccacagtcaccaaaacagcatggtactggtataaaaataggcacataggccaatggaacagaatagagaacccagaagtaaacccaaatacttacagccaactgatctttgacaaagcaaaaaaaacataaagtggaaaaaggacagcctattcaaaaatggtgctgggataattggcaagtcacaggtaggagaatgaaactggatcctcatctctcaccttatataaaaatcacctcaatatggattaaggacttaaacctaagacctgaaactataaaaattctagaaaattacattggaaaaacccttctaaacattggcttaggcaaagatttcatgaccaagaacccaaaagcaaatgcaataaaaacaaagataaatagctgggacttaattaacctaaagagcttttgcatggcaaaaggaacagtcagcagagtaaacagacaacccacagagtgggagaaaatcttcactatatatatatttgacaagggactaatacccagaatcgacaacaaactcaaaaaaaatcagcaaaaaaacaaacaatcctatcgaaaagttggctaaggacaagaagagacaattctcaaaagaagatatacaaatggccaacaaacatgagaaaatactcaacatcactaatgaccagggaaatgccaatcaaaaccacaatgtgatatcactttactcctgccaaaatggccataatcaaaaaataaaaaaacagtaggcattcagttctgatgttacgtttgagatgttcccaatcttaagtgcttggaaagccacatgccaaacaaagcatagtagagccaatgaaaataacaggattatctgggatgtagtgcatattgatcaagcactttattggccaacagtataacataacacatcaaaaagcaattatggggagcaacagcagagtaactcacctatgtgaagcacttgctcagtaaacagagaaacactaaaacctattactttccaagagtggaaagttgtgtttagcaaggcagagataccacagaatcacaagtttaaaaaattatttgggactcaaacaaaatgtttagtgggaagaaactccggctatcttatctggcaatacttcgcaagtttccaaatgaatgctgaatccaagaaatatgatttccctattctgtacccaaattctactttatcactgcattcaccaaattatatttcaaatgtgatagatagatagatagacagatagatagatagatagatagatagatagatagatagatagatagatcttctgtgttttattcattgctgtcatctggcataaagtgtgacaccccacagtcacagtataaaagcttattcaatagaattcatgtaatttaggaggttacatatactcatggaaaaactaccaatctaaaataataagttgttatgtttctaatacttcaaaatgtttttttcaaatacaagctttaacaacaataacaaaaacttgagtcatataactttcttaagctgctcaaagttctggatgtcgaaggttagaacctccgtcatctcaattttaaattttattagtattccaaggtgatctgtctttcaacttctcaaacagcatttataacgtaattttttaaattactggctatgagaaactatttgggtatgcttctataccttctccaagcaatttgccgctgttggtactctttaaaagctatctatactttgtttttttcccacaagaggtgctaaaatagcatttctataggaaatgtgttatatacaagaaattaagtgtactttatacatattccaccaggtaaaaatacacagaataaaattcatatctattttaaaatatggtacttattgataaggcaaatgtgctccagttatctaaacctgacgatacttaaaagctgatcaagtttattagcaggacctaatatttccccttcctcacctctccaacactttagcatcctctggagacctactgataccatattttctttcccttattgcgggtattgaaaaccgaagttagagaagaatctcagaaagccgttcacattgagttttaagcaccttccaaacaccagccattgtgatcattgttatagttttctcatttctttttcataccaactctgaagtaactaccattaccttattttcctgtagagataattgaggagaccttagggtataaataatttccctgtggccactcagccagctactggcaagggtcaactccagctctgtgtgaccccaaaagccccgttgttcattagactgcaaactgctgaaaacatatcctattcaaatgaattctacatctgaacacattagcaaagttttaaacaaaagaaataaaacaagctgcaaggtagacttcagacatttaccagaagaggggaatgcatattttggggaggaagttctgaatctactatttgcaggcaactttacttcatttatctctctctctctctctctctcacacacacacacacacacacacacacgcacacgcacacccaccaaccatcccagaaataaacaaatcctgaacttgcagaaatattatttattgtgaaagagagattcacttcatattatgagggctgaaaacacccaaacaatctaggatatggatttaatatgttatctgcacatacatttatatatagctatcctgatttcctttgtgaatgatacatatctgtcctatcaacattcatcacacgtgatgacaatgtaattttctttgctggtaaaagatttcatgtggttaacttttcatgtcacactaaaaataaacccccattcacttattaaaaattttacctatacttttatatgaactattttaaatttctttcatcagttatgaacacatttaaaacatctttgcaatatttggagttgtgttaaatatggctactatgtagctctattggaggggttgacaacagaatttgtgccattctagaagaaatttatatagattatttagaagttatgataaacttttcccggacaaaaatcaattttccccataaaaaatgttgtttaaatttgcccagagattggttattcttgttttcttttttctttttttttttttttttgacagtgtctcaaaaaaaaaaaaaagtggtgcaatggtgcgatctcagctcactgcaacctctgcctcctgggttcagatggttctcttgcctcagcctcccgagtagcttgggttacaggcacctgccatcatgttgcgctaatttttttattttttgaagagacagggtttcaccatgttactcaggctggtctcaaactcctgacttcaagtgatccacccacctttggctcccaaaatgctgggattacaggcatgagccatcgcatccggccactttttcaccttttaaatcaatgatttctctcagatgcatttcattcagttttatagagcagaagcctacctctcttacacccaatactggccttccattaatgttatttccacactcgtgctaactcacagataaattatagattaattttaatacaacatgcttccatgaagccatataaattagaagtgttcaccaatgagtgattcttaaaaatggctagagattttaaaaaggccaagtttcctgatttaaaaccctccagtgggacaaagatctaaatcgctatctgatcagataaaacctctactgaagaaaagggaaaatgagaagtgtagcaatttgtatgcatctcagatttaaaccaattccacattgtaagatgttaaggtacatgtttccagggcctagtaattacataatttctctatctcttacttttctcttctataatatggtgccaataatagtacccacttcaggtggggtttggatttttagaatattgtatctattaaggatttggctctgtatctggtacacagtaaatgttccataagtttaactttattattagtatttggcagtcacaaagtagattctataattggtgggcttagtaagcacctatttgctttatttttttctcgggtagaattcattatttaatttaaaaaaatcctatagcaaatttgattcatattcctgatgtggtattattattattattatttgcctttatattctttctcatagatgtatggccataaaaaagacaaacacatttattttatttgccttgacctcctgagcaacagatgttgaattaataaaaaaagattcagaaaatttaaaaataacattttagtggtgcttttaatttccaccaaaatagtgattttaaccattctataataacattttactaaaaatcaatataaaatttgaaattcatgaacatattaagagtaattccagttatacagatcaatggctatgttaagcattgagggactgaccaagataaatgtaaagtgtatgattctagcccaagcccacatacacaacaatgtttcacagtatagtagcctggtgtagttaaaagtctgaaatgcggaatgtgcaagtctacactaagtagaatagtaactgggcttttccaatatcctaagccagttctcagtggagatatttacagggactgcagttgaattaggtcagttagacagaggatagaaggaagaggacaaatgcacattgacacagtcccccagatattctaataggcaatcctaaagcctcaatctcatttatcaccagcttaggtgagaactattaggtttcaaaggggtctaataaataacaaacctcttccccacctcaccgtgattattaataaagtggaaattgtaaagtatgactgaaatctgtgagcaaatgggatgcctgatactgaccccagaactgagtggactgaccatgtccattcagcactgacacactggaacaatctgagcctgagcccttcaatggggtctttggcactagcatgggtggggctggaaatactaaagggggaggccttgttcctccttccaatctctccaagaacaaaagttactccacgtctcctgggaggaatgagtaggagcgagagaaagtgaggaagagagatcaggaccacaaaatctcagcataagaccaataagcactgtgagtttcagtgctataactaaaatacatttgactctgaattttgaagcagacagtaaaatatgaagggccattactgtcaaatttgacaggagaaccaaagtaagtgtctgcacattgtctgctcctcctctgatacgctgctaaaatttccagactactttgttcctggcagtaaactctaaattagccaattagaagagatacgttaacagtgtctgcttatgcatttatgctacttatataatttgtaagataattgttgttttattattgttctaggtattgggttaaaatgccaaaaaaagaagaagacctaaattttataatgatgttaacttctccttcctcattacttacctgccagtacagttttggagcacgtacttctttatctcagacaccttttgcttgaggcctgtcttgagtttccaaacgctcttctatatgcttctcctgtgaattactgggtctgctttaagcacaaagtaatgggccaaatggttccttaggctacttttagaagttgtcacacacaaaagggacaactgaaatctcactaatttctaaagtttgcacctaagaaagcataacataaaaatagaacaattttttagataatggactataaatgcattttccatatttgtatgagctcatatataaaatgttcacaagatacatttgtccaaaaacattagaaatatgacatgaatcagttaaaactgagctatatactaggtagtcactaatcatatgtgactatttaaattaaaattaattaaaattaaacaaaagtaaaaatttacttcctcattcttactagcctcatatcaagtgctcaaaaaccaaatgtggttagcaactgtcctattggacagcacaaatataaaacatctccatcactcacgtatgttctaccggacagcaatgattttagagcaccactgttggtatgatcttgttactaaataaagaactttaagggattcaactcatatgcctacaaaagatctaacagtctcatatatagtgaagagtagaatattctggtaaactgggtgaataataaagcatttctaagatcacttaaattgtattagtcttttttttttttttgagacggaggctcgctctgtcgcctaggctggagtgcagtggcccaatttcggctcactgcaacctctgcctcccaggttcaagcgattctctgcctcagcctcccgagtggctgggattacaggtgcccaccaccacacctggctaatttttgtatttttagtagagacagggttcaccatgttggccaggctgctcttgaactcctgaccccaggtgatccacccacctcggcctcccaaagtgctgggattacaagtgtgaatcaccgcacccggcctattagtcctttttaaatgaaaaactggtgagcttgcatgctgctgtcaagtcagtacagttttaaaaaacaatttctgcactaaacctaccagcttgctacagttcttaggtctcatatagtttctttattaactgtctcctaacacaatttctttatggatgtcttacaaaaccataactgagttgcttggtaaactaatttatatttattgctttttccttaggttacatgcatattatttatatatttgcctatagcatattatgtgcaaactaaatagtatacgtagaccaagatggagacagaggcagcttgaagaacaatgtaattggggaatggtgggtaaattcatgttcactgtacataaatgagtggattaataaaagatttatattaaaaaatgccagtacttagaaaaaacccaaacagcttcttaataaataactttttaattaaaaagttttcaatataagctgaatctgagagtctgaattcagctaagaattcactggttttgcatctcttagctacatcctatcagtgttcaataggggtgaaaatggcaaaactcagagcaattttgagaaacataattatcatcattatggccaaaagggagacaaggataaacatatgcataaatacaaataactgtactagcttgagatgctgcttctaatcaagcaaaatgctccactcataaattgtatcacagtcagtcttaaatatcattccgatgcctataaagtagtgaggacctatcttggtgcactttttgcagatgcaaaattcagaatgaaagataagtgaattctatgaaagttggtaggcattgtacctccatttctgtttatctgttccttttgccaagtgtccatctgcatgctcctcattatcaaaagcctacctgtccatcaagtctgtgtggatgtctatctggatgtttcaatcatcccctactccctgaatgtgacccgtcctttctcaagactctctaaaactctctacttcaatttttcttactgcaatacatgttaagttctctaaatgtgttacaagaaggcactgtatgtcgctcatttttgcaatttttctgaatgccgcatctaatattttattttatctaccttgcatttcttctttgcatttacttttctacaatgtctattctagtacttttaactggccacaaaattacaaatgtccgtaagcttggaacatgaacgaaattagattgagtttaaaagcaaaaacaaaaaaactaagccatgatgacgcaaaataacacagctttggatccatgcagacttgagctgaaattccagtaccacaacttagtagactttagagttttccaaattttctcttcaaagcaatcacagaaaagggccacacatacaaggcacactggagggaataaaaaagcctttcatggtggtcagatgtgacccatccagggactctagcttccgcaggcctcttttttttttgttataggttgaaaggatggaagaatcaaggttttgatacacagccctgaagtacaaatctctaggttataatgattttgatacattgatataatagcatctctgagcctcagtttaattacacacacacacacacacacacacacacacacacagatacattatctacaaaactgctaatatgattggaaacaatgtctataccgcacctagcattgtgttagatactactaactagacaatcataaatagtaactaataattttactgcccaataataatattccaaatataaaccacatgaataaaaattgtactctttatggtacagtagttagctgcgtcatcatcacaatgaggtgggctgctaacaaagaaatggatagcttatttttttgaatgaattagcaaacagctttaagtacattaaaactaatactaataatttcacaggtaagtcaaagtcttcatacatcaagtgaagggtggaagtagccatgactcagaactgtgtattcagtcagaaagcatctgaggaggcagataaagggcacagtgacacatctctccagctttcggatggcaaacatggaatctcagaatgaccaagccttaagggctttcaagggagcacgtagcacaactcacagatgagtaggtaattccctgtactcacaggtcaagcataaggagctatattgctctttttgattctggtactgacgttttaaaaggctgtgaattttatgttttgtttcctttgacaaactcagtcatccagttggacacttttcaccacagacaatatctgaataggtttttaacactgattctaaatgcgattgaaatttaacttattacttagatatccagggctgctctactcttggcagtggagcctgactgactcacagattgatctgttgttgtcctcatcccagcacacagccatccacttgattccgatggctcaaactttccttcacatcttggccaccaaagaggctccaatgaaaggttcacaggaagctcttggctaggagcacacataatccctggcttaatgccggcatacattaaatctgaagttaaatattgaaggatggatatgaggacctaaccatgcatgtaatatgaaaaccaaggcatcgaattgatgctacattttagaaataaaggaatgctcaatggcaacagaatattttatcaaactatgaatcactgtttctgattcaagaatacattaataactgagtttttgaatgacagcaataactagcagtcatgacactgtgtggcctgtgccaggacacatggaacaaaatgatatatagtggacaccactgtgatattgttaacatatataaagatactcttagaaaattgttgtttagacgaaatctttggcaaatgcaagttaaaactttcttcaatttgaattccaaatttttaaatcataaagatttgattacacgtgaatactttccatctaataatagatgtatattgtagatgcgtacaaatatacttcttcaaatactgatgagagggcaggataacctaattgtttccctaattgggccataaactttgcccccaaattttgtctattccaatttccaaattataaaattagcttatacactgcccttcagagtatcaacaatttttaaataagattaagaatctggttgccattgtatggctcaaatacagtataaagctttgagggaagaagagagaaattgaaagaatgggctttcagtcttttggaatagcaaacctgaactttccccagcagtaaatgattgggtatctgtgttcaccgtgactgggtcaggctggctgaggcacaacggcacaacatcactttaattaagacaaggtaaagcatgagttggcaaaattgcccactatttgtcacctgaagtccaattacgactgtaatcactgagcatctccaatgctgaaaattagatccagccatttacctgtaatatacttcaacataacaaatatttggagattacttaaacagagcaaatcctttgaaattttggtcaccctccttccgctggccaaattaatgatctttatgcctgaatacatgcatttggcattactgagcactctcattaactcccaccactcatattcttgcatattagaacttgattttccttttatttacaattccaagtcccttcacaaattcttgaaccctatattaaatacagttaaggtctagtctttaggaattactattctcccttcttctttccatgccacttttcttaatactcaaacatgcatgggagattctgcccaacctccctcatctttttttactgtttcttaaaaaaaaattttttttttagagacatggacttgctctattgcccaggctggactggagctcctgggttcaaatgatcctcccacgccagcctcctgagtagctaggactacaagagctcaccactgtgattggcttcccactccttaataatacattcttgcctcttttcatgtaattctcttgatcatgcccccagagcaaacagcatctcttcataagtataacacatcaaaacatgggcattaggagtggccatgtgatttcctctggccagcaaaatgtgagcagggatgatgttaactgtttctgccacttctttcttttccttctgacacaagaatgtcaagtcctactgtggtctgaatgttggtaacccctaagaaggactaagacatatcttgagtaggggctgctcattctgtttagttcccaaagtgaagaagacacagagcagaatcccagctgaaccacagccaacatacgttgtaagcgaaaaataagtttttattgttctaaacaactgaaattctgggattatgtcaccagagcatgatgtagagaaaactaatacattattacataggaattaacatgtaatgttggttaaacatagtgatgattaaatgagataatgggcatggtgataagcactgtgcttgtaacatagtaagtattaaattcatatgagctattataacatattccacatatatctgtttcattttctaacatccttcaaagaacaaaactatgtgttttataaattcctgatatgcctagaagagtgacagttacttaataaatacatattgcattaagtcaaagttaaaggtaacgaaaaggtaacctgaagagagccacaaaagagagaagaagaagatttggagggggatgggagaatgaatgacatcactattttttactcaataaatatttattgaacacttaactatgagtcagacacagtgataggcattaaggagacaactgtgaagggggcaattctgccttcattgagttagagaaatcatgaaaaggaagcagcaattataaggatatgtgtcctccagtgtgagaaaacacattgacttggatcaaggacattttcctcaggttgtaacctcaagaataaatgggaggtgtgtagatgaagtagacaaagttgatatggaaagaatgtttcaggtagagcagacagctgatgatgatttcccagtgaaaacaaataacaccatctgttgtcaattaaaggtggtgggggacgaaagctgatctttaggaagttgcatgaggtctgatgcagccactacagaaaataagtagggaaactgacccatggatgcggaaatcttctaggtgttgttgctagcctgttgtaaaatgtcatcagaatggcatgaatcttcagagttgggcgattttctatggcaacactaggattggtcatagtcatggggaagtagataggtggcttgttccagagtagcttctgatgccagatggttgcactgaagccaaccaggaaatgaattgtggatgttgaccagggtgtagctgtcattgtggactattctatctaagtcaggaaaattaaaggatggtggtgagggtgtggtagggtttgaatgcatccctaaagttcacgtattggaaaaaaatccccaacgcaatagtgttgagaagtgggactattcagaggcaattagatcaagagggctctgccttcatgaatggattaatgccaatatctcaggcatgggtttgttattgaaggagtgggttcctgataaaacgatgagttcagtccccttccactctctctcacacatgcttttttgcctgtccacccttccaccatgggatgatgcaacaagaaggccctcactagatgccagcaccttgatattggacttctcatcctccaaaactgtgagacataaatttcttttctacatagattaaccagtctgtgatattccattgcagcaacaaaaactgaactaagacaggatgtttctactgacaagaaactataaaagctgaagtttcaagggactggtggtctcaatgaaactaatgcatagatttttttaaaaaattaggtcacatacaatatctaatgcagtactgtcagcctatatcatcaggatatattaaatacttctctctgtgaaccagcagaggcaggcatgtcttaagtgatctaagggggtattactactttatttgcatagcacttccctttatttcaaatgctttcccattcatcataaacacctcatttaattgtcattacaattgtgtgagttacagaaaaccagtattaatatcctcattttataactgaaaaaaaaaatattgaggcttgagcaaattttaacacttgcctaaaatcccaatgtgagtttgtaatggattataattaaaacccaaactattacccctttgatgtgtgccacttaaacaatctatgcagaaaagtcagaagcattagctggttatctatatggcaaaacccaagtatatactgaaattatccatcacttcaaacaaattcttttgtttaattcccaaaccaaagaacaatggccgacttcttctggtaatctcagtgagaaaaatgttcagctacattgtatgctcaggaggttattaatctatgttagccttaccatccccttttttgaggcactgattttcctttaatgtctacccatataagtattgttttaatttaatcattgtaatttgtaaaatatgtgctcacaacgtagtaaggttgaaggtcctcgttccttttgtctgataaatctttttctaggccgggtgcggtagctcacgcctgtaatcccagcactttgaaaggccgaggcgggcggatcacctgaggtcaggagttcaagaccagcatggccaacacagtgaaatcccgtctctactcaaaacacaaaaattagccaggcatggtggcggccatctgtaatcccagctattcaggaggctgaggcaggacaatcgtttgaacctaggaggtggaggttgcagcgagctgagatcacagcaccgcactccagcctgggcaagagaacgagactccatctcaaataagtaaacaaacaaacaaacaaataaataaatgataactcttttctatttacccatgagaaaacaactatacattttatcaaactgtaaggatataaatagagccaaagggttggttccagaacctgaatataaatgaatattcttatatctaatcagttttttttaagctccaggctgtaagatagatggcaaataatttccctatatgcttctaattttaaattaaaattgaggtcactgaaatggtagaagtcaaaaccaatttagttcctttgatctcaacctagggaaacataacatttctgcttatcttcttcataacaagaaatgcttctcagataaaaactgtagtacatagaaataaagagactgtatgtcaggcaccccattaaactctgcaaatgcaggataagtgaattttgaatatatgattttaatctttgcccatatagatatttctattagtatcataattaaatggaaccttcatttagacttggttctactattcacttgacatctaaattttaaaaaaatcactgaaactctcatttttaaagttttatgttgtagaatgctgcaatatatatgccctgaccaacttacaggccctaaaaattaaacagtttgccctagattgtataggtagtaagtgacaaatctatggttccttttacacaacaggttacagtatagttgtttctgtgacaagtttttatttatcttggaatgcttttctttagcatactgtaagggcctctattaaaagttggtcaaacttcttagatctgcagtgagagaaatgataaaggacacagatgatcctaaacaatgtttatgcaaaaacaaaaaaaaaagtatgtcatttaacttcagaatacaagattctttactaaaatatttatataacaatgttttacttagtctcctattaaaacttatattaaattgtacctgctactcacataccaatgctgatgctcacaatatcaccctaacagcaatgttacacaaaattcatatttgtattttcagtctaaaatagggtaactgtggtttccaactatcaaaattgccccatgactttggattatcaaataaaactggcaaataaaaatagacatataaagattcacatgaaacatttttagattctgttcctcaatctttattttcagtgtctcaaaataagccgcctttatttattatctggattactgaaatgtctgtctaaccatttccctacgtcaagtcttaccaatcactcttcaaactttatttctcaggactaacaaagttatctttctaatatgctcattaggctgatggtcatttttctgctttaaagccttcattagtgctttagttttcagaaaaaaggaaaaattcttaaccttaatctcaggagcccaatgacttagcctttgccctctcttttgccccatgttcttttgctatctttatacagctaattattctaagtggaacctcaggacaccagacagagtttccagtctctgttaattccaagttactgttttcctagacctagaatcctttgcttcccatcaatggtacagtgagactcactcatacttaagtctctgctcaagcatggcattgaccctctgtttgattagatgccctcttgggtggtcttactgcatcctctgaatatttgcattctatctatcaacaatctaggctgaatccattttctacatggcagataggtttttgttttgattttttggtttttttgttttggtaaactaatcatatcattaaaaacagtcaatacttgtctcctgaattctggacaacagccgccttaggctctacctgagatagtccggcttaagtcttcagccttacctgcctggcaacattcttcttcctgtccgctacactgtgaggtgacagccagctggcagccctcacagccctccttcgctctcggcgcctcctcggctttggcactcactctggccgcgcttgaggagcccttcagcccgccgctgcactgtgggagcccctttctgggctggccaaggctggagccggctccctcagcttgcagggaggtgccgacgaagaggcgcaggcgggaatcgggggctgcgcccggcgcttgcgggccagcgcgagttccgggtgggcgtggccttggcgggccccgcactgggagcggccggccagccccgtcggcccgggcggtgaggggcttagcacctgggccagcagctgctgtgttggatttctccccggcccttagctgcctcccagcgaggcagggctcgggacctgcagcccgccatgcctgagcatcccccaccctctgtgggctcctgcgccgccagagcctcctgacgagcgccgccccctgctccacagcgcccagaaccgcccaagggctgcggagtgcaggcgcacggcgctggactggcaggcagctccacctgcaccccggtgcgggatccactgggtgaattcagctgggctcctgagtttggtggggacttggagaatctttgtgtctagctaagggattgtaaacacaccagtcggcaccgtgtgtctagctcagggtttgtgaatgcaccaatcggcactctgtatctagttcatctggtggggacttggagaacctttatgtctagctaagggattgtaaatacaccaatcagcactctgtatctagctcaaggtttgtaaacacaccaatcagcaccccgtgcctagctcagggtttgtgaatgcaccaattggcactctgtgtctagttaatctggtggggacttggagaacctttatgtctagctaagggattgtgaatgcaccaatcggcactctgcatctagctcaaggtttgtgaatgcaccaactggcactctgtgtctagttaatctggtggggacttggagaacctttatgtccagctaagggattgtgaatgcaccaatcggcactctgcatctagctcaaggtttgtgaatgcaccaatcgcactctgtgtctagctcagggtttgtaaatacaccagtcaacactctgtttctagctaatctagtgggggcctggagaacttttgtgcctagctcagggattgcaaaggcaccaatcagcaccctgtcaaaacggaccaatcagctctttgtaaaacagaccaatcggctctctgtaaaatggaccaatcagcaggatgtgggtagggccggataagagaataaaagcagtctgccccagccagcagtggcaacccgctggggtccccttccacattgtggaagctttgttcttttgttctttgcaataaatcttgctgctgctcactctttgggtccacactgcctttatgagctctaacactcactgtgaaggtctgcagtttcacgcctgagccagcaagaccacgaacccaccagaaggaagaaactccgcacacatccgaacatcagaaggaacgaactccggacacgccacctttaagaactgtaacactcaccgtgagggtccgcggcttcattcttgaagtcagtgagaccaacaacccaccaattccggacacagtaccacctgccatagttttggggttttggtggggtaggtaggtagaaaaggagcgaacctgaactctttaccagctttagcatattctcttcccactgtctcaagttctcttcttccccactcttgccatcacttatctccaggtctcatcttacctgacactttctcagtaattctcctcatccatttttatgcaaattgctcttgcatggcatattttgcttttctttcatagctcctatcaaaatgtgtaattatgggcctatttgcatgactatttgtttcatatctgcctctacatcctccataagttccatgaggtctgagaacacgttggttttgttcaccaccctaaactcaaggcctggcacagtgactggcaccatttggtgcttagaaatatttgtttaatgaatttaaagtctgtttcattaagcttcattattcttgacgaattgtgatttctatgtaactttgtaacactaagaaattgtataatacagaactgcctatagagggttctcactaagtattagattaacaaatgggcaattttcaaagaccaaccaaaactcctaagactaaaactatggtgaacagtactaacctctttttgagtatcaagatatactgaaggaccttgtatttctttagacttacatctcaaggggaaatatgacggatactatgatgcaccagccagactccccttcaagaatgaagatttttttccccccagctggtgtgagagttacagctcactttgtgctacgcttaagcgtagctttagaaagtctcgaaggaaactgctgcgtttgaggactttcctccttgcagggacactcatactccacatatataaaggtcagccccatatcccaacttgagacaaggctgaagagccatcccacctccagaactctccatggagtacacagaggctgtcacaggcactgtagcctcactcaactcctccctgtacccactcctgcttttctgttctttcacttctcttgattctaataaccacacctaacaaacatcctgcatgctaacctccatctcagggcccgcctcacatccagggtatctcttcccattggtgacaagaaaaaaaacattagggttgtatgtgaataaaaacggcttataaataatctgtgtcatatctgtgttgtggggatgtacatgctattattaaataagttactagaaggacagcatatgattcttacaacagcattatattaatagcaattctgattcatttgagctgagtggaggtttacagatatattggtattattgttctggtttttaaaaatttattaactattatggtctgcatttgcctgataaacacaggctaagtaatacattattgaaaacagttgtatgccaaaaaaaggaaatagtggagggcaggcatgccctatttgtgccataccacagcggtttctgtttacctctctgaaaacgggagatcttccatataaaggcattggttcagagagtaagtactggagaatgaagttgtaactagttcagggtaagaagagatgccttatacaaaaggagatacaactgtttgttattaaaataaaggaattattattttgcagccgactagctaaaatgtaacccttattactttctcccttatacattagttatgcatattttatagttaagcaattaaaattaggtgcatcctttcttcctaaaggaataaacattctccttcctctgcagctcattagaaaatgtctactagagaagaaaaggcttcccttgaggcacttgggcttctcaaacattactgtgaacacaaatcacccaaaggatctcattaaaatgcagattctaattccgggggtctgtggtgagccctgagattctgcatgtccaataagcacccaggtgatactgatactgctggtctatggaccacactctgaatagcaaggtataaaagcaaggtataaaaacataacttgtggggagggctcacagaatatgatttagatataaggcagtacttctgatactaaaaaaaaaaaggatgtataccatttttgtgaaggaaaaaatacacacaaacacacacacagcataagtttaaaaaaagtcacacaggcacttaattgttgtacttataaaatgaacacatagacaaaagcctagttagcaatcacttctgcaatatatacctcaaaaagttacatatttttataagtatcggttacatggagcaataaaagtttcaataggttatttttatactatggaaactaaatttttagcttgtaatttgagtatatatgtatgtagtatgtgtctatgtatgtgtataagtgtgtgtgtttgcatcatacacagattcaaattttgtatgtcaaagattatgtaatgcatttcagtgacagataacacaagttgatgatccaaacactttggtttcatgtctgtttcttcagtaaaaatcttactttttgtgcttacagaattatccatacaatacagagactttctttctggaaagaatcctatactttcagttgtctaaatattaaaaacaatggcgatcatcaaaataagccatatgcagctatgcatcctgtaactctgagaatgaattattataatagtacaaaaggaagtaaggacatctagagtatctattctctacctgttgcattccaatgaagtcaatacaactatcccaatgtcctgagtacatagaacagccagatattagaaatgaaacacatttctaagattcttttctatctggatacaaaaaacaacacagtcaatattcattgtgtacttcctatattccagagagtatggtagttgctttacatctctttgctcagctattcctcacagcaacctagtgaggttaagccctgttatccccattttgcaagcaaaacagaaatgctaagaaatccatccttggtcacagagcaagacagctccttttttcctctgaaaagataggtaaaaaatcctcttaatagttctcaaccatggatacacaatgtgatcacctggaaggcttttgcagtagtaattcctagatgctacctcttagagattctaacataaattgtctgatatttggttttcatagccagagctgaaaaccactgttctggagcatttaaataatcttgttctcttctactcccatcagtgtaaccagatgatgacctcatttctcatttctcaaggacagtagatgctatgtaatggacactttctatccacatccccttcctctggcctacactggagagtaatttttgaatcttctcttcccccagcccaaactcctttccaggaacctccctaaatacatttccattgctattttaaaatgattaaatttctcttattttttaaaacaaaaacgaaaagccctctttgtcatcacataacctttcagcccatcctatcccaacaaagccaaatttcttccccaaattatccgtaacggatgacaatatttcctgccactcatacattaccctgttagcctggtttctacctcaactctcaatataatctattcacaccaaaattacttttcacccaatatctctcctatcagtagttgactcttaatattttcctttcccaattgtttattttcattgctgcaacactgcactttccaggctttttctcctatgatttgtaaggtccttcttagtcactttgcaagcttcttgtcttgcacacattgatgcaagacaagggtttctcataatatctaatgcaagcttgtccaacccacaccctgcaggccgcacgtggcccaggacagctttgaatgccgcccatcacaaatttgtaaacttccttaaaacattacgagatttttttaagttttttttttttttagctcatccgctattgttagtgttagtgtattttatgtatgacccaagatgaaggttcttcttccaatgtgtcccaggtgtgccaaaagattggacacctatgcatggacatgaaaccatatgaatactgttatgggatgtaaatcacaaatcctgatgccctgtttaatctttcttgaactgtgcattcatatgtcctactataaattagacatgtctgcagtcacttaatatgtccaagggcaaactcatcatcctcctgcacaaaattttatcatccattttccctatagaaatgaatggtgccatgaattcactcccatcccagaaacatacctgcattcctgaaacctctctcttcctacacaaacatccaatcattgagtccaaaccaatcattaagtctttttaatccttaaatatgtcttcttgatatcatccttactttcccagcctggctgctattatctagtacctaaattactattcctaactgttcccagttttgttcattccctctactccaatacacaaatggtagtcatgagaaacattgtaaaaagcaaactgtaaaaggtcatgtttcttaataaaacttcagtggtcctacagttccctcagaataaagttcaaacttgttatcttaaaagatccttcatgaactgatcattattttcctttatggtcttatagcatgtgattttgtctttcacattaaaagaaacataaataatgaccttcttaattttccttgagtttgtcatgctctttctgtcttctaagacttggcatagtttcttttctttctttttttttgaggggggggctcttcctttccttccttccccaacctctctctccttctgattaacacttcacttatctttcaagttttttttcaacaataaatgctcatacttttaactcggcctgtgtttgaactgggactctatcatttcttacagtgtgaacctgaaggagttgtttaacttctctaatttgcaactacctcctctttaaaatgaggataatggaaatatgttatctcatataactatataaatgttaaatgagataatgcttgtaaagtggttggcatgctgcctggcaaatgttgtcaataaatattattttcatgcacctgggatgctttcattgaccctagaaatgtttttggtcagtatcctaactgcgctcatcatgccccctactgctcctgtcattgttcccattacatggaacgacgatgtctttttttattgttcaaatcttccactatattgaagctcttaagggtcaggactatgcccattttatttgctgctgaattctggacacctgacacagagatgagcccataagaacaccagttaaaccttagttcaataaagagcagggggctttggaattccaaagaactctccaactacacaggctgtgcacttttaaaagctgctcctggaaggaataatcatagtatttgtgcatgtgtaagtgtgtaaattgaaccattcagggataatctctaacactgtttacttttttaaaatgtgagatgttagtttatgttgtaaacactttagtaaacatgtagtataaataaattcataggtaaacatgacaaaactaagtgggcatataagaaaaaacgccaaatttcagtttgaagaattccaatacatcccaaaatactggtatcacatcagtaatttccagtgaactacactgcacattttgcttattttacaaatgctgtgcgaaagttgcagaattctactgatgctgctataaagacaagacaaattttagtttgcagtccactttaaatatatgatagaccatttaccctgggtctaattcttccctgggtctaagcaccttcaaaaatacttcctgtaggttagctaaaggatcctgagttttgtaacataaggattggtgcaaactctattaactgggtccgaaatgtttagatgacaaactccctacattaaaatactataaaggtgaaaggtttgaaaaatagactgtcctttcctaggatgaagtacagaccaaagtgtatgtagccagtaagtggatcctttaagaaagaaaataaagtacatatcttttgggaggtaatttggaaaaatgtttgtatagtttgactcagtaatcctctctcaaggaattcaccttaaatataaaaagaaaaaagccaaatgcaccatttgttgtaattttttgcttagtgtggtatttctcaaaatagaggggaaaaactaaaatctatctagattcaaaatgaattttgtatattatgacacatcaaatgcagcccttaaaattagttatatcataagcacttttcatgttatcataaaatatcatacaaaatatttgatataaactgatttcaattatgtaaaaaattatataatcatatcaagaagtagacaagaaaacaaataatttattagttgtataactgtgtaagctcacttaataaattctgtgtaatatgcatatttttatatgtgtccatttaaaaaaattcctcaaatgtaaaaacacagtcttagaattttattaatgttgtctgttctaaaagaaaaatcgcttgtaaatctggcctccagtaaacaaaactgttttttcttttttagcttttctaagctatattttgtgctacatttttttaaataaaatgatcaactttctatttcatatgcctaaaccataaactttagttagactgattgatcttagtagcagttaatctgacttcatgagttcttgagccccagttcatataggcaaagaatacttttgttttatttactttgtgacaaatgaaaaatctataggatgctaggcaaaaggcttattgctcttagagtcttccatctcaatcattaccatgttcaggttcactaactgaatcactttcaaaagagcacattagtatgaaataaaactatttcaatggcaggctaaaaaatcatagtttaacacttctttaataaactgtgtgacctcaggcaagtgacttaacatctctgtgcttcaaattgttcatctgattattatcatgggtaataataataatacctacccaatagagttgtgctgaacattaaatgtttttatagacagaaaacatttagatcagtaaatggcaggtggtaaacaatatttatgagttgtatcatcgtcactcatttttaatcacagctagtttttatattaaagtactctacaaagcatggcaagaaataaattttatgttgtttttctaagagaaagtccaaggattctgtatctcaaagttttgaccttaagcaggtcacttatttatctgagtatcaggttcatcactaataaaatcagataaatgcctacattatgatttagacatgattaaatgagacatacaacagaattgaatatgatatcatcaatttattctctcctaatttttatatgacctgacgtagtatctaacacagagcagatggtttacaaataataatactttttaaaagtagggataattgtgcgaaaaaaagttgctccagtagacatgaatttaatttataaaaactaacttcaacaggctgaatgccatgagttgtcatcatcccttacatattaaatgtactttgatgccaaagtgctaatacctttctacaaggctagaaaaatatcaatttctgggtacaaaggactgtggccattatctgatttaaatctgtcttcagagaaaacaattaaccccccaaattcaatggtccttaaaatcagaagtgtgaatgttttataatcttgcaactcaaactttcaggaacaataatgctgatttgctgtcaggaaaattattcatgccttgttatcttccagtgagtgtaggtttaatacaagcagtgtgtgaatatcgaagaataaggtggaaaagtattaaattagaaaacataaaaatagacacatcttatgtaagacataatctgagagaacgatggtgagacaataaacttattgacaaaaaacacaggccatttgcaaatcttcattcaaaaagttgtctattttaaaatgctcgagcaactaagaagcagcaggataaatcggaaatttttttcaaaaagctacttagggaataaggcttgccagtaaaggacaaataatttcttacaacatggatatcatatcactacatctgatctttttatggttatataatactttcaaacactttgatccccccagactcaaaaactcctaaaacacatatatcttcataaggtataacttgaatttaagcaaaaaaggtaaaagaatattaattttactattaaaagcaacaacttctcagtataactggaaataaactgtgtgaaacctcaaagctgtctaattgtgccttcattcatgcaaatgaagaaggcagtttttgttggtttccaggtttgaattaatcatcagagcaaaatccactaaaattgttgtagctacagaaagctacatcaactgaagatatctagcatccagaagccagcattaataaatgcttgagtgggccgggtgcagtagctcacgcttgtaatcccagcactttggaaggccaaggtgggcagatcacctgaggtcaggagtttgagaccagcctggccaacatggtgaaaccccatctctactaaaaatacaaaaaattagccgggcgtagtggcaggcgcctgtagtcccagctactcaggaggctgaggcaggagaatggcgtgaacccaggagacgaaggttgcagtgagccgagatcgtgccactgcactccagcctgggcgacagagcgagactccgtctcaaaaaaaaaaaaaaaaaaaaaaaaaaaaaatacaaaaattagctgggcatggtggagcgtgcctgtaatcccagctactcgggaggctgaggcaggagaatcacttgaatccgggaaatgaacgttacagtgagctgagatcatgccactgcactccagcctgggtgacagagcgagactctgtctcaaaaaaaaaaaattaaaaaaatgaataaatgtatgcatatacttaaagcagtttaaaaagtgcataagtatttacaatgttttaaacatcataataaatatgtacaccccttttcacatttcaacatataaaacaactttatgagacccgctattttatctgcattttataaataaggacacaagtctcataaaacatacttatggatatgggtatgtatatgaagtggaatgagttgaccaagatcacccagttggctaggggtacaaacaggatacaaatccaagtagaataattcaagcgcttctaactctaaccattatgagatgctggttttgttggttgttaagatacccacagttatttaattttatgaataaactatttaactttggcagcaaattatttaaaataactaaattccgcataaatataagaaaatgaatttgagaggaaaaccactctcctaatagctaagttcctcctgagataatacagccaaattgtcacttaaaataaccagtacaaaaatttagttttaaacaattttccaagaatatcctggtgaaacttcaaggaaataatttttggaggtttaaatatctccccaaaagtttgtaccactcctacctcttaaaaatctaaattctgcatattgtaaatacatgtagctctgcataaaaatgccctcatgtaacatattataagaaataaaaactcatgcgaattcaccatagaaaatgttatccaaattgtaagtgcaagttagtttttagatagtgtcaagtgtcagatttcagatatgatatacgtaatactaaactttagctggtctcatttcattgttcttcttggatgaactttcatgctaattgcacagctctgttcctacactggctttggtgaggcaaactaaaacacactaagattaaatgtctacgctgttacccaaagagatgatatgacacaactctgattcatttgcttactgtctcctttgccaccatcattctcaatcaaatcctgccaggctttgaacatgtgattatagtcttcaaagctacaacagaatcacagaagctggtttaatgatgcctaaagcaaataatttagatgaggcccctgacatccacagtcagaaatactcagtagaaaaggggtccatgctaagtctgtacgtgtccacagaatacacgtgtgcattatgggtgtgtgtgcagatatacgaatgtttacatataaatataaaacccattttgcagttgaaatcaatcaaaataaatttaatttgagcagtaggagtaacaggcagagagaattcaggggaagataataaattagaaacccagttttgctgtgagaaaacttagcaacaacagtacctagagtaatttgtgcacctcaaacaaaaactgcctctccatccttacttttggatggaattaatgccaacattcattaaatgtataccatgtgcaggctctttggaacatgcaattgccagtgttaggtaagaagtaggaattacagatctcccaaacaatttcaccttcatatttattcagcctaatcctgcaccattactccgactaaaattcctgaatagttctggtcgcctctttttctcccatacccctcacccagtactcaaaactgttaagcctctactttcaaaatgcatcatgaatctttgcatcatctcctaccctagtccaaaccacatcatccttccccttaactatggcaagtgccttctaacaggcctctctcatacaggtttaaccctttatagtcaagtctttacccatgcaccaaagcgatccctttaaaacctgtgatagattatttcacatcaccattcagaccctacaattcattattaaaatggtcaagcctcacacaactgggccctggttacctctctggtctcaccttctattactttctctagttctgtgtaatttcttggcattccttgaagataccagacattcacatacattagggtcttggcagtcagcatttcctcaccctgcaatactctaccctaacttcatcacataatttaggtctttgatgaaatgtcacgacagaaagtcttccctggctactttactttaattaggaacctcctgccatttttctttatcttctcatcttattttatatttctttatagcacttatcaccacctgatatgcgtgagtataaaggtgtgtgtatagatatagatataaatttgttgtctattttaccctcttagaatgtaagctccatgtgaacagcgatttatatcttttgaaaatgtcatttgattaaaactttgatgaagaaacatattcactaccgccttaccatgcctcatccgccatgaacttcactctctgaaaaactctgtcccagacatagataaatcctttggctttcctccactttcttcccctttgaatataacagagacagtaattttgtaaaaaattattttgtctaagaaatgagccctccttgcttttacagttactcatgggctccagcatacggtgctttgcatttttgcatcaaagcactacacgttgaatcctgcgcacaagtacgtcataactccttacaaaaggggcacagataacctcttagatttcaaataaaaaatgctatttttattcttcttttatttaagacttttatggcatttcatattgtatactgttctatgtttccatgtgtttcccagttcagctcctaccagaggctgctgcttcccagtctctcattcaaggacctctcctccaacaacaatccgtcaaaatgttaacactgtataagactccacatgtgcctttctgcacagtagaaacactgcctggacaatctcaaatatctatatagcttaaactctcaaatacccattattcacttttccattcttagctccttgagaaaaggggccttaacctgctcattactgcatcactagctttaagcccagtacttggtaaagaatggaaggtaagtatatatctgctgaatgaatgagaactctcaagtaaatgtgtaactctaggtaacatcttgcctttgtttccagaactatagcaagcttcctattagctatgctctcttgactgggagcgtcttcgcacatttaatgcacaacatggtcacaacgtaagtcatatatttctccatctcctctttcctcaccctcaagtttaatgccaaatggtccccttcttggatagtttacatcttgagtcaaggatttgagaatcatttctgctccctgatggtgtatatccagttttcaacttctgaaggttttttcttctaaatgtctcttcagtgagtcttccctcatttaacattgacatgattatgccaattcatgccctcattatttcttacccgatgtactgcaatgacttctgaactgtctttcctgcctccaattttaccccactagtcttccttatggttgctctttattgttgtggttgttggcttttaatggtaaaatcatcatgtcatattcctttctaaaaatttgtggagggatttctgtatcattctagaatgcatataaatcaaatttttagcatatcataaaagccccaaatgttaagaatcctacctcttctttgtacatcttccttgacacttgactgttctctcaccttctaagatccatctactctccaatagttgtcccacttctagtcatccaagtgtcaaaagttgtggcttactgaacatgcttatccctctgcacaaaatatcctcacgtccctcaatatttctgatgcttttacaaagacttaaacataatttcttttaagaagccttcctttctttatgttatcatcaagccctttctgctttctctcatacacaagatcccagtgtaaggctgataaaggcaggagcacttgtttctggttcacagctagtactatagagcttactatgacttgcaccaagaaagtacgtatcaaccatttcccgaataagcaagttcgcaatgatttctttaccttttttttttgttttccctactcaagtagctcctcaatggcaagaagcaatattcatcttcttcccagtgaatgaaacactcattaaattactcatttaattaaaaatacagaagtattcatatgtacacctatacatatgtatgtattcaatgcaaattaagtatgtctcaacttgttatacttgaagtgaagccaagaagtccataggcttgccagggatacagatcattagcttgattcctaaatgaccacgtctggtctaaaggacaaaacaggttccttagtcaagtatatgcaagtctgattccagagcatgatgagttacttcatttacattgtcaactctgcccactgtggacaattgtaatccctgattcaatgagtgtctctagagacatctcaccatttctgtttacatgagtccaggtccaaatgtgactgtaaaaagtagactaatgaaaatactataatgaggatccaagtattagagaaaaagggaaaggagagagaagatccagtgaaagagaggataccaaaaagaaacagcatttgaatagggagttgaatggtggccaggagttcaaaagtccagacgagagccaataagaaatcaaaagaaagattgataagtagtggctatcttctaaaaagctgctatttatcataatgaggatatcaacctcttagaatatattttaggttgaacatttgtgataacacaatttgatattaaataattagaaagttttgctgtaatacctcatctgcatgtaatagctttagctaaggttgtcaggcactgcatataaaatgccatttcagaagtgtattaatttatttagcagttcattcatcaattgaactcatttgatagggaagagatgcaaggataggaatggagaagaggagagcagaggagagtgaaggggaaagaagagaatcagtacaatctgcagatgaaaataagctagaacccaagtggtgaagaatgggaactgggtgttacagtgcttaattacctcattccaaatgtgtaacgtaggaaaaattgtaaagtggggtaaaataaggaggggagaagattctctccctaggggaacttgctcttacagatgtgaactactttatttatgaataaggaatggactctggagacagctctgccacttgttatctcagtagccttcagctatgtacccatttcttactactcagctccctcaccagtaaaatgggaattattttggtacttatctcattggactcttatgagaattaactgaatcagtattcccaaggcacttagaaaagggcgtgatatataaatcagcagtacataactctttatgctgaacaaatatgtatacattttaagacaataaagtgagctcaaaacatgactttgcagcatattaaaaacagacaataacatacatccattgaccattccaaaagagggcttcgagagagctttagttcccacagattatctatcagatacatttggatcaaaaatttacatttctcagcctcacacatattgcttggcaaacactgcttcatatcctaccaagcaaacaaactgtgttcctaaatccatattatatagaagtactagagtcctcaattctaccagccctatctatgtatctatctatctatctatttatcatctatccatctctagatgataatatctgtattaaagcataaacattgtaaattccataacccaacttctgttaactaaaaaaggttaactttgtaaatttagcctctagaagattaataagtggattggtttattcgcatttcatcaagactactccctaataacattttaaacaatccaatataatttatttcttaatgagctggagatagattgggttcaaactccagctgtttatttaagactaatgggacttgggcttaatgtgtctttgcctaattttcctcatatgtcaacaaataaggataacaacagagtattttgtatgtatgtatgtatgtaaggcacttaaaatatcacctggcaaatactaaccactatgtaagcattcgctattagcattactgttgttattctggataaatcacaatgattatattccttccttatactaatgagaaatcacattctattcttaaaggaagagccaaatacataacaggttctgtaaatcttcatttatttttaattctattcataagcaaaaaatttttaaaaggaaaatattttaaagtattacattataccatttttaataaaatgtctatcaaaagttgaaaacatatttaatgagcagcctgttttagcatctatggtgcttcttgtcaatcattttttaaatgatgcagcaatcactaacattcaccatttttggacatgcatatgtaaattaatgatttctctacaccatcagatttgctatatggaaattacctacataaatagcatatggcaatttcttcccaatgattcctagatacccatcccctagtagtagtttaatatgcaagagaatagcatcctagttcctgaaataaaaccttgcatctttctatcaccagccattctcaagtaggaaagcaaagaggcaccaaatgttaacgtacctaacagttcttaatctcttcttaaaaggtctgctgtgtacataaaaaatatcaagaagtcataatttgactgacacattccttatgtaataatcttcatttgatagaataacaaaatgtttttactttttcattttacctgcaaagataaatttaggaacaaccaaggccaggatttttaaatggcatagattctccacttttctttatttaaatagaaaagaaaaatttttgtgagggttactgattaaatcagttcttaaaaatacagtaaaagctaaaagctcattactgagcactctccttgttcagtataatttatatagtgaaaaggaggaaataagacattaaaaggtcattcagtggatcagagtgtagaccaggtgagtttttccacagccaatttgaaattagtttattagagcatctatacgcctactgtaagatatataaagatatgttttcatagaaaaacagtcacttcagtctacatactagaatctggctgtggtaggcagaataatggcccccaaagattcccacactctaatccctaaaagctgtgaatatgttgctttatatggcaaagagaactttgaaaatgtgattacattaaagatcttgagacttaaagattatcttggatcatccaattgggctcaatggaaacacaaagattcttataagatcaacctaagtgtccatggatggacaaaatggataaagaaaatgtgatatatatacaaaatggaatcttaatcataagaaaagattacaatcttgtcatttttgaataaggatgaatctgtaggacatgaagtgaaacaggacagacacagaaagacaaataccacatgatctcactcatatgtgggatctaaaaaagctgcagaagtacacagcagaagagaagttaccagacgctggagagggtaggaaggagagggagaagggaagagattgatccatgggtataaaattatagttaagataggagaaataaattctggtgttctattgcacaacagggtgaagacagttaacaatattgtactgtaaatttgaaaaaaaaaactaggagaggattttgaatgttcttatcataaagaaatgataaatgtatgagatgacggacatgctaaatgccctgatttgatcactacacatgtatatggaaacattacactctactccataaatttatgcaattattatatgtcaattaaaactaaaaataaatcttaaaaatatatatctatcttaaaataataattaggtgggagtttcagagcaggagaaagatttgaaaatgctaccatgttggttttggaaaagaaggaaggggccatgagctaaggaatgcaggcagccactagaagctggaaaaggcaaggaaactgattttcccctagagcctgcagaaaaaatcatagccctacagacagactgattttagccctataagactcatttcagatttctgacttctagaacttaagataacatatttgaatggctttaatccacggaatttgtgggaattcattacagcagcaataagaaactaagacactgtttctctaaaaataatgcagctaccatctttacacaattcttataattcaatcctttttttttttttagagggagtcccgctgtctcccaagctggaggtgcggtggcgcgatatcggctccctgcaagctccgcctcccgggttcacgccattctcctcccgagtagctgggactacaggcgcatgacacctcgcccggctaatttttttgtatttttattagagacggagtttcaccgtgttagccaggatggtctccatctcctgacctcaagatccgcccgcctcgtcctcccaaagtgctgggattacaggcgtgagccaccgcgcccggcccaattcaattcttatgattcacaattcttataaatcttaaaagaaaattcgtataattcttataaaaataattcttataattacaaatattataattacagactgtttcattattatacatttttttaagatttcataaaactagtaccagcactaacaaaaatgcttacaactgatcaaaagaagctctaaccaaaatgtaactatttaacaaaacagattaacaataacacccaatattaaagatgaagaaaactggctgggcgcggtggctcatgcctgtaatcccagcactctgggaagccgaggcgggtggatcacgaggtcagaagatcgagaccatcctggctaacacgatgaaacccagtctctactaaaaatacaaaagaaaaaaaaattagccgggcgtggtggcaggctcctgtagtcccatctacttgggaggctgaggcaggagaatggcatgaactcgggaggcggagcttgcagtgagctgagatcccgccactgcactccagcctgcgcgacagagcaagactccgtctcaaaaaaaaaaaaaaaaaaaggaagaaaatttttctcagtttgactacgtcatgtaaactttcatttttgaaatatactcaatgttaaatacaaagatataaatatatacaatataccaataggttttgcttttttcacttactaatgattgtctaggatagattaccaaactagtttcttaaagcatacttcaagaatccatacaattacttcattaagcttttcatatacatatatgcatgtatatacatacacatatacacatataacatatataatactcatatataatacatatagatgcatatatattatacatataattcttagcagattttcagtttaaattttacttctgaagccaaaatagtggaaaagtgattgaaaatgcatgcttcagagtctttcttctcgggtctggatccttggatccttggtcagccacctactagttgggtgaacttggatatgttatttatcctctctaagcttggtataataatcagtgaagtggggataacagtagtgcattcttcattatggtgtgcagctgagaatgcatatgaaatacttgcccaatcatgagcataatttctatgaataaaagtttttcttatgcatcatttaatgccctacaacccttagcgtaaaatatggcacattctgcacaaatattagatgacaatttaattttagggttgaattttgatcagagccattttatgtaaaatgaaattgtttgtgaatctgtaatttgaaagtgagatttacttgctccttaaatccacactctttagtgtgtgtaaatagtgctttgtgtgattaatatctctgcttcccttgggccaagtttcactcaactatttaggagcattctactgcaccataatttacatgaacatctaagagatagtttattaatgaaatacattgccatgtcttatgaattatgtctgtctatactcaatattgtttggattaatctttagctctatcatcatatatggtattctaatatgtcaaatgttcataaaaataaatgtttgtatccatttgccaaatacgtgtcatgcagattaagtcaggaagattaaaaatactctaagattttaattattcaagcatattttaggtctgctcaaacattttggaggctcaccttacaaaatcaacttcaaaagttttctattaattgcaacatgttatattagattataagcagtaacacacatggcctatttcaaatgaattattcattttattgcactgtatgaatctttgtaatgtcatccttgggatgacttttccttataatagtaggcattaacatcagacacaagctttaaaaaggcaaaaaaaaaatgataatttatgtgaaacacaattccacttctccatttggctcagggactgaatgtcataagatttttcatcctagttgatcaaaacccaactggagacataaaccataaccttttataaacactgtatacaatactgatctcctcttatagaaaaaagtagttcacattacccatgttgatacttaacttattctgtgcagtacagtaatattggggtgggcaggtggcttgccacttttcgcctaccacaaaataacatggaaatattaatacccttatgtccaaaatatatgtgttttatagctgttttaaaagttttagaaggttaaacatgcaatataaaacatgaaatcagctatatacattgtagcatctttgtcattttttctgaattctataaaattattgttataacttatatagatccatttttgaaaagacaaacatttaaggtgacggctatcccaaatacactgatttgatctttacaaattatattaatgtattaaattattacagatgccaccaaaatatgtatatctattatgcatcaataataaataaacaaataaatgcctacaaaacaacaataaactatgactaaccacttcaaattgtgtaggcaaatatctactcacacacacacaacttcaaactttgtttcctgtgaatcttccaatggtttgcctatgtcatactgtgccattttatattgttaagagacatgaatacagattgtcaagtgagacacttctgtttttaatctaggctttcacatttattagttacataacctttcactatttatgcagtctgagacttaacctcttcctctgaattttgggatactattaaagaagtatgttgagaatttttgaaatcaagttctttctatatagtatattctcagtaaatggtattattatgggcatgattataaattcccttatctttccaatgacagtatatgccatttgaagacaaaaaccatttttatagttctttgagtgtttccctcaatgactagaaagtagcctgctatatacataatgtctaataatgatttgctcaaagaacgatcgtaatcaaaaataaatagagggcaataagtgctaaaccataaggcactgaaagataagcacaagcaaagttcagctgcaaagaatatctgagtgggctggtatagtcagagaaagatctatggcagacaggggaccaggaatgggaagtaaaagcctttcataggtagcataagactggataaataaaatcacccaatgttctctgcagaatacatttcagaagcatattttgacctaattgaagtgttcttaaaataaagttcataagaaagtgttcataaaatcacttaactttggaatttcttcatgttgtgttcaacacttctttcttaaaccatatttaaacagatcttctttagaatacaaacagaaatggagaagagataatacatttttacctaaaattatattaacatcaattgtacctacagctatcacattaacacttaaaaatgatggtttatatatgtattctgacctcatgtctagtacctagaggaaataattatttagtaatatcaatacatttttaaatgtctaaaattcatcatataaaatatttgtatactcattaaatgttttaattattatttccatagtcatagtgattaagagtaactttacatttttgccaaaaaacctattgggtatttttttcttcttaataaatgagggagtaaattgcaacttactactggaaaactttcttactgttctattatttagagactgtagcaactgcttaaaagtttatctatagacaaatttaagctaaagcgtttgttcatggatctacccattaattctgtggctccagtaaaataaatgtgttgtgtcaggcaaactgctaagtgctttatgtataaatggcaaacaagtcatagtagttcctgtccttttggtcatccaattttacacattaaacaaatcatttcacaaatttatacagcatagcctgggagaccagcctggccaacagtgaaaccccgtctctaccaaaaatacaaaaattacctgagcatggagacacgtgcctgtaattccagctactcaggaggctgagacacaaaaatcgcttgaacctgggaggcagaggttatagtaaaccgacatcatgccattgccctccagcctgggcaacagagtgaggcttcatctcaaaaacaaaacaaaacaaaacaaaacaaaaaaaccccacaaatatatagagcataataaattataataagtactcagagagaaaatatgtaatgctataggagacataacagtggatttaaatttaaatttaggggatggtgataattgaggcagctctatttttaatctgaatattgaaaaaccaggatgaattaggctaaaaaagttgggagagaggtagagaatgtaatggttaattttatgtgttaacttgactgggtaataggatactagatatttggtcaaactttagtctaagtgcttctatgaggatgcttttagatgattttaacatttaaatcaacagactgattaaagcacatggtctctctaatgtgggtgggcctcatccaatcaatcgaaggcctgaaaagaacaaaaggcagacccttgcccaaataaaggggaattcctcctgcctgactgccttcaaactgagacatcatgttttttcatgctctgggagtcatgcttaaacatctctttttgggcctgaagcatgccagcctttaggctggaactacgtcctcagctctcctgggtctccactttgccagctgcagatcttgggacttatcagcccccataatcatgtgagccaattccttattttacatatgcagcaggtccttgaataacattgtttctttcaacatctttcattataattttgatgagaaaaagaaatcaattcccagcagaagccactgcctgtgtggagtgtgcaggttctccatatctgtatgggttttttctgggtactcagctttcctcccaaatcccaaagatatacacattaggcaaactggcatgtctaaattgtcccagtatgagtaagtatgggtatgtgtgaatgcaccctgtgatggaaaggcaacctgtccagggttgcttcccaacttgcaccctgggctgctgagatagagtctggccacctgcaaccttgaactggaataagcaggttggaaaaatgcataaatgaatgaattaacacaaattattgtaaaataaaaatatgtgaagcagatgataatcatacaaatgcacaaaaaaacaatgtggaatgaacacactcagcaagcccatcatatttgttattgtttcttttgaattgcatgatggtaggtagtgacagttttctttttgcaaacttttattccttgatttgacccactgccactatgactgctgtcactcaatgattcaccaaaaattgggtaaataattatcttacttggtgttattatttcttaaaagtatgtgtaactaacatttatttcaatgtttaatattagaagctttttgggtctttatttagaaattcagtgatgattttgtgatcaaaaatataccacaggaacttaactgtcatttatgttaactagcctatggtaaagtctgtttcattatatgtcattttgcttaaagtcacagttttcaagaacctgtagatgaccttaagggagattctgtgtgtgtgtgcatgtggtgtgtgtgtgtgtgtgtgtgtgtgtgtgtgtgtgtgtatacccataaatacctatacacacatatcctattggttctgtttctctgaagagctccaatacagggcagacattttcggagcaatggataagcacacacaaagactctgaggcacgaaagaacttagcgcttccgtgggatgaaataaaaatcactgtatctccaccacagtgcttaaagggagaagcaattcaagatgaggcagcagagtgggcagggccatatctggagtgtgtgagaatgatagtagaggttcaaatttatcttcagaggaatgagaaaccactgaatggctttcaaatcagaagagtgatgtaatctgctgtttttttttagccatcacacaggcttgatgtatggatgtatgtagggagttatatgaagcatgaggaaggggtactcacagggcaaatgggagaataatgaagagaatactacattcgatgagacaaaatagaaacatggaagggataacggtggtggcagtggtacatctgagatctattttgcagaactgctccccaaataaaggtgacgatctgctttcagggataaaaacgaaaggtcaaggtcaagcatgactttcaggtgaatgatatgtggacctgggtgacttaatgagaagaggtaggatgaggagaaagagttgggtagaccaagagtccagcttttgacaaattaatgttgatgcctttgagcactctaagtaaaaatgtgaaagagacagttacacatacggatctggagctcagaacaaagacctgatatgaagtgtaagtttaaaagttggcagacagggacagtatttaaactgcccaaggcaagagggtgcatggtgagaaaagaaagagggacaaggacagaaatataaggatcttgattactcgtgattgaggagaacaggaagaactagcaaaagatatacagaagcattagttatcaaatataattatctgctagaaagtattattgctttcttttgctataaagtactatcagaacatctgaagttattttggaataaagaaggttatttacacaaaatttatatacagtccatattcctctcatctattattcctgagaacaaagttttatatagacattataaattattcacagagaaatcggaacttttactatacatacataacagcaataaaagtatcagaaacacatgaatgttcttaaatgttatataaatgagactaactccaatgatggcaaaactacaaagtcagtttcctttatctgaaaatactgatttgttcaagttataattgttatatgtgttgaaatagaattaaactttgattcacaagtaacaagcttataaagatgatattaaaatttcattaaagtttcaggattatataattatttgctgagttaaaacaagtactgtaaaacatcagcaaaccaggcaagtggatattgcataaaaaattagtaccttataactctttagtaatttttaaaattgcaaagatcatttcagtgctgctcccctccccccaggcacacacaaatatttatccagcaactgataattaatagtggaaagaaaacatatcacttttaattttttcaaaaaagtaaaaatgaataagaactataactcagagtcagaaatcaggatttcaaaatccctgaggaactgacctgtgtggcccagattcttactacaccatggggaagtaattgaaagtctgagacagattcaggctgaagcactgtctgacaaactatcttctctccatttttatcctgctaacttccaaaaaccaactcatggagccactggtggatatgagtgctatcccagtagaacctcaatatcccataagaatcttagatggacaagaaataatcctcaccataagaacatgtgaaattgccacagttaaggtcttttaaaatagaaaaatcaattttctatggaacacaaaaaactcaggaaatacgaacaagacaatagcaatgatttttccaggagaatagatttcattcatccaggaaatactgtggaagcaatagttctttgctgagatttgctgagatctatggctgagattgctcttgagctttatgtaattctgtcttctctaggtgaactgggataatatatcagaggaaggtaagtgaaatgtcgctggtgcttaaagagttgggggaagtaataattacaaggactacaaaattagatggttatctctggaggctacccacgcatttgagaaagccaatggaaaatggaaagatgacactgatgtattactgtggtaagcagtaataaaccagtaacaaaccaaacctcgccaaaagaagttcacatcctaattcccggaaactgtgaatatgttagactgcatgacaacgtggaattaagattgtagatgtaattaaagttgctaatcagctgaccttaaaatagagaggacatcctgaattatcagggtgggtccaatgtactcaagggtctcagaaagtgcaagacagcggaaaaagaggagagtcagagggagacaggactatggaagaaaggcacagagagatgtgatgttgttagctttggagatggaacaaacaggccacaagccaagacataaaaggaggctgtagaagttgggaagagcaaggaaatggattctcccttagagctttcaaaaagaagtgcagctttgctgaccccttgattttagctcagtgagacccatgtcaggcttctgacctacatagagaactaatattgcttaaaaccactaagtttgtggtaatttgttacaaaaacaaaagaaaactaacacaaccatcaatttaaggccaaagatcttcccatggagtaaataaaaagaaattcacctctacaaattgtgtaaaaattccttaggttcaggtacagaacttaattataagagcaaagctctagatatggttgaattcacctgaaaagtcagctacatgaaagtaagggtgcaaattaggaaaataaagagccctagagataacaaaatctagtttgatgcagtcaataatctcgatcatcaggttcctatggacactaggtgcctacagaagtctccctgttaagagactagtgtttcctgcttgaagacaatgaagatgactcttccctgaaaaagaatgtaagtcccacccaggattttccaccacctcctctgctggccaactggctaataactaacggtaagtcacaactggctgaagtgctaacccttcaaaaggaggacagggacaatagctcaaaagagccacaggacccagccaatatgttccagtagaatcagtagaataactttggaaccaattctgaagatgctgggtcaccagagaatggaacataaagttgaataactgagagttccagttatgaagagatctccacctatgaagacagtatatttccccttagaatatatccccaactctcctactggcagccaaactcatcaccagggttaagttacaaattaacccagcaatgaaggtgcttagattaccaagggagaaaagaagaagaaaaaagactgtgctctgaaagaggcagatttagccaataagtactggcagaagttagaagagtgtgtatatgaattgattctaaggacgctagattaagatgggaaggaatataatgttggataagagaggcatttttgatgtgggaggaccctcccaggatacaggatttaataacaccctgatgataatgttgctaggataaagacagtatggcattctagacaaaatgtaagatatcagtaccacttttaaagatctaaaggaggcacattttatagtcctcattgtgccctccattttattcaccactcttgttgataaacaagcagatagatgctggaagttggaattgaactacacaaattcaaccaagtagaagccccagttgcaagtgcttggccagttgcagtatctttgctacagcagattaatccaactttagttcatggtacctggcaattgatctagcaaaaacactgttatccatctctaccaagaaggtgaaccagaagcagttctcattcacatggacataacagcagtacgcatcttccatcctgacccaggattataataacttttctgtcctctgccataatacagtctgaaagaatctgaatgtattggatattagaaagaacattacactggtccattacataatatcaatgacatcctgtaagagaaccgaataagcaaaaagtggcaagtacttcggaagtctgggtaagacatgtgctcagaggatggaaaatagacacctcctcagtgagttgtaggagtctatggcctgagtcatggaaagacaatctttccaaagagaaagacaaattgatgcacattccaaaataaaaagcaatcttccaaaaaaagaacaaattagctcactttccccatcaataagaaggtagcacaatccataacagaacactttagatctaagagagaacacagtccatgctgggaatactgttctgacctatttaccagtgccacagaaggatgctggcttggactgtggcttagggcagttaaagaccttggaggaggtataggttcaactgaagaattaattcctcaagcttagaccatataatcccacacatcccatgatattagaagtatctttagtgtgacaagccacacgtaaagtctacggcaagtccctgtagaaaaatcacaatgttagccactgaaggtttttcagcaagcctgtgccatttgcaatatagaattacaaatcacttgacaaacagtttatggcatactactgggaacttacttaggcagaatgcctgaaaataggcaattaagagaccatggtgccaaaaatgtccattataactaggttttgtcagccaagtcataagatcaagtaggtcctgtagcaatccattattaaataaaaatgatacatttgggactgagcacaagtagacagagaaagcccaagtaagctatatgcagaaatggcaaacccctacatctttcctattgcactgcctcatttccctcagctcatccctatgactgcatgggcagtcctgtctaaccaccaagttcaagacaggttcacagatcagttagctccacatgtggtataaaccaaaaaggtactgcacctgccctgcagccccactaatgggtgccttcaaagagtgcaatgagagaaaatattcccaatggggtacagcttcagggaccatataagttgtatggaaagagaagtggctgcggtaaaaataaacatagtcttattggcagcagtgaataacttagctgattgttggctggacgcctgcaaagagaagtgacagaaaatcagcaacaataactcagaaaaacaggcatgcaaatgtacctcctatgggagtgggcacaaagtagagagatctttgtagacaatgttattgtcccccagagagcatccaccacaaaagaggcatgtggcagattgtattcttttaaaaaggccacaacaatttctccaattctacaagtcctccatcaaatgtaaacttaacattattcccataaagaggtgtaaagaggtgggatttataatccctttctttcaacctgggtggacctttgtctctgcctcaaactatagagcgtcacggaatcgatgcatgtaacttccaaggcaaaattcaaagcgatcctttgtaccttttcaggatacttactcttagaatcctcacaccgtgctgtaagaaagcccaaagttttcaattcagccaaagtcccagctatctgccagagtctcaagtatcacatatgtcagtgaagatgccagcagatgattccagcctccagatgtcaagtcatcctccacctccaagtcttcccaggtaagggctcagaaattacggggcaaagataagccattctgaatatccctcatataaattattggcccacagaatccacgaatataataaagggagtgttttataccacaaagctggggtgggttgttacagagcaatagcaattggaatcagaatacagaataacttgatttattgatattagtcagcttgccatcagctactccagtgttgcatcaatagacacaaaagggaagaagccgtagtgaaaattatagacattatccatatactgaatagcaaaagctcccattcatcagcattgaactagctaatgctgctgctaaatgtccaacctgccagcaggagggaccctgatgtaccccattcctcaaggaaactaactaggcatttggtagaaattgagtacaatggactccatttacaaatgaaagattagaaattcatcttgattggaactgacagttaccttgtgcctacagtgccccataaaacacatcaatgtaagagatttcagaatatgtgatatacctaaaacaggatctctcctaacattgtactaaccaaagggatccactgaacagaaaagaaggtgctgcaatgataatggaatttactggttctatcacatcatctaatagaaaacttttgaaggagcagcattaattcagcagcttggagatgatactcttaaagttggaccccacacttgcaggatatgacacagtcctaaattaatgactattatatgtagctgtgtccccagtaggtagaatacataagtccaagaaccaagaggagacagtgtagtatcctcagttatcttcactctcatgacatatgtagggtacctgtgcttcctgtccccagaattacagggcctgtgtggctaagatgtgttggttcccagagggggacacttttcttagggacaatagcaaaagtctcaaactcctgtgacagttgtcacctgtttatttgggctccttatgcaaaagacaagcaggcaaagaacaaagtcacttttcaggcagggataataaatcctgattgtctggaggtggcaaggctgctgttatgtaacatgagcaggggagaagaactctggcaccccagtgacccactttaagtatgtgttgatgctctcttacctagttctggtaggaaaccgataaatccatcagctgtgacctgagaagatcttggtgaccaagatcttaggcccttcagctcactttgccaagttcacaatctaatcctttagaattgctagctaagggtaatgggttctagaagaagtagtagaaaagaggaatgatgagtatcagacacggttctgagaccagacataagggctggctgacgtttgtcctgctaaccatcctcttttgtgagtttccttaagataaaaggccagctcctggagggccagttctcaaacaggataagcaagcagatatgagcaacaaaagctgtctaagatggggtgtaacattcagaactccttctgcatgaagaagacatccactctcccaacttccaagagtgttacctgatgattgctcacaactgagttcctcccagaatttgccttccagtaaagggagctgcctaacccaaatatattggctctgccccaggggcaacccacgtccaaggactggtagaaaagagagtaaacagaattctttctctatttggaatatctctgaaggtccatcccaactctacagcatcccatgcactcagcctaggactctgttgcaagtgaatcagagttcaccttctccctctgctcttcccaggctcccttcttcccttacaggtgttcttcccaacatcactctctaataaaccacctgcatgtaaaccttccacttggggtcggtttcctggagaagtcaacctatgacatgaacacactgcattctgctttgatctattctattaatcctcatgacatgaaatcctatcaccctgctatgtcaataaatttattcctatttctctaggctaagattatgaccaaactaacacatctgctcctacccatgcaacttcaagtctaatccccagagcagagcacaatagtaggttgaaattctgctttactattttcattatttgctttataaataactttccatctgtagaaatgctgagtctttcattactactgtgaaaacctctgaaatgtcataataattgttgggagggtgacagctatgtaaaatgaatgagaagcagtcaatagttaagccgctaaaaatattcttagaacaaacttagaaatatcttaagaaagtctaaattagctttcgtcacagccaaagacatttaaatggcatttttaggttcataagatattttaccttttattttacttaagaaactgtattccagctttcatggatattatttaattattgttggtaaaattaaatgataaaccacaacatagagatgtacttaaatcttaggtgtataagtgtatacctcaattatgaagtcactatccactctcactcaaaatagagcatgcatctaatatatcacaaaatgcaaaaattggaagcagagaaagactttaaaaaggtgtactatattctataagtactcccaaatatagaactaaatgtgtaaattgtaaaatcacgaaatctattaaactcttatgaacttggatttgactcatcttttactctatcctttacaaaggcttccagtttaatttgaaatttttagttacaaaatgcatgatggctccaccatttaacattagcgctatttccagtgtgcaaaaagtcatatcccattagtttcaagcatttggtcagatattaggaagccattgcttaaagaaggaattcacaaaatcagtgcttctccatgctttttttttttaaagaagagatctggctttgaaatacaataacaacagttatactacagaattaatgaattgccaattgtaaaatgtgaatgtataatgaatttcagggcagtgctcttgcagccagactgaattaagagttaaagttctaaagactcaattgcctctgaaaatttgaggggggatgtttatcagttaaagaaaacatcagctgcttagaaatgcatggcgctacagctgaatataatacctttcctgttctctcttgaaatggtttcctattgaagcagtttctgtatcaatcacacaatagtcacaatgatacagggttatactataggacacaataacagcattcaaaaagcataggaaaaatgacttttatagtggtaaatactgtagctaaaagcctaaaacaaatcactaaactgcactaatctgtaagctttgaggtctgaggaactcactgtcagctaagagaagggcagagctcgcaatcaactgtcctcttgaacacaacaagattgtcaagaaaagaaatccgctgatagagtctcctcaattaactctgcgcgaaaaatgcccaagcaatactcggagggaactcaacaaaaatcaggccaaatatgacatttaactatcaatctttccaagaccagcgattgttaatcagcctagggagaaataaagtagtacacctgacagtggttattttttataagcacatacctactattttacatggaggaatataactacttctgcagaatatgtagtagaaccatttcttcatttttacaggttactaattatgaataagcttaaaatatcctatcattccaaaaataaattatatgagagagagtcctcagtatgggcatttcaatactgaaaagaaaaaagaattataaaacatatctttcttttctaagaaagaaaaccatatggtataaagtgctgacattagctacctacatatacttcgcatgtgacaagctaaaatgtattattacccaagttgcatttcaagtatatactgtttaagataattttcatgcatagcacaatgtaagctacctaacttttatgatttaattagaataagtataagcacacacatatctgaatataattttaataatataaataagtataaatacaagtatttacttttacatacatttcatatttgattccaaattcagccaccagtaactatatggcggttatttaaacttcatgagcttcagattttgcatctatctcatacaaagattagtgcatggtacaatgtgtataaaacttctaatacaaggtgtggcatacagtaggcacttgataaatggcaattattttatgaaaaattactatatctcatctttaattatttttcaattataggtgaaaaaagatgaaagataatccaagttacttaagttttgtttgtgcatgtattttagaatccagacatgaatatagatatgcctggtgcactgaaagctcacttataaagaataaaatacaacttaaaagacctgattaatagaacggcagggatggtcttctgaatatgcaagtgatgctaagcttcaaatatacacattactgtaatgcaggtggaataaactgcacatgcattgctgttaggcagctaagaaatatttctcttttgtcaactgcaaaaaacgaagtaatcagagtttcttttttttttttttttttttttgagacagagtttcgctcttgttgcccaggatggagtgcagtggtgcaacctctgcctctcaggttcaagggattctcccgcctcagcctcccaagtagctgggattacaggcacccgccactacgcccggctaattttttgtatttttagtagagacagggtttccacatgttgggcaggctggtctcgagctcctgacttcaggtgatccgcctgcctcggcctctcaaagtgctgggattacaggagtgagccaccgcacccagccagtagttggagtttctaaaggtaattttgtaaacccatgaacaatagaaacatgaatgtatcacaaatattcaaacacaaactgagtattaggtgagagactgcatactctgttgccaacactgaattagagtcagctttgcaagggaagtgggaaaagcacccagtttcttgggattagcctaaataaagtttagctactattccatgcattttttgaatacacatacgcactcttatatactcttaacatagttaatcgatttctgcttgaacatgtaatatgtattttttatagtatacatgcaaatactctatatacaaacatatatttgtattatgaatgtgtgtatgtatatgcacatgtgcatgtgtgtgtgtgtatcttctttagctctctctggaagagggaaggtggttaaacataagggtgtcaaagtacttctttgcataagtaagcttagagattaaggcattaaattagtatcaatgacgacagaaagtaaaactgaaacactgtttgaaatatgaatcaaaaagatataatgaccatagagttcaactgcaaaatcacaggaagcaagaagaaggccactttccacaccagctgctgcaattggagggatgtttgatagtgaggcacaggaaataatcagagagtaagcagactctgagtaacaagacagattatttcaggctgcagtccactgggagttattctagtcttggggaaagactgggaggtttctaaaccccgattttcacagtaatgatgtcattatggagtttataatattgtagggaatggtcataatggaaaagggttgcacttccttagacaagtatatttagataaatctatgcacaacaaaggaagaacaaaattagtcaaaggttgagctttgattaattgggacaaagacctaaaactctaaaatgcatacagcatctctgttgtacaggtggtacaaaccagtgtgaaacatgaaccaaatgaaaaatataagttactcaaaggatgagagagagtcacaataatggcgtagagtaacccatgaaaaacaaggaacgagttcagaactgaaataaaagcattaactatgccaattcttgataataacttaactcattctgagataccaagttagactgacaactgtgaaattacttggcagttgtatctctccatattacacagtactgtgtgtctttgcttaaggtgatttgtttagcaaagtcaatattgctcatttcacataatgggaaaaatcttctcaactaacaatttttgttgtctttcacagtcctgagtaaagattgccttctatgtggttaaagagatacttgaccaatatacttgactaatattgagttaatattcagacatggagaataataattgaattaagcaattacagccatctagttaattatatgaatagagaatatggaagtggactaccttccgccctccaaaaatagaaagtgtttgccaaagaaaacgattgcattatgcataaaatgctttcttaggtatgtggctgttacagtttaatggtgagcaaagtcccactcagtccttttcagttaattctaatttaaaaatgttttaaatgattaggtgactgggtgggaaacaccaattctggttacttctggatcaaaactagaagatgtgacacagtaattgtgtgatgaccccatttaatggtttatcctcattttctgtttttatgtattaactaccaattataagtattcttataaataaatatatccctaggttattttttccaattgggtggctgatttttataaactgctgttttccaattagtcttgaaatgaagactattaattagtcttgaagactattaagaatactcttactccttgattcaacaacaagatcaatacacgtatttgaacacacttatagatttatataagcataaatttacccataaccataaggtttaggatacactaatgttctctggagctctcaaatgagggggaggatgccagctccttgctaaccaccactgttaaggagaagaaggagaaactcctgggttatgtggattgagaaagggagactagcataagcaacaatataaactacacgtgcatcgaaatacaatatcaaattgcattttcatgcacatatttataatacttaaagtgtttaaaaatactcagtttctgttattttcccctagactgacacaaccagaatattttttccagaaaaaaaattacttggtctctgttaccttctagcttcttattctggtctaaaaactaaatgatagtcctattatgaggttcaactgctagagcatctaagtgtagatttttaagaacagaagggaaactctccatgctccctcccccttctactccagatataaaaatgcagccatagtttcttattcttgctaatatctacatttcttctatgcatcagcccactctcctaagagtttactcgatgtggaaactgagggatagagatcaagatttttgcctgaagtaacacagtaaagcagcagctgaacaagaagaaagcccacgttacccaacagttttcaactacatcatgctgtcttgcactgtaataaaaaacaataatgaaagcacatacctctcttttcacaagggcaatgccttcatcccagtggctgtacattcgtaaagaacgaaatgattttagtcattctggacccatagttgctgctgctaaacagcacttctttttagcactctaaaaatttagactttaaaaagtctttgagtttacctccaaaaggagttgccccccacaggaactttagagataactgtcctaccttctgaagaaatggtcagttagcttcgcacatttaacacacacacacttcagaatcttgatggacatatatatctgagcaagttccagagtatcatacaataaaattgtatgatgacacaggttaaaggacagatacatctttctagttggggtaaactttaaagaaattgctgaggctttattacacacccattccaggactacttttctttctgcaccactgttcctccacctagaacccacacaatagcaatgccctttcttccttctttatctatattatgcctacccactttcaagtcttaactgttccgagctttttcaagttttctccaaccacaataggaaatgtaattcctctctcttcttctagatacacacatttgtgtatttctcatagccttattttatttgtttttccatttgtttctatctcctggattcatgcataacctctttgattttacagcacttactgagaggtgacagtgtgctggcagccctcacaaccctcgcttactctctgtacccattctggccacgcttgaggagcccttcagtccgccgctgcaccgtgggagcccttctccgggctggctgaggctggagccggctccctcggcttgtggggaggtgtggagggagcagcatgagtgggaaccagggctgcgctgggcacttgtgggccagctggagttccgggtgggcgtgggcttggcggccctgcactcggagcggcctgctggccctgccggccctgagcaatggggggcttagcacctgggccagcagctgtggagggtgtgccaggtcccccagcactgctggcccaccagcactgcacttgatttcttgtccagccttagctgcctccctgcggggcagggctcgggactagcagcccgccccctccctcgccccccctcccccccgcccccgccccaccccgccccaccccaccatggactcctgcgttgcctcagcctccctgaggagcgcggccccctgctccatggtgcccagtcccatcaactgcccaagggctgaggagtgcgggcgcaccacacaggactggcaggcagctccacctgtggccctggtgcgagatccactgggtgaagccagctgggctcctgagtctagtgggaacttggagaactttatgtctagctaagggattgtaaatacaccaatcagcactctgtatctagctcaaggtttgtaaacacaccaatcagcaccctgtgtctagctcagggtttctggatgcaccaatcggcactctgtatctagctaatctggtggggacttggagaatctttatgtctagctaagggattgtgaatacaccaattggcactctgtatctagctcaaggtttgtaaatgcaccaatcagcactctgtgtctagcttaaggtttgtaaatgcaccaatctgcgctctgtgtctagctgatctgctggggacttagagaacctttatgtctagctaagggattgtgaatacaccaatcggcactctgtatctagctcaaggtttgtaaatgcaccaatcagcactctgtatctagctcagggtttgtaaatacaccaatcgacactctgtatctagctaatctagtgggaatgtggagaacttttgagtctagctcagggattttaaacgcaccaatcaagcaccctgtcaaaacggaccaatcagctctctgtaaaacagaccaatcggctctctgtaaaatggacaaatcagcaggatgtgggtggggccagataagggaataaaagcaggctgcctgagccagcagtggcaacccgcttgggtccccttccacactgtggaagctttgttctttcactctttgcaataaatcttgctgttgctcactctttgggtacacattgcctttatgagctataacactcactgcgaaggtctacacagcttcactcctgaagccagcaagaccacaaagccactgggaggaacgaacaactccagacataccgccttaagagctgttaacactcactgcgaaggtctgcagcttcactcctgagccagcgagaccacaaacccactagaaggaaaaaactccgaacacatccaaacatcagaaggaacaaactccggacacactgcctttaagaactgtaacatcaccgcaagggtccgcggcttcattcttgaagtcagtgaaaccaagaacccaccaattccggacacattactacatagctacatgcatcatctacagcagttatacattaattagttgactgaatttatgagaactgaacctaaacaggcctagagtttctgtggggaattcaaactggtcaccacttctgaaaagtggcacatcttcctccagtattttcttgccttcctagtaagcagtccagcacaggtgaggcaaaaacccaactcagttacactcaggagtaaaagacggaatgctccaatgatcaatctgtacccaacctttccttgtgttcccaaatcccacaatccatcagtgagaagagtaatctggttcagagtgaccacaggctctattaagagccctttatctcctcatcctttcctttcaggacaccagaaaaatctcccttaagatggtatttcttcaggcagacagcaggcatttttctttttcatcctgatgcactacaacaaagttctagtggcttcagataaaaatatatgcttttgctgttttgccattatttaaagggtagatacatttttccaatagcctttacttcctactcacctccttcagatctcagctgtcttttgtgctgtccattaagacttagagacgcctagctgtgaacaaacccttcctctttcaggaagatgtgtttccccttctacaggatcacttgattatttttatttccaccattcacattacaacaaaacaagacaaaaaatatactgcttgaagatactgtaacatgtcatacacatgaccccaaatttcagccacaccacagtccttaatatagatttgagcaggaacagcaagaaactgaggttcctgtttatgcaaagttgtagagacacaaagtgtaagttacatcataatttctaatgcctttcatcataccataatatgtatttaaataacaaatgtgtaatagccaaaaatatgtttataatagttgaaatcctcttctgtaactcctagggaatatatcatttggatgttgaaacagaaagcacagatcttactcaattcaatcaatgaaatcagcaggaaaagaaacagtttttaaaaatgtaagattagaaatggcatagtgtcttggaaaagtagcaagaaactgatatagaaaagctgaaatgggatcagtgcaaggtggtatagttagaaaagaaaatggaattgcaccggtataaaacggaaataattaagtacatgccccattattttaataagagattttagtaatttgtaaaaaacaaattcatctaatgaatacaactggaccctggagaaaataagtttcacaaacaatgcaggacctccatctgcctgacataatggtaaaatcactgtgccttgagttagtgagatgatttaatgatatcttaaagtctcttctcccactttatgattttacagggccaaaagattattaattggatttgaaaataaagataggatatagttttctatgaatgcaatattttattgtttgctctaagtaatatagtgtttacactcagtcactgaagcaaagaaacaaaagttattttgtgggaccattaagttaatgtcaattacaaagaagctaaaaatgttcactcttttcatactttaaatatatgcaatatactttgcatgtccttccaaaatagccaaaagggagcctaaggaagaccttatcttatttaactgagatgacagcacattcccttagttaatctgagctaccaaagagcataagctctcgagctcagttcccagagtaggtcagtgtatctggctgtttgctgttgcctttatagattacaaaccttgagcccaacccttgcaagactcttctcaaagcatgaggatcaaatcagagaatatgagtgatgaatcgcctctatacctggaacacaacccaaaaccatggttcctgacaatgttttaataaaatacaattgaactcacaaggcttatgctataatcccatccccatgagtcctactgcagttacattaaaataataagttttaaagaagtacagagcacatccttgcagaaaagtttatttgtaccctgcttctcaaccagggtttaaggtgtttcacaactataaaacaaaaataaaaatattggcaaaatataagtataaagaagcataaccagagataataagattaagcaaagaaatcaagatcatgaaaaatgccttcctggaattacttttgtgacatctattcaccggaattatttcatctctaaacttttatctctgactgttaattgtctaaactctggcactctcactgacttattcattgtaaaataagttaggctcaacttgctcaatctaaaatacttattaatccacttaggggctttcccagggaaatataggacatgagcaagtaacactatataaaataatctgcccattttgcatgtgaaatctcagtaatatgaccaacaaggacaatttttgaatgggcaaaaatgatcccaagatacaatgagcagcccagccacttttctttcatgatcgtggccatggtggtgacaatataagaatgtgcatgagtgtgtagggacaatggagtgagaagaggaaaaagaggttggagctgatggtatgtaatagagcttcacattgattttttaacagcatttattaaaataatctcttcctcttttcctacagactaacaccctaaatatggtttagtcaaaggcagtatctcatcacacggcctctccaaacccaatctgaaaaaaaaatcataatcaatataccttcggatagctttgctatgagaatggcaacatcctgagactgaatgtaatggccaactgaccatccatgtcattcttatcccttcctatccatccagattcaacccactaaaataccatctgaaatatcttccagagctttcttgtgtcacttatgcccttgttcttaatttcaccaaggccatttctgtccagctactgcctgggctgtcattcttaaattgtatgagatttactgatattacctgaattgagttaatatagcttgctaatttgtcatactcaagtgtttcttaagcttactctatttattacttctaatgcattctgaaagctatttttggacagtgaattaaccatttcaggacaccaaatcaccgtttgatttggttcccaaaaaagctattcagacttgagttgtattttgttttttgtttgcagtggggatttgtctgtgctgatgcattcataatgtttaataacttccttggaaattaaaggcatgatgaccagaagtaaaattacagaatatgtcaatagagtacttcttctttttttagcaagccaactgataagtttacaggagatacaattattgatatgatgtcattgtcaataggatctctagaaaacacagttaacccaaatgacttactaccatacaatgacttacaaagaaaactttcaaaactaagaaaatgcattggatcacttagctctaggtacttcaataagcatacagatagctaggttttacattccaattcttgaagctacatcgattagttatcctaaatctaatgaaatgtgagtgcaacaaaattaataacgtgaaaaatagataccagttcatttaatgactttttgttatccagtgatgtttaattaagctaaaaggaaaattcaaacaaaactttaacattccaagagtatttgggagaattattttaatataaataactttttaaaatccaataagcaaaaatctatagcttaaggaagtaaaattttttaaatgcacatatatatattgccaaatatatatgtcaaatgggtagtatccattaaaattgccttggttagtccatatgatttttttgtgctattctattatgaagaggttttcttgcaatttttccttcagaaatattttcaaataatttatattactataatgttacatctgatattgaaaatgtaataaatataaagtacaaatcccacttaaaaaatttataggacagaattattggtggaaggcaggcagttaagagataatctccctcatccaactgtgacaccatatataaatcttagctattgtgcagttcgtttgctaagcactattcccagataaatgacagtaagttcctaggtctatagcagaaacttttacacttaagtattgcacagggttgtcaaacagattgggcataacaggaagaagattaaaatacttgagacaatataatccatgtgttacagcaaatattctcaattcactaaaaaacagaatctgaatttcatgctcagagtttttcagtgaggaagtagaggagaaaagggataccctagctattccagggaagaaagtttataatgacatagttctcaatcatgtaaacaattttaggctacaatgaagtgattttgcctgagtaacctagaaaatcatttgtgtttcctcttgaaccatgatactagaaaacactattgagaaatattactttgtgtgtagtatgaatggctttacatgtagcaaatataagcaaataaaggaatacagatttttatgctagcaaagttcctgtctaggctgttgaagtttctgtttataataaccctgccttttaaattaatcattctcaaagttattcatataaaatgttcaaaacacactttttaactttacactaaatcttatgtctatgtcctttacaattgattcctttttttgataaatttaaaaaatgttctcttccttataaatgcttccacaaataaaaacaaaactactttaggttaagaaagttcatgacttacaaaatcaaagcaatgaaactgtaagcctatgttagtgcttctcaacttcagtgtccactgtaatcatcactcgaggtgatgaacacaaatcactgggccctacactctgagtttctaatttagaaagtctcagaggggcccaaaaatgtgcacttcaaacaagttccagggtgatgctaatgctgaagattaggggcctaatcttctttgagaacctaacttctgtgacaggtaaaacatatcttaaaagtaatacataatttttaacccacctcatagctgtgacatttataatggccaggaatactgattaatatttttcacacaaaaacaattctattcctggctacatgactaataaccacatcaatataaaaacaaaactaaatgaaaaagacccccactttcattacaatcatcagctcagtagcagaactgcctccttgtttattgttaacagacataaacacaggattattttaatgcaattgtttcctatttgtcttctctgctagatcttacccttttccactacccaatctgagacttgccagggcaaataatctgaataacaaaaagtgacaggaaaatggaaccatgtccttctgatccagatagttccagcaatgtaccactgtctccccacgtccccaacctttctcacttctcatcaccccatcacacacacatacactcacacatgcatacatacaaatttaaaaaacaaaccagaacaaaaaattccttttagctaagatgatctgaatcaatgagagaggaatacagagttaggcatgggatgagaagaattcagactctcccatcctaaggaacagccctttgagaaagctttatctccagcattcctacatcgctagaatccccgtttttctcagctgttcagagggcaccggggtccaggatagtcacaagagcactaagttaattcctactcttttcaggccccacctcctgttgtcagtcaaaccttgaggtctgccaggagactcagcatctctctcatacacacgtccccccattaccacaaccatcaccaccacgagacaagttgtctttcacttgggaaggaggggttgggagaggggacattctgatccttagagtcgggagaaagtgaaggtttcttgggagccaagaagggagctagaaacacaggaaaggggaggagcagatggagtgcagtgggtaccagagctcacctcagcactgttcagccctggacagaacacagtggacacagtaaaggctgggtctgtagcattcatccccaaacacccacccactgtgcactccgttcccagagagtttgaggactcaggattcactggcacctgtgtccactctgcagtcagttccagggtctgcagggaaagctctgacacttccacaaatattcattcctttttgccctgggtcagccattgacttagtcctgcagcaccggagtccaaacccctgagtgaaaccaagggcaagtgggctggattttcagcacacattctgtggacactgactcaggggcgaggggtgggaccggctgtgggcgggtcttggcttgatgtcccctcaaggggtgcacctctaacctcccaccagacctcaaaaacacagaagttattttttgggcaccacctgcttgtcccaagagaagacatacattttagtccactattaactatgacctggatgtgtgtgtgtgtgtgtgtgtgtgtgtgtgtgtgtgtgcttccatcctgaaagctaagggtgccaactgctgacaggcaaaaaaacctgtatttgcttttgaggacttcaaaacctcctaattaacaagcttgcccttctctagttcctaaacctaaatctgggttttccagaggggagatgagattgtgttcccgctgcagcgagctagtgtcctgccctggaacccagacgcgcggacttagcagtccgttcattcatgcacttgctcatccattcacacaaacatgtcccttaattgtgtctggcaccgagaatcttgcctgctattttcccctcccgaagtcagtgctcatggcaaccgctggtgcagaacgcaactcaactgtcaccccacttcctgagccggaaaatcaaggcatgtaggcattcacagaaaaaggaaaaggtggagaggaggaggcggcgggggcggagaggggtggggagactcacggggtcacactggaagcttccctggggggtggggggaaaccgtgacaccgacaccgtggcatgcaaggagccaaaccattattaaatcaaagactgctggagctcggattccccgcggggataaatcaagtgcaaagccgctcgttcgcacgagtgcgttgctgccggctaaacccaactccgagccagagcccaggcgccggggaagcggctcgcagcccaatccgcagcgcgctcgctgcctctttatcgctcccaataacgtgatgaagtgtaaatcaaatgccacgccgggaggggccccggaacggcgcgagtcgtgcattttcgctcaccagcctatcttgcctaagaatcacaaggtcacgatagcgtcgcgattccactcaccgtacactccttggccagagatcccctccaggaggactgtcagcagccacacgagaccgtacagtaaatccatcttcacgtgaacatgaacatatccagcccagggggtacgcaacgggaccttcaggaggccggcggccagccaggcgcgctccactcgcgcccgggccaagccgaggtgcccgggaaccgctcgccgaaggaggaagcgccgtccgtctgtccttccccggcggcggcggcgagcggagcgcaggagccccgcactccacacactcatgcacacacacactcacacacactcacacactctcccacaacacaataccctgacacacactcacacgcacgccgcactcacaccgggtgcctgggaaaatcgcagacgccggggaggagcagggggcggtgatgggaaggggagctgcgaggcgaagt

SEQ ID NO: 1402 - DNA, 503611 bp, Homo sapiens
ttgtaaaacgtaaaagaaatgccccagatattgtgtacttgaatctctttggtctgataaagtatatgggttactgtgaaactctgaaaaaattttaagatgtctaattcattcaaataagttatgaaactcatttgtttattatgtttaatttaaaggacttggttcagatcaattccatcactacctaaatattcaaactggtccccttttgaactgactgaaaatagacattaaattccaggttcatatatgtttcatattttaccttcaaaggtttaactgctttctgcatgtattacaatataggggagtgcatcagggagttcctattaaaatttctttctgcagacattaaggtatgtggagcactgaagatttatcccatggtaaccaataaattgtataactaatttcattttagtgataagtgaacattgctcaacaaacacacatactgcttgtcataccttacctggaaagaggctttattgaacatagctgtaaaattatattttaagttgaattactgaatttgcacaaacatttctacagaattgttttaaaaaacaagctttgtcattttccactacattttgttgtgcttttatattaatatttgcaaatgctataatttaatacttatattccaattgcttgcataatcagtttttttaatcctggggtgttgaaagaacatataataataatattcttcttagacaaaagtctttttaaatgaagttaaaagctgagataatttaaggaaaatgatcttcaaattttcataaccaacaggtttaagtgaaatttacaatgcattggaaaactggctggttaaagatatgatttgtcgtcaggtagctcaaaattatttttacaggtttttgtttttttgtaaaagtgtttttataatcttggtaaaataataaaataatatttcacaatttgcacagagtctgactaaagggcagaggcatattaccctcagagtttagaataaagccagatttttcaggcccagttccactgtagagttagtatgcactgcaatcccaaacattttcttgttccctctaaagctagggccaatttcatttcaaatggaggttagagtaaaaaaatcacttttgtgttttaccaccttctgcactaagtattcttaataaccttttgctctggttgacccatttaataacctggaagaaaaaaagtgttgctccatgtctggtctcaatggaagtgattttctaatggacaataagccgaaaggccatggctgtctaggaggttaaacaacaaatatcttgtctgcatgggcttacgcagcagcttcggtcctttcttcttcagaagcggctttgttgtcttgcctgtaatttgcacatttaggctctgtagtttgtttataaaatagttttacacaaaccactcttagcagtgcaagcttctgagttgaaaattattcaggcttgtttcattgaaggcacttggtttccatggcaatttataaaagatggtggtttggtttcttcattggaacagatgacgtagtttgggtgttcaagtggccgcaagcaaactccgataagcctgtgtaacatgtaagcccaggtttaccatcctggatagtagtgcatgcaaaaagagacagcatacagttatctagcttagccatgggagaaaaataataataataaaggtgggatggggataaggtggggagaaacatgaatgctttaaataattctgagttcgggttattttcaaggaagggtaacagccaaaggtaaaagggcctacatttatttaattctctacgaaaaccttctcgtaaggaaaataaatgccagctcttcacgtaccctgtttacagtgaggtttttgttggcaggccattaggtttccatggtaacaagcaaactattcatttgaaacaaaaccagccatgactttgtgctttgacaaggatttctatagctcttttttttttctttttttcatttttttttttttttccagagttcaaccagatgacgctgtaatctttttagccacaaaagcacctgaaggtctcttctctactcaggtcaagattatcttttatgtttagtctggaataagttatacttccatgatgtctttttatccccagtgcttaaaaaaatttgtttttattattttatttttgagtcagtagtcagtggaggaatctttggtagtttgtttgttcaatgtccatttacaaagactctttcttcatgccagtgcctggtgaatcttttatagcctctgccaggataaggtcaccttcgaggacttaagatagagatgaggacgataatgggaaaaagccatatatgaaccaaaatcccaacagcaccatcaacggaatctaaagataaggaaaataaatgcaaacaaaaaaagaagaataataagcattccacgtagctactaacacaaccttggtgaataataaaacaagtatatggaaaatatttctggaaaatatttatttttattttgttttatttatcagcttcattgctaagggaagtgaaaaggaaaatgaatatatggttaaggcacttgataaaaagatttacagattttgaattgatataatatgctatgaaaacttgttcataacatattcacataggtttgtggttgagctcaatcttaagagttctgctagccacaggaaagcaggaacatggagaaaattatcagaatacttcaaaaagtagattttttttcaagcttcccgaagtggataagcttgaagactgaaagaaaatctatcttaatgaaaactagaaagggatggttatgtgtacagaaattaactattgcaactagtagatgatccatgtttagatcggtccattatctataaattatacaaataattttctctttattttaacttttagaggcatgatgaagtccattcaaactaaaaaatcccttccaccaatcggcctggaaagtcctactgtaattgggatttctgttaaaacctggtgtccagttgatgcctcttagaatgcatgccttactgtggagggataacacagatataattcattaaactagctaaagttgcaaagtggcttgtatctaggggagaattgagtttgaaaattgagacatacaatcttatatctgcatggtgtggaccatagttccatttattgcctggaaagaactggcagcctgaggaatcaggaagaggctttcagccttcaggctggtctgtacttagaatataatattcatttaataatcatcaatcaatcaaatgctagtcataaaatgaacttaataaatggtaattaaatgacacaaatgtaacagaaaactttctgatgccaaatagattatttgtgttcaattaagattatttatttcccctaatttatagagtttaaatataaatacacccaatacatacagggggtgttttcatatttaaaactgccacacatttcttggatttgctagtttaagagaaaaaaaaaactaattataaaaatgttctattgtaatagaacttgtacagtaatgaagtccctatgggctttcacaggcatttactgtggctagttttatcagttatgctttctttctgcactagggagtaaataatttcctttgctttcttcctttgaaaagtttaattcaatttattgaatttatttataatatttgtgcttacattatgaaaatgtaaaatttctgtatatagttgtaactgccttcaattaataaaatgttactgccactcagtcatactatgaaattcaaaagaaatcctattctcctttgaggagaatacatgttttcctgtgcattagaaaaactgttcttttgagtatagctactggttttctaaagcagaactagacagacacaaggatacatttttactaaatatgttacttgaaatactaagtttatgactttttaatatattttcattttatataacaatgagcaaaatggctcattgttatataaaaatcttagtttttgtcttttgacaatacttaagaattgagtcaattcagttcatatgagtaatcagtggacaattgtacacattcaactttcaacatctagactggtacagtttctcactaaatatagaaaattaccaaagactctgatttgctctagatttatacaacatagattttcatgcttttgtatgtgctaaataattgatgagtaatttgtgtaaatttagtttgattactttctctatatatgaccacaaaataaaagattccagatgagtctaagataatccttcaattgcagtcatttttaacaggaatgattttagatttcatagcttcgaatgtgaaatatggagatgaggactttaagaagcagctaaatacataattctaaatctttgtgcattattcatcatgttttatttatatctcttctattataaaatggacctgtgacaaaaaaataaaattaaatatatcattaaaccataatactcaaaaaagggtataaagtgaaaatcaaattattaaacaagcttgtggtgcagataggagattagaccataaatatgaggtctacttcattacttaatatatgtatttaggctctttacaatgctgaatctgttaaaatggctggcaaaaggccaggcacagtggctcacgcctgtaatcccagcagtttgggaggccgaggcaggtggaccacctgaggtcgggagttcgagaccagcctggccaacatggtgaaaccgcgtctctactaaaaatacaaaaaattagcggggtgtggtgccgcgagtctgtaatcccagctactcaggaggctgaggcaagagaatcacttgaacccgggaggcggagattgcagtgagcagagattgcactgttgcactccagcctgggcaacaagagcaaaactccgtctcaaaaaaaaaaattggctaaatcaggaaatatattcactatattcacaaactggacgaatgaaagcatctatgctgacatggtaaggctttgtgtcctcacacaagtctcatcttgaaatataatctgcataatccccatgtttcaagggagagaccaaatctcatcttgaaatataatccgcataatccccatgtttcaagtgagagaccaggtggaggtaactgaatcatgggggctcttcccctatgctcttctcatgaaagtgagttttcactagatctgatgatttttattattattattattattatgtttttgagacagactcttgctctgtcgcccaggctggagtgcagtggcgtgatcttggctcactgcaagctccgcctcccgcgttcacgccaatctcctgcctcggcctcccgagtagctgggactacagggactacacgcccggctaatattttttctttgtatttttaaatagagacggggtttcaccgtcttagccaggatggtcttgatctcctgaccttgtgatccacccgcctcggcctcccaaagtgctgggattacaggcgtgagccaccgcgcccggccgatctgatgattttataaggggcacttcccccttctctcagcaattctccttgctgccttgtgaagaaggtactctgcttccccttcaccttccgccatgattgtgagtttccttaggcctcccagccttgctgaactgtgagtcaattaaatctctttcttttataaattacccagtgttgggcagttctttatagcagtatgaagattgactaatacaatttacattgtaaatatgtgctatgtatataggttcatcaaatattttaatacaagtttttaaatcttctaaaacaaataatatcaaagtgttttaaaatcttaattaaaaatcaaagtgtacttgccttacgtagatctaaatcaaaatctcacttctattttatcttaggccaaatatgtctacaattgaatttaatactttaaaaataactgaacaaactttagggtattacatataagaaatttctaaataaaccaactaaaaataactccgtttttaaaattaattaaattaaatgttaatttaatagtaatgttactttaacgttacaacaaaccaatctcaagcaaagatacttactcttagttgctaggtcttgttttgcacattctccttctgcaattgatacatcatcaatagcaatgtcaccttctattccaggacctcggataccttcaaaaatgagctacaaatatgaatgaaacaaacctaaatgtggagctttgatttgcagatcagtttctcttgagaaatcaaggtgacaaaaataaacttgtcagtaatcctggcatcttttatatttgatggctttcaaaattaaaacttgcagaaaacataaactttcatcccaaaaccagtaattgaatcttccttgcattgtattagtttttcacatcaaaagctctgtgtcgattttaaagcaaaactaaacttaattaaataatacaattaaaaaaaatgactacacatcctcttttaatttttaaggataagaaaaaatgttttatttgaaaagtctttctctgagatagattctttctggttttatctgaacataactcataacattagttttctagaaatattttaaagaatgaatcaattctgaattctttacaacagtaatatgtatattgaagcccggaacaaagtgtttctatctctgacattgatttctcacaaatagattgaataggttcgtcatattcccatgttgactttataatttacctccatgatttcactgctgatattccatttttttaaacttgaagatatgtatcagtctatttatgttgaatatctcacggtatacctttgaatttatggtgtctataacaatggtggtcactgaggctcagtgcatgaatattgaaagaataaatgagtacaatcagaatcctttattattaaatacttaaaacaatgacaatagaagcacaattagcaaatttatatattttttatttttacagaaacaggactcttttagaattttctttatggctcccaaattattccttgctttcagcaaaactttaatctttttgatactgtaaggcaattcatgcatttagtggtgggtatacagttctagaaaaatatttacatgttaaaaggaaatatctgctttggtcattccaaagaatagtttaataaagagctgtttctaacatcaatctggtaatgtgctttattaataacatttctagacttatgtcatcacaacaaatctgacaatgtttatttttatcaatgccaaagtttttgtttttgtttttatttgaaaacatctcctcaaaggcaaatcagagtcatctctgaacttttcaaagctgctgtcctgggaaagccatagcttaattatgatgattttgagagaacttaggctacttttgagaaatttatccaatgttctttgatatgctctcataatattatcagtgggaatctccaggtagtaaccagaggcatcagttgtcaacttttgtattgagaccctgtccttcacttaaatgtagttcatcaaacaaataataattttcatgatttgatagcagagaaaaatttgagttcttactgatatacagatatgataaatatggagtttcctgcttatctatgttaagataagcatgttcttaaagattctccaaagccatctctttgaaagacatttaaaatggtctgtttcactgaagccaaaacaaaatggcagctgtagttcaaatatttagaaccaagttagcagtttagcaaattctcagtcctcagatagaatttacaatgaagtattattttggctgcttggaaatgatgacttccatttgagataggatggtgtctggaaaggtaactgggaagtggctttaaaaagtctcagaagactttttaacagtcctttatttaaaaggtctatgagaaaggatttagaaaaaaatgaacggtatgaacatttgagagaattgaatatgaagaaagggaagtcattttaaggtgcagaatattccacattatggatgtaatttatttaaccagtaccctatagtcatcgttagacattaaaactattgtctcctattatgaacaaggctgaggtgactacgtttcaaataattattattcatacttatttaaagcacattgttctttaaagcctttacaaattgcccgtatgagcaaactacctgtgagaaaatattttcctttttccaaaaagtaggtttttaagtcttggggtatattttccctctttgatatgtgtcccttacctgatagagagtcaatgttagagtaaatcaatagttaatattaaatactgcttgtagagtgcaatacagggtttacaatgtagccatagcaaagataaggggtttgcattcccatgggctttatgtggggaagtgagatgtggtgaagagtctaataaaggtgggttaaaatgctctgcacctgctcgcacttgaaatttacacagataaagctgaagtcaaaatccttttattaggaaggatgtttgaaaaacatccacagtgttctgtatcactgaagccaaaacaaaattgcagtacatggatttcctatcttagctatgtaaaggtaaaaagtttgaagaaaatacactttttcttattcaaagtacacaattgctttcacttagtaagttcttgttacttccagatgggagtcatataaaatggtgagatttctttaaaaatcaaaactaaaacatacatgtcgtcaaagtcatttctgaacttttcaaagctgctgtcctgggaaagccatagtttaattacaatgatcctgccattacttcaaagcatttcaaaacttctcctactactgcctttaaaggattaaacaatcctcctttttatattaattttctttttcatcctgtcctcctgcctccctgtgcagcttgatcaaaatcaaaagattggacctaggcttgtgctaaaaaaaaaaaaaaaagtcccagagcagtgaaattgtgaaagacagacccttttgtagtcagattgagagactgtgtcgggaaaccatctgtagtaaacatcaggaagcggattgactaatgtaatttaatatgtgtgctacctacctactggcaatatgttgactgtaagtctgtggtttgctgaacaacaaaactagcaatcaacaaaaatcaaagcgtcacgtgtccagagggcttcctatacttagaacattaccttatatgaatatttcaccccttggtgataccgaatgaatgaagtggtacagtaaaaaaagtaggctgatttgcaaatatattatttacatttacacttacaattattgatactacattttgtcattgataaagcaaggtaatttctttaagcatagcaggaattttagacattttgtttaaataaatctagttatttattggtatgataaagataatttctagcaataaaactcttagtacagtcataatttgtatttttaatatttatttgtaatcttgtgatgataaagaatctattttaataggccagagaaatctgcagtcttccacaaggacctttttgaacagaaaggaaaagaaaggtcctgtgtagcatgtttatttgtttccttttaatttccacagttttgctattacaaagatgtagattattttttaacaggttgaatttcaccaataaatatttattgcattgttttatttatgctctgagctcttgactacaattatatttctgaattactttaattaaattttatagattcaaacagattcataaatgactcctagactaagatctagagagagcatgttttacttgacatggtttctgtgtgagttagattagacaaatataaagtgtagatattaaatttaagtaatgtgccttagccaaacttttaagcatttgtaaaaataaatctttgctgacgttttctagaatatacagatgagaaattataagtgcattaaaatatgatgtatttagccatagaagatgtgatctttacacaacaaaaaatcttaattatatttatctcgagaattaagactctctagtttaaagagttaaattgtcatatttttatttccatcatttccatcatttatttccatcattattttgactactattacattacagagataaaaccattttcgtttcctcttcagtacttctgaaatgcatttggtttaactaacttgaagaaggaactaacagcaactaggtacccatggagaaaatgtgaaagtttaggtctcctaaaagagggataaaattatgcaaaacctgttcctcccgcacaatagcactattatttaaaattatttcccttaattgaaatgacaagtttaaaactgaaatgttttcacagtgtgttcatgcaacttcgcaaccttaacatacaaaaaatattgcctaatcagaaaattaacttttggtaagtaaattcaaacgggaattctaaaaaattaatgtggatttctgtattagaattgtacctcacaaaattgtttcattaattgacagtttcttacatacattataatgctttaaaacatataaatatagatgtcaaaataaagatatagatgatgctataaaagtatgtgtcaaatgtaatttctcagcaagaaaagaagagctacatgaatcacgaatgtgtaaaagtagatgggggaattaaataatacaatgcacttctgatgatttgccttcattgttaatggtgacttctgcaaatatttacaacatagtttcttcctgacaaaaggcaaatcacttctaatcattactgctaaggcaaatgcaaaaccctaagactgcagtttgaaaattgacagtatatgtcactttgaaaaacttcaggatataaatatatttaaaaataaccattagcattaataatgttatctttattttatcactggtttagcaaataattgaactatcctcaaccattacaaaacaaatttgaagagagacagcataatagacatagtgggtagccttggctttttccctggggaaactacccaaatatgaacagtgagtttaacttaacaatactctgccagttcatcttgtgggacaaatgtcaattagttgtcaacatttctaatattaaataataacatgagagtcgactgttgggaaagacaaagaaatgcatcaaattgtgagctgcaattggtaaatgttttcaatggttaagtcaggagccaccattgtgtccatataattgccctggaatgtggcttagaatgccagatatgctacatgagcatgtaatgtctactaatgaggacaatattttctagcttattattattcttagttggaacataaggcagcatgatgtaaggagagcagtatagtctcttttccagtccctgttacagtgttaagcatttgtatcttaattttctcaaaaatttctcaaaacctgtttctaagtctttaaatgaatatgtaagagcaggaggtttccagaatccctttctcttaaactaagaaaacgtaaagagcatcttgtgtctcacaatctagttgtacactttacccctggaaaacatttgaaatatactatgaaagaagtaaagcattaaaaggggatggttaaatattttccctggtatatgatgtaaaattcattgacattataagaatatatccattttgcttctttggaattgttgccctaatttttcccaatgtagcaaaatctgttttcatcccaagcactgatcatgctaagttaattctagtaaatgaacccaacataaatttcaatagaataaaacttctacttgtcttgaaaagtactaagcaataattgtattttcagctaagcaaactaattggacacactcaaacaaaggactgtccaagtaattttataaaggatttatggatcaaattaatttaaagtcatgcaactcaaaacaaataaaacagtgtaaatgctagtgaaagagactcaaagtcacttatattctgtgtaaaatttcaagaggtaaaagttgtgccgtccacttgaagtaaatacatcctcaaataccagaaagttacatttgagtaatattaaaacctctcaaaccttaatttatatagtaatatattggtatcattgttgttatcaggagttcctagaagacgttacataccaaataaagtatttttgagaagtttgacaagttataaaagatttttgggtaaaaaaaaaaactttttataaaacaattcaaaacaaatttctctaaaatgaaacgagacaaaaacaacaaaagtggcatgggattgtttagttgtgtttcacgtttccttgaacaatcaagattaatgaaataaagtccttagccaatagacctagaaatatgttgggaaatgaaagagcgtcgatcaaaatgaaaagatgattttatctatctttattttccactggtaatttaaatagcttaaaaatgcatcaattcaaactatttacaaatacagattgttccatttgtttccatgaaaaatagagtaacaggaacaaggctatatttctactttaaattaccaaataactgggccaaccacagtgttcaggatactagatatcagataatgaagaagtgtgatccctgggaaatgggagtcaaataaggtgaattctcttgaccaatacaaagttttaggccatggtgcaagtagaggaaaagaaggtgaaacctggtagaaaatctgagttgaggagatgagagttcaaaaaaacaagggaagctggaatgttcagggcagaataccagagaaaaacagtggcagagaaaaagaaagagagagagaaatagagcactgcagagagtcctccttgagtattcagcagagtactgatcaggacatgaaatgagcaatctacccaatacttgggaaagaaacagaggggtgaatttgagttaatagtgcccagcattcacaggactgggaatggtgactgttcccatccaccacatggaaaaacctcataatacatgggacatttggtagacgactcagagtagtcttgcctccatcatgaaaaataattagccctataccaaacattactctagtctcgcctaagaaatcttaaaagcaacacctaaaataatcaaactcttctgaagtaactcaactatcttccctgaaaaagctcaagaatacttataagaatacaaaaatatgcagcacctatcaaggtaacagtcacaatatctggtacccaatcaaattaccagacttgtaaaaaaaataacgaaaacagtgatccattatgagaagaaaaatcaatcaactgaagccaaccaagaacttatacagatattagcaatagcaaataatgatttaaaatggttattataactggatttcatatattcaaaatattaactaaagacatacaaatattttttaaaagattcaaattgaacttacagagatgaaaaatccaatgacttagatgaaaaatacactgaataaaattaaaagtaaattagacattgcagaagaaactattgttgaatgtgaagacataataaaaactatcacaaattaaacataaatagaaaaaaatgaaaatgccttaatgagttgtgtgacactttcaagcaattttatgtatgtgtgattgaaatcttcgaaggagaagaggagaaaaacctcaaattttatgaaaactataaatccacagatccaagaaattcagtgaacacaaagcacatatagaaggaagaaaaatatatcaaagcacatcacaatacagtttataaatacgaatgataaggaaaatcttaaaagcaaacagagaaaaagtcacattacatacagaagaataaatttaaggctatccacagatttattcctggaaacaatgcaaacaagaagagtatggtacaatatctgaaaagttctaaaaaaaaaacaacaaggatgctataatcagtggaaatctttcaaaaaatgtgtggtatattatgaccttggtatttttgtttattgtgaactttgctggaattttgtgttggagaggcagtcatgtggaaagtgaaagtatatctataataatatcaactttttagaaaaaaattgctttttaatgacaatatcagtatatacatcttaatattaaggttacttctatcagtaatactttggaatcctgtcttcccagtttaatttagtttgatgatatgttgtcattcattttcacaattgtattgatcttcatagaaacaaaatgattatttttcagaatcatatgggaataaatcttttatatatctgtagataattagccagtcttactctctgattgtttatcattgtgaatgactatgtatttttatcatcctggtttgatttagaagtgcaatctccaaagcaattagaatttatagattagattacaagaaaaggtcattccaccaattaaaaactggcacgattttctatacccttacaacatatgccatgaaatgcataaaaaaaatcactagtagattcaatgctataaatataatgtcatgaaatagatttgaattcttttgaaataaagcatagagctgtataagatatatgtcatagactttgaagatattttaccatatttttaaaatataaaaatatttggatatgtatatatttatatatgtatatatgtttatacacattaaaatcattaaacagtatattaactccactgaaatagcttaatgatctgttgtctctagctatcatggccagtgtggcagtctttacaatttctatatctttactggtaactctcttagctaactctctaagctttacttcttttctatatagaaacaaagaaaaataacttatttaaagtcatcttaattttaataatcactgatcaattactgatatggcattaaatcagaaggaactttttgttgtaagtatataaaatttaatcaagaaaaattcaaacagattgagaattgattaccaagttccattattatagaaacttataataatttttttttcagggagtaaaatataagcatgtgattttatagaaatggattacattttttccaggaaaatcatttaaattttgataaagtattattcaaaccaattacttgatgagtattaatgaataaaggaaaagcgcatttatctttataaaacagcttttagaactaaagcaaaacctaatcatataatttttgtgatgcttatatcgtggaatttctgaatattcatattttaatatttgctcaagatccacctttaatattatgctcatttacagcaattaattagccaaaactacttttcttacctgaaatgaagtaattgggtatatattaacatgagcctcattccatctttgtcctttattcccacttgaagaccacagtggattctctattgttgtttgccctttcaaacgtagataaacatttaagacacctaaaaatgacaataaaattttattttgcatattcattttcacctcaaatttgtttttccttgaccaaacacttgtaaactttttaaactgaaattttacagaacactctagtgtcttgtcctctcttctcctctcatttcctatcttgctcttatgacatttgacatttgatccaaaagtaaccatctcctaattccctagaacatgtgcatgttgcctgatattgcaaaagggatttaaggattttgcaatggggagattattctagattattagggtgagtcctaaatgcaattacatatagctttataaaacagaggcagagggagatttgatacaggaaagaaggccatgagagatagagatgttacatggctggtttccaagatggaggaaggggctacaaggactactggcagcttcttgaagctagtaaaggcaaaggaaagggcttctttcctggagcttcagaagaagtcagccctgctgacatcttgattttaggcccagaatgctttttttaaatttctgttctccagaatgataagctaataaatttgtgttgttttagatcatgaagttggtgatcatttgttatttgttacagtagcaagaggaaattaacatagcatgtaatcatgtactgaataacttgctcagagttggactctaattctgtcgtcttatattatcatttagcatcttattttttcagtttgatttttacctgtctcatttttcttctaaaagagttattggaaaataaaatgaagatagcttttatctcattatttgatatctctctttcaatagtttaatgtgctgtacacagtaatgatattaatgatgataatgatattaatacaataaatatatatcaaacacttactccagatgaggaattaatcctctcaacaatcctatgaagtacttattattattatccccacattatagatgagaaaacttagaggggttaaacaatttgctctatgtcatacagtaagaaaatagcacaagcaggatttgaactcagggagtttcagagtcttacatcttaatcactaggcaatcaatattttactagataattttaaaaatcaactgtattgaggcaaaatttacatgcaataaaattcattcatttctatgtgttcaggccaatagttttagactaatgtctactataatgttagtacttgatcaagataaaatcaatgcatcttgattgtatcaatgttcaagatacagaacatttccatttcctcaaacaattttctcactttcctctgtagtttatcttcccagccaccctccctttgctagataactagtaatcaggcttctatcactaatcaatgatttcttttatagagtgtcatattaatggaattaggcattatataatttttgtgtgtttggtgagtttccctaagcgtaatattgatgatatttatgttattgttttcttagtcattttaaattcaatgtttagtttacttatgtttaatgtagctattgatgtgtttatacttaaatataccatcctgttggtttgcatttctttcttctgtttttccttctccctctctccttccattcctttttatcaggaactgatttttttcaggatttataaaaaaataaaaatttaagatttcaatttatttactctactgacttaactttatctccttttactatgcgttagtgattattttagagttaagatataacttctcagagtctaattagagtcaatattttacttcttcatatctacaagtcataattcaaactcccttcagatgttccactattaccttatcctattcacttcactttctatatctcactccacaaatgtaacaaccttacacaacattataattcatttatctgccccatttctttactcaaatatatcttttacttttgtttacattgtaaaccttaccttccggtactattttttaagagccagatatgaatatattttctataaattataagaagaaaggaaatatggcgtttcaatttccacttatttccatttctggtggtttacatttctacctgtagatatgagttacaatctggcacccatggcccaaagggcatcccttagcattttttgcagtggtgagcttctagggacaatatttctctgattcctttaagtaaaaatattctcatttctctcatatttcttgtgaggtttagaattcaggcgggttttttttccacgtattaaaggtgttccattatcttctgcatgctatttctaatgtgaagtaaaccatcatttatttttgtttgtcttgtatatagtatgcttttctttctctttcaggctgctttagagaatttccctttggtttgcagtagttgattgtgatgaatgtaaatacggttttctttagattcatcttgctcagggttatgctgagtttcttctaagtcttttccattaattctttttaaaatttgttttattttatcttattctttttttaagagatggggtcttgctctgtcacccagactggtgtgcagtggtgccatggcacctcacagcagcctcaaactcctgggctcaagggatcttcccacctcagcttccaaagtagctagtactacaggggcaccccaacatgcctagctaatttatttatctttttttatgaatggggtctctccatcttactcaggtagatctccaactgagttcaagcaatcctcctgccttggcttcccaaagtttttgggattacagacttgagttaccacgcctggtcccattatttctaacaatattttctgccacatgtctctttcctctcttttgcacaattaacttatatataaatccttaaatatatatgtatattaaagtacatatatataaaagtacttatatataatgtaacttgatattcttgtataggtcattatggctctgtttatttttcttcaatattttcccctattttctcaaattggaaaattttctttgtcttcaagttcactgacttttttttttctgtcatctccagtcttctgttaagcccacccagtaaatttttttgtttattgtactttgtagtataattcttatttagtcctagccctttagtatagtttctctttctctgctgaacttctttatccattcacgcattttatttcctttgattctttcagcacattctgttatttcacggaacacatttataatactttttttcttttctttttctttttctttttttctttttttttttttttttgagacggagtctcgctctgtctcccaggctgaagtgcagtggcgcgatctcggctcactgaaagctccgcctcccgggttcacgccattctcctgcctcagcctcccgagtagctgggactacaggcgcctgttaccacacccggctaattttttgtatttttagtagagatggggtttcaccgtgttagccagaatggtctcgatctcccgacctcgtgatccaccagccttggcctctcaaagtgctgggattacaggcgtgagccaccgtgcccggcctataataccttctttaaagcctctatctgctaagtccaaagtctaactttcttaagtttggtttctacgaactgatgttaactttttatggctatgaatcatatattctatttatttggatatctagttactttcagtgagtaatgggcattgtagatagaacattatagagactcttcagctgtaatctttctcagaaggctattggctcctgttatagcaaaatgttcagttataaattgaccatgctgaacttgtataggcttggttttccactactaatgcagatctgtgaaaagccaaaattgttgccctaaattctctaactttatgggactcaatctctaaatctgtcttacctatgaatcttactggggcttgcatttagtttaggctgttttggagaatgtctagagaaggcctttctcccaagtatgattctagcctttctggtttcattgtgctgccaggggttttatgagatctctacactctcatgaagtttcatggctgagacttcaatattccatgctgctctcctctcaggtctccttgctctccccacctttgttgtgctgtcaatctcacaaaggttgctgtattataagtcttggtttttctagttttctacatgtacagtctagccttcagcaaatagtcatgagggaaccccatacagacttttggattcaaccctgcatatcttttttctttctgttaccctgacccacagattccaatgacatcaattgtacagtacactaatctttgttttctgactgactgggatcttcacattctgcttgaatttctgggatctgtggcaaggtcaggaaattttcctcaggcagagaacttgactgtcatggagatcactccattagtttctcttttctcatccattgcagtcctaccctgttttttggtctattctctaaaaaatggtttctaatatattttgcccatttttatgcttgtttagggcaacaggacttatctgatatcatttactactccttggcctttagatgatctcattttgattacagataatgatataaattagtaatatgttaatatatacgcttcacaatatacatataaactttacatataatgtagtatataaacttatttatatgaatatgctacataaattctaatgaacagaaaagacaatataacattatcattaaatcactcagagggtagccttcttaacattttggtgtatgttgctttagcctttaaaaaatatttacctgcttatgtatcgttatatgatatagagtagcttatccttcaactttttaaagaaattttctttaattatttacacataagaccacatgtatgcatataatagaagtatataaatatgggtatccactttttaagcaaaaactgcattctttatatcacagctggatgactctggcttcatctctaaatctctcattccctcaacttcttcatcaggcaaatggtaactaaatgatgataactagcataagtttttagtgagaattaaagtatgtaaaccatatattatttctcatataatcagcacatttattattatataaaatattcaactaaggtttctctattcctctattgatgtgttaggttatattaatgcattccataatgttgaactaatcgtatattacagaaataaaatgtactttataatagaccactgacttttttttataaggctgaatcaatttgctagtattttattttggaataattcatggatatttgtccttatggttctccagttttcttttttgattttatctttcagtgttgcattttcactttttgcttcaaaattaccttctatcatttttcctcttcagggtaagaaagaatctcaaacttgtcttccacagaactgactttaatttccaaaccatattgtttttttctgttgttttgtttccaatgtcatctttattctgctattatactatttaaagtgtatcactcttttgtgacctcacagaattctcctttatatctagactttatccagttccatctttttcttggtccactgttctcttatattctttcgtaaagttcatattcttatatgctttgttaaatatataaagcatatgctgtacacattttactttcacttgaagtaattcagtaagtctttttcaccagtatatgtttcttctactatgtgccatgtgagccagtttttattctatggaatcttcattagaacctcatgtttttcctctctccattttcttcctctttattcattcttgaataataagaagtaatcctttggcatttttcaccagacaatttttgaggcttctcttataccctttcatatagagttttatttctcttgggttgcatgaccttttattttgatttaattgacaggaaatacatccaatcaagaaatgcactttttaaaaaacattaaaagaatatttttaagacctattatagtttgctaacaaaatagtgcatactatatgtccttcagaattcatgcgttttaataaatacatgatttagtaaaacatattaatatgtgtgacttatctttcttatatcagtaattatagggtatcgtgccagtactgaatattgtttctcactaagggaattctgtttgcctgtaattatgtttatatttcttaacattttctttttacatatgtaatataaattcaaacttgagttatttctatttatgtttgttgaatacataatatgtaaaaaaatattttgcctaggtttaaagaagccaggtgtaaattatcccagaggtcttattaggtttgagaataggctaaacaaggtgtattcaattgtggctagatgttatttaaaaaggtaaattttacttgtttgataagaaaaagacacaagaactacaactgattgaaataaatctttcaaatataatttcaatgttttacatatatagtaataattatatgattatcccagtcagtgaatgcaaactacttattactgatatattttagaggtgatgagaaaagcagtgttaatcaacaaatgattttggaacttttctcccaggaagtttctagttcttaagtttataaaagagaaatcagtgccaaaagatatttaaacttatgtcaagtcatcttggtcaacaaaattagaacttgtgaaatagaataaagctattcaagagaagttagattcagcaaagctgattcagcacattatagtattatagtaaaaaaaactctgaagtgaatatgatggattgtgttaatactccttaaaagtaagtttaaatccccagagacactgtgttcatgctttagtagacatcagataccaaaacatataaatttaatcatctccaaggattttcaattttataggatttttcaaattctatagttctagaatataagtttgcagaagctaagcaaaactcaaactttttcttttccttagtttcttaattctcatcttttggtcaccactctccaaaaatcaggtgctagagcttagaggactttagtcagctcttatgtttaaagactacaggcaaaaaggctaaatgacacaagtgctgtcttatctcacgaataatggccaaaactttgaggttattcatggcattatgcaatagcctgattattattttaatattatttaatatatattataatataaactataatttgcataaataatatttatcactactgttaacctagttctcttaagttcttaacataattttacttttaattattgtactataaatatgtattatatattttagataaataatttaagtatatgtcctaaaatgtgcatacatattccccatagagtcttgaaattgccacatttacatgaattaatttgcaatttggtatattctgaggtctggagatcacttgcatacaaatcgcattgttataatcagtaacacagacttactgagtttcacatttcatgtaaaatgaggatgtgccaaaatcatccagctctaggcaagatctatgtatattgataggtaattgctagcatcatttgttttatacatacatacaaagtgagaaattataaaatcattattttctgcttgaataaaaacagctgcccatgtccattgatattttttcaacatataattgcagtgctatcctaaatgaaaaatgccagtttattttctacagttattaccattccttctggtgcacaggtgaatttgtacattagagtccaaaatgtttttaaattatagctttcctttctatttctctgatgtaagtcagatcccttacgctgaccttttccctctttagttctatcactttctctactcttccataagcacagtattctccattgtcatacattggctttgtccatttctcatattctttggcctttgttctccacctcctatataattccctcttttgtaggatgctttatatttcttctcttccatagacacttttattttaatgtacccctcagtcttctctcccttgttcacccacgccatgggcttgtcctacattttgatacatattactttctgacttttattttattcagaaatttattacctcaaaaagatgatgaactatttgatgaataaaaaacttttatcatatttgtcatttattctctatagaattctaaacactaggattaggcacacagcctgtgcaattcatcctattgaacagaaatgagtgaattcaaacctaagggtaaaaaatacccattgtaataaatccttaatgtcaatgaaattagttttaaagtttggtacactggatgagaaacagaagcagttaactcaattgcttaccatcaattcaattgatgaaataatattgtctattaattatactgaaaattagacttatatggtttgaagtagcagcctttctcagctactgtgttctcagccttactcagttcatatcattaattttgcttaaacacactagattttattacatacattgtctaagggaccatcatcaatgaagaatagaaaaaaaatgagtttagaagtagttagtggttcaaacctggattctaaaaagataaatgtattaaagattacatatagttttactagcaggtctataacaagtacctgtaaaaagagttttattatacattgtcataagtcatggctagattctatccacctcctcaattttaaattcatctcatttaacaaagcagttacatatgtatacatgtgccatgctggtgcgctgcacccactaactcgtcatctagcattaggtatatctcccgatgctatccctcccccctccccccaccccccaccccacaacagtgaaaagccaaagctaattaatagtgttaaaacagtccagtgcttccctagggtgagagtggtgggaggagattggagaaagggacagaaaagttttggaatggtagaaatattgtatgcattgatgtgagggtggttaaatgagtgtatgcatttgtcaaaactcatcacacttcacttaaaatttgtaccttttgttatatgtaaattatttctaaataatgttgacttacaaaactagaagtgatgcttagtcaatctaatacttcaaacattctaacttaattattttgccttatttttatgtctttacattttagttctttacattttagttcctataagtctggtttttattgctttctgtaaaaggatgtactagactccaaattgagagttgtaaacacacaaatactgacatatcttgttttgttgcgctttgcagatattgctgtttttttttttttttttttttttttttacaaattaaaggtttgttgtaaccctgtgtcaaaaaaaaaaaaaaaaaaagcagtttactgaatgaatgtcttccatctatagcattattttcacatttacagcattggcattatcagcattaaataccaacaggacttcactgagagcatagactaattcttaacagaaagcgtgacttaatatcaactattatcaaacagctcacagtttggtagttattccctaatatctaaatggagaacactaaggagccttatctatcccctcagccacctaagagttgtcttcttcaaggaacttaattctgagaatttatcagaatgcaagtaccttaatattttatatttattccactgagattctcctagagtcagtgaaatcaaggctttaaaataatggctccttatcttaacattctttctcatatggcgtttaactccaagggaaaaaaaatcccaatatgtgagctgatttcctatttgagaatatatttgatatgtaagcaagaatcttgacattttgaattctaatcagaagaaatacagtctttgaccaaaatgagaataaaaatcaaactcataaaatcatgcaaaataccatctttgctttctcaatatcttgtataaaaatatttaagttcctagtttaaaatccttgaatgccagcatatctgttagaaagcattaatccattcttgcaaaactcttgattaatccacatgattatctcaatagatgcagaaaaggcctttgacaaaattcaacaacgcttcatgctaaaaactctcaatcaattaggtattgatgggacgtatctcaaaataataagagctatctatgacaaacccacagccaatatcatactgaatgggcaaaaactggaaacattccctttgaaaactggcacaagacagggatgccctctctcaccagtcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctcctgaagctgataagcaacttcagcaaagtctcaggatacaaaatcgatgtacaaaaatcacaagcattcttatacaccaataacagatgaacagagagccaaatcatgagtgaactcccattcacaattgcttcaaagagaataaaatacctagcaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacactacctgacttcaaactatacttcaaggctacagtaaccaaaacagcatggtactggtaccaaaacagagatatagatcaatggaacagaacagagccctcagaaataatgccacatatccacaactatctgatctttgacaaacctgagaaaaacaagcaatggggaaaggattccctatttaataaatggtgctgggaaaactggctagccatatgtagaaagctgaaactggattccttccttacaccttatacaaaaatcaattaaagatggattaaagacttaaacgttagacctaaaaccataaaaaccctagaagaaaacctaggcattaccattcaggacataggctgggcaaggacttcatgtctaaaacactgaaagcaatggcaaccaaagccaaaattgacaaatgggatctaattaaactaaagagcttctgcacagcagaagaaactaccaccagagtgaacaggcaacctacaaaatgggagaaaatttttgcaacctactcatctgacaaagggctaatatccagaatctacaatgaactcaaacaaatttacaagaaaaaaaaaaacaaccccatcagaaagtgggcgaaggacatgaacagacacttctcaaaagaagacatttatgcagccaaaaaacacatgaaaaaatgctcaccatcactggccatcagagaaatgcaaatcaaaaccacaatcagataccatctcgcaccagttagaatggcaatcattaaaaagtcagaaaacaacagatgctggagaggatgtggagaaataggaacacttttacactgttggtgggactgtaaactagttcaaccattgtggaagtcagtgtggcgattcctcagggatctagaactagaaataccatttgacccagccatcccattactgggtatatactcaaaggactataaatcatgctgctataaagacgcatgcacatgtatgtttattgtggcacttttcacaacagcaaagacttggaaccaacccaaatgtccaacaatgatagactggattaagaaaatgtggcacacatacaccatggaatactatgcagccataaaaaatgatgagttcatgtactttgtaaggacatggatgaaattggaaatcatcattctcagtaaactatcgcaagaacaaaaaaccaaacaccgcatattctcactcataggtgggaattgaacaatgagatcacatggacacagcaaggggaacatcacactctggggactgttgtggggtggggggagaggggaggtatagcactgggagatatacctaatgctagatgacgagttagtgggtgcagcgcaccagcatggcacatgtatacatatgtaactaacctgcacattgtgcacatgtaccctaaaacttaaagtataataataataaaaaaagagaaacttaatgattagttaatttcagattctttacattccttctctacattaagttagatcatcataaggtgacatacctggtccttaatatttcagctgaaaacaaaaatgttattttatcctgtattatggtttatcaatatattaaatttttatttgaacaagttttatatctttatcctttatatgaatatcttagtaagtaaagatattgctggtaacattactcaagtgtacttttataatatgcatttctctttgcattaattgttaagaatatgtgacacttttgcttttctttttactttagttgccagagcatatagatgaaaattcaagttaagtcaataataaacttcatcttctgtctgtttttttttttacaatctataatgtcttaatgaaactaccttctatttccaaactaaactgcatactttcaattcccttgttttgttattctagtatatccagaagcaaaagaatctagtttggatcattctttaaatctattgtgtaaatgttgtttccgagaatcaaatgtaaataaatcatggttactgctctcaaggagtttacaattttacaggggtcagtgtgataaacattatgataggtatacatatcaggagttttgggaacaaaaggagcagagaagataggaaagaatttcagcatatatccctgaattgcttttttaaggaaggttatgcatgacttagatgattaaacaggagaaaaagtacttattcaattagataaacaaatatttattaatttttttgggggagtacttgaatatttacatgcagggcagggtgtcatcagaagagacatcatttctactcccatcaagcctacagttcagcaggacaaaagagacagcctgtgaagaggcttcaggcacaagagagctttacccgaaaaacttcaagtatgactggaacagactatgaagctaccccaaggaaaagccagaggggcatatatccttgaggtcctgttactgcttttagagaaagatctttaccctggaagctatggactttttaaaaaagacagcaagaaaatcagttagcaagcgaaatgcagtactacgcacagatggggactcaaactggccattatattccaaaatgcgtttcagaaacctacagattgatgtcctcatctccaacctctccagctgtctctatattgtcagttactttgtgctcccatttaccactctcctaaagctatctcctctttgaacatgtacctctgtatctgttttgcagagaaaatggagactgttaggaaggcaacttccatgtcagcttgctgttattgcagctagaaatctatcagaagccatgttactattaatactgaattcttttttttaccgctttagtggaaatggcatcagtttctctcttaaaagtctcattccacagccagagctctaaattcccatctaagcttaccctttttattacctctttttcctcttaaaataagcccttctacaatcccacatctctatttatcagttcttttacagtctcctgcttcttcattaatgaactcctttgctttccccctgtttactccatagtggaattagctttctagagacacaactttattgaaccattcgtatcaagtacaatgaatgtattcataagtgccttaatttcctgatatgatatgacctttacattgcacattctttttttaaagaaatgaatgatgcatttaacttatttttaatacacttttgtcatatctagtgatctcctatgagattcttttttttttttttttttgcaagaacattagaaattcagtggattcatcgagaattgaaatgtccattagtagtcacaggaatgctgaaagaatcttttattattatcatggccagatgttgtatcacttacatataaatcagcaggtactttaaggataacattatagttttcatttggaaacatgtttttttcttcaatcaattttgatgaaacatttaactaaaaagaaattgtaccaatgtggcagagctcaactcaacctaggtcctagcatgaacactcttgggcatttctctccccttgggtatgggcttgaattatcaactcagtcacattaaatggaaccagacagacatatgggatatcacttcaggggttaggttatgaaaaatcctgggcatgcattctctctctcttcttaatggattacttgctttgaagaaagcctgctgccatgttatgcgacagccctgtagagatgtccacatggtgaggaattgagggaggcctccaatcaacagccagcaagaaatcagtatctatagtccaatatcttaagggagcaaagcctgccaaaaatcaagcaagtgggcttggaagtgtatcctccccaaactgagtcttcaaattatggtggagtccttttctggaaggactataaccttaggagagactttgagccaaaggcactcagttgagctatacttgtattgacccacagcaactgtgagataataaatatttgttgttttaagtcacaaaagtttggggaaatttgttatattgcaaataataagtaatgcaacatatttaactttagttcaaagaggaatctcttttcttagtagggtattgctcatttctgtattagataattatgaaccttctcaatggtatactgtcctttagtcacagttaaaagttcaagatttatttacaattactcatgaagttataaatttaattaggctattagaaattcaggacaaggcatctttgaatctggatttccaaaagaatgactaaaactgaaaatacaatttgtaaaaccagtggctataaatgcctcctgagtttacagatgaatgaaagtccgaaaataatatatgcaaagaggggatgttttaactaccagcagatctctctaatgaactatctcatctagctttaactgattactcaatgtctggaccaggtatttttgcctagattttagtaagcagcatgcctgcagcttgctgagaggaactcaagtaatagacctgatacccagcctgcaaccttcagtctgatgaagcaaagaaatgacataggggtcaaaatgtaaatgtttgccaagaaatggagaactgtcctcctaattttccctcatcccaaaataatcagaataaaactagcagaacgtcaactggacatccattgacaataaagaagataagactaacaactattaagttaaaagtatattataatgatgtattaaaagtatttttaaagtatcttaaaattattttaaagtaaagccctaaaatctagtctcataaataaggtgaacatattttatgactttaagtaattcagaatattggtcttggaaatatttatttaaaaatcaattaaaatatgtgatccaatgtaaattggaagaggagaaagaaagtacatgacacatattcaaaacaaagaggaaacagagtatacattattaacaaaaaggaagaattagagttgagctaatcctacattagtaataatatagtaatcccacaataaataaaatggcttggcaattatgcgatttgtttcctttcattggttctttaagtgattcccagtctagattctgtttctgaatgattttacctatttttatgtttattttcctaaatcaaatatctcattatgctttttgattgcagaaaatctaataactcacaccactactaagtaactgtcacatacttagctaggcttgcaaaatcttccaacaagtgttcctgcacagtaataaaacaggcagactctgtccagcttcccatgtttgtgttatggcttcactacttagccaggtgatgggcatggtaactaaagtcctttgtatttcaattttgttatctatgaaacaggataatgattttaataagcacaaatgttgatcgtgaaaattaagagaaataatccacaaagtatcctagcccatgatgagtactccataaatgtcaactattattttattattgctattattattgctatttcagattcaaagtaacctaagattatgagtgtctgccatctggttgaagatactatgtatgttgcctaatttaacttaaactacagctttctgaaataagagttattattctcattttacagataaggaaaccaaggttcagacattttaagtgatttctctgaagtattacagtgatgaagtgctacagccaagttcctgcccaggtctcctgacttcaagtttatagtagtttaacttctcaaaagctttctggctgggcacaatgactcatgcctgtaatcccagcattttgagaggcgaaggtgggaagattccttgagaccagcctgggcaacatagcaagagcctgtctcataaaaaataaaaataaaaataaattataaaacaaaacaaaaaaacccaagtgctatccatttaggcttgtcagtatactgtgaagaatactagttaatactgttgggtatgagtttgaatcccagcacaaccatttacttggcagttcacacaaacttcttgaggttcagttttctccacggtaaaagatggacagtgacgttcacttttacaaacttaattgagagtattacttagcttaaataatatggtggctgatacatattatgtgtccaattgtattagtttacatcacatatatttatactatcactttattaatttatataaagacactaatgtaatcctaacttctcaaattttacttccttattaccagtgctttaaccctccctgtgctaatctctgcgtattgaaaacatacctcttttgcataccagagaaatgttcttgtttgtattgatgcagtgactcattcctcaactagataaagatccacaatccctggttcaagctctatggggttagatatacttcattatttagaattttgtcttatgttagaaaggtgagagattatatcacttatatcatgtgatatcttctggaatggtctcgagtagaatcatattattaaaaacagtaatatttttgctgcaaatggtataaatgtccacattcatttggatagagactatacataggttcatatcagttcaggttatatatcaggctaacatgtaatgtcaaataattaaattttaaaaattgatattcagttctcaggattttagaattgcacataaagaatggtagacctgcatgatctttttccccacagagtttactaggtctactctcagtgtaatgtcatgctctatctagcacagttgtgcatctgatcttatcctctattactgtacaaggtctcaagggaaggaaatgtgtctttatctttgtatgctgtgcaggacctagaatgttcttaaatcttactgggtgtgtttggcatactttaaaaacatgaaaaaaatcacaccaacgtttcaaatatgtggatggtgctaaaaataactgtcaatatagcaacatgacaatattacttttcatcatgattaatatgcattcagtcactgtcgaagcatgtttcttcggaaagaagcagcctaaattatgctgtgtcaattccatgagacctggtaaagaatttaactcattgattgtctacctgatttaggattccaaagggaggtaggtgatgatctaaaatgtcaaattccaaatctaaattagatggtgggaaaaaattcttactatcttattttgcaatttgcagataaatcatttaaaaagtgaattatagcattctttgaccaaaaattgttttaatgctgtgtgtttatgaacctttttcttcttagttatcattaattttgtaagaatcagtaattattgctatctcacctatatgttgtccatacatgtgataaaagaagctgaaacaatatgcagtgtttgtgggtccataagggtttttgggagctatgctgaaaacagggctgagaagtcgagccttttcgccttccaatctgggtcgtgatgtctcaatgtacatataaaaaccttaaaacagacaaaataaagtgtttaaacacattattcttaggcataatgaaatttcaaatcactgagaagtcttatagttttcatacaaaataaagatggataggaagatttgcatctcatttataaaatctctatgtgtatatgtaactaatagtggctgtaacacaaagaataaatgatctaccaaattaaagataaaatgtataaaaagttgaaatttagacttgaattatcaaaaaattcctattctctctactatatgtatcagtgaagtctgagaaaaaattaatgtctacaaagttttgtaaatatctaaattgatactgtacagaaaatttaatattttattccataatcttcaaatatatggctaaatattagtatttcatatttatagcagtttttaaaagtctctgattgctatgaacacaaaaggtcatacccccataccttctttggagccactacggtcagcattaggtcctgtattaggagtatattttgtatttcttgttgctgtactttgctttgtccagtcaaaattatctgtatcatcttgagtgaacaaacaaatattaccatcttcaaatccacaatgaaattctcctgttggtaaattttaattaaattaatattaattaaattaatacacatactgcaatattttcataagaaaaatgtaaaatattacatagcaataataatgcaagattgtgacaatggcatgagagccataatggtgcagaagattacaactaaacataaaaccaatctaattttaatgaaaaagtaaaagaattttacatgtaaattaatatcttattgaataattaagactcaaacaatttttctctaaaatatccagataactgaaattaaagaatataatttatgcttgaattattgctgaagaattttcccaactttcattttgtcagtatagaaacaatcaaaacaaaactgtcaattggaaaattacctttattaatttacctgagggtagttttaaattggtatactttaagtttataatttttcatgcatgtctagagatgcttttaaatatccatttgcataaatggaagtgtgtttagggcaagctaatagcaaattattttgaaaagtatttatccttcctactttatctgaatgtgggtttcccagatacttgaacttcagtatggaaatgaagtaattaaaagaccttttaaagactttgaaggactgtgatttctcggatgcctaacgtatgttgagttcagggccaacacaagttcagagaaagactttttcaactatccctgaaatgtgggtggtagtagtaatgtttctaggtatcaaaggttttcttactgcttgaaaaaaataggtataaataagttggtaaggtccactagacacattattaaagagtgtgtatccttgagaaagaataaacataatgtatattatttcactcagcctcataacaactctgtgaaatcacaataatccttactcatgaggctttacagaggagaaaactttggcaaaggtcagctattaaatgataatgtcaaatggaatccaaattccctggaattcatagagatataaacacttaaagaacagagacttccattttagtctctctccgacctacccataaggggttagatttatcagatatccttggaaatggagtcctggttgagatcatgtacctgaattaattgaaaatttttggtacttacaaataaaaataaaacagaaggcttttcctttaaatttagggaatgagtttatgttttgtttttgttttttagacgaaacacttgctttatctctttgtatttatttatattctatattctgggtaggtaatgttacaggaaatatacatatttaagggagtctaaataaataactcaataaatttctgaataaacattattgtacataaaatatttattagacacatatttatgtcacagaccttgtaccaaacaagacatgaccttttgatgctatcagttggaaaaataatgttggtaacagcagtgtagcagtgtatgcatttacatacatgcacgtatttctttaaagatattttaggtatgacatgaaattccattagttgctactctggcggtttgaataccataaaggcaatgtttgattttgaatgttttcagttatttaattatatattacatatgcacaaaaaagagtcacagaacaaatgtaaagataaaggatttcagtttatgtatctactgccaagtcttactttttatatgttatttaaaattatgtataatgaatttttataacactgttgaacctttttttcgtaatttaaacttggttaaaaagagaaaatatcttgtctttaaaaatctatacaataatttttgagacctaaatatttaagtctttcatagtaaaattaagcaataatgcagcttatgaaaactacaaaaaatgtcagttgtgcctaaaatttttcatcgtttaggttattttatatggtgtaagttgtttataatattataactagtgtaataattcaaatcaaacaaagatacttaagcaacatcaatagctctcgattccttctaaggacatatatctttacaataaataagcctattactgaagaaaatttataaaaagttggcaggtaaaatgaaaataaaactcactagtcaaaacccaagaattttatgatagtcctgtcactttaaaaagagacaattataaatatgtgcaaatacatttattcatttaaaaagtttattagaataaagaatatctgatagataatgataacgcaatgagctgtacaaacttttcaaaagtcaatgtaatataaaatactaaaagagtaataagtataaataagtaataaagtccaggattttcacaaagatatagaactgagaatcaagtggatcttgaattttccactggttttctaattacaacatgattttagcagagtttctggggctacatagaaataattaaacatatcttaaatattctccattacgtggtcttcaaaattttgctttatttggtctgcagaattttccctgaatccttctcaatatgatgaaaaaacaaaacaaaaaaaaactcaggaacaagaatcctgatacccagtggtccttttgcacccagagacgatgctctttagtccttaaacttgtaagaaatctaaccttaaattacaaataaatagctctgattttagaatatgtcttcatagtaaatcctctgttgatttaatattattttccagggagagagaagttttcatatatgggaatatttttcaggtagatacatatcatcttataacatttaatataaaacaaaataaaaactttccagaagtccccaaatttaacaattttatagaattcataacctaaattagaccaaatacattggagtgtaaactagtgttctataaaagaaagtctcaattaaacccatcaaataccaactttctaagtaaccatactcttttataagtggaatatagacattcaaagaaggaaaatcaaagaaacgtgtaacaacgataaaaatgatatgcaatcccacaaaagaaaaaaataatcccacagctgcagaaatagcaaatattaagcaggttggtaaatggctccatatttcaatatttaggaaaatctataaacctcaattatcagtattaaaaaattgtatttatactcctatcctttgaaatttaaaatctacatttaatgccaattttactgattctgaacaattgtgttttaaaccaactaagaatagttactaaacaatttttgtatatttataaacattatatttttgtatttattaaatatagtgccattttgtaagttaaaatatacttactcaaatgaggatttacaggagctacaagaaaagcaaaagaaacaaacaaacaaaaaaacaatgttagcatggcttgaatgtcttttataaataaaagtctaatcagtgtctcatagttccttaccaaaacttaatgatctttcccactgtggccattgagatttatatctgcaatccattttgttttagaggattgaatataatctgctttggagctcagcaataacagcctcaaattaccaaaaagaccaatgctaaatagcacaggaaatgttcccttttcaaggtatagagtttctgacctcttaaatatctgaactagtgctaaacaaaaatactcagatatcaaaactgaggctgaaactaggccaatctataatctaggtgatttaaaaatgaaaacaattatctagcagagtttccacttttgttttttgctgttttctacttctactgagagtaaagtagaaagttcatggcacagatgaaaataaagcaatcctgatatcatgttgtaatatgtgtactaaaatgaatagctacatcaatgcctttttgtttaattacagtaaaatatacacatacatatacacgtgtgcatgcacacagaattttaaaatgatgagcaatacattttctgttctggggtaccaaaagaattttttttcccctaaaactaattatatttgcaatacaagtgccaatgaatttccacccaaagagaaatgaatactttaaatattactaacacaacaacaaaaatatctctcatctaagggccaaatttgtatctgtatatatcaattaaccacttatcactctgagaaaatattccaatctggatgaaggacagcattgatgtaattccccaagattacaatgggcagaatgtagtttcccaggattacaattggcagttaatttacagtgcagaacttatctgatttgtcattttcttagtggttgtcattaaccacttttgttaaatttgtgcaacagtaataaactctgacgggcaaaaatattcatatataattgcaacattagtatacaaatgataaattttaacagagtaactttttcaatgatttccactattcctacatacagaagacaattcccattactgtagttgtttttctgattctacattccacattgcaaattatgaaaagaataacagaaaaggaactgaaagtgaactaaaaataacaatttaattttttggcaagatatccatgtattttaattttaaaattagtaaaaattaaaattatttcatagttaatatgaaattcttaaaaaattatgtgctatctttcaaagatgtaagcgtccttgaattataacttagttctaagatatgttgtatgtacatgtaaagctcttaccagactgaattttaattgagactttgcctccaacatttaattcaccaaattcactatacataatgcagttaactttgtgaaaatttgcacaaacttctaaatagttcagcgagtccagttttttcttctttcatttgaacttgcatgtataatttttttataaatgcatattatagacaattgtgtccccataaaaatgcatatgtcaatgcctaatccccaatgtgattgtatttggggataaatcctttagggaggtaattaagattaaattaatcttggccccaatccaatgggattggtgtccttataagaggaggaggagacaccagagagctctctctgccatgtgaagaagacatggtgaaaaagtgaccatctataaattaggaagagagctctcaccagaagctaactatgccagtgctttgatcttggacttctcagcctctaaaagtgtgagaaataagtttgtgttgtttaagcctcccactatggtattttgttatggcagcccaaacagactaatacattgcctctaaaccattaaagtatacattgcccaaacctatatcacataaaaataattttaataaaaatgttggagatctgaatatgtatgcctaagtatgtaaaaacaattttgaaaacttattattaaaagtaatatctatttcctgcatgtgtttttcattttagtttgttgcctcagagttttcaataaccactactaagctaattaactttttaaaatctcttaaggaaagtcataatgatcaattaactttagcaaagaagtaaagatcttctctaatggagtggtgaaccctaattctagtcaggtttgtcatttcacagtcatttaactttgcaggacactgaaactttctgggtccgaatatcttcatcttttaaagatattgatattaatgcactctacattatacatcttatttatttggtaaaaactgtaagtacaaacaactttaatgagttgttaatagttttacttcatatttcacgtttgacagtattcactactttccccttaagcaggaaacgtatacttaagggtaaacacaatggagtacttcagctgcaaacaaagcattctattatctttttaactcaggctctgataatcagtgataaaaagaatcacgtttggccgggtgctgtggctcatgcccgtaatccaagcactttgggaggctgaagtgggtggatcacctgaggtcagaagtttgagaccaggctgcccatggagaaaccccctctctactaaacatacaaacattagctgggcgtggtggcaagtgcatgtaataccagctactggggaggctgaggcaggagattcacttgaactcaagaggcggaggttgcagtgagttgagatcatgccactgcactccagcctgggagacagagtgagactccatctcaaaaatatatatatagtaataataatattctactgaagcaatacaataaatatgaactgtttaaataatgattcattcaaacctgaaatacattgaaaattctacagctaacactgaatattaaaattctaaaatgcacacaaatttcaatttttgaaatatttatctctttagtatacagtaaaataacatatctaggctgagtgcagtggctcatgcctgtaatctagcactttgggaggccgaggcaggtggatcacctgaggtcgggagttcgagaccagcctgaccaacatggaaaaaccccttctgtactaaaaatacaaaattagtagggcatggtggcacatgcctgtaatcccagctactcgggaggctgaagcaggataattgcttgtacccaggaggtggaggttgcggtgagccaagattgcggcattgcactccagcctgggcaacaaaagcaaaatcccgtctccaaaaaaaaaaaaaaaaaaaaaaagaaagaataaatatatctaattgccattgtttctctttgagatattaattctagataaaagttttagatccacttttaactttttcaaagttctgcactaatttctatttttctccaaataggacatttaagtagtgaagaaatattttatgcatatagttaataaaaagaaaactatcactaacacacacacacacacacacacacacacacacaaacatttagcattttttaacattagcaatatgaaaaatgaatggccaccaacaaccaagaccaaaatccggcaactaagatgtcttttgatatgtatataaataaactggtacatttatgcaatggagattattcaatgataaaaagaaatgtgctatgaagtcccaaaaaggcatacagaaatcttatgtatttctaagtgaaataaggcagtctaaaaagcactacatgctgtatgattccaaatttacaacattctcgaaaaggagaaactatagacagagtaaacatatcattggttgcccggactggagaaaggagagataaatgggtagagcatgggaacttttcaggcagtgaaactattctgtgtgatactgtaatggtggagaaattatatacacttgtcaaaatccatataactgcacaacacaaataactgtaatgtataatactgattttaataataatttcttagtagttgttaatcaatttttaccaatgtaccacaataatgtaagacgttaataatggggatactgtgtcagggagacggggctctgtatacttcctgccaattttctgtaaaccttaaactgctcaaaaactgaaatctattaattttatttaaaaaacagaaaatgaattttgatctttttttacttcttaaaaagttttaaagtcatcaagaatttgaaaagataaaatgcagacaaatattgtattataacttgtaggatcaaaaataaagaaacattgcttatatcacataggttcacaattaactaaattattctatatctctacatttgtaatcaaatgtcacatttatggtgattaaggtttttgtttttgtttttttgtttagttaactggctaatgatccagaaagtcaatatgctaagttttactttgtgtctaaatttggtagatagcagcaaccaaaattttccatatagttaaatatataaataaataattttaaatgaaaggctacttaccactatatttgatcacacgaattgttgaatctccttcaccaaatttggtgagaggagtcagtcggacttcataagcttctggtttaattagctctgtcaagttatatgtaattaattctcccttttgaatattcccatttattttaatctcctgctcccaccagcgctgctgtccagcctgaaatcaaaacaataatagaataatgttcccagtatgttcttcagaggtactaagaaaattgaaaacaaattttgaaattttattaaatcaaaaagtacgtatattaatgaatacgtattattaaagttcaagtttctataatgataaacaaattttgagatgtttgcatgcatatgtttgcaggtaattgccaaatgatcagaggtatttaatagatttaatatatcatctaatgtttagtaagagtcagaaaattccaaagtgtctctgatcttgaagtcgggagagatcaaagtttagctacttcttgcttaacatattaatggcatacgagattcttgaatacttacaactctatcacattagcaaacatatgcattgcatatataactgttcccatatattatgggcattaaaagtataaaacaaagacaaatccttaacttttcaagtttattaaaaagagaggcacaataaacaaatgtataatataaaatttcagttagtcatatgtacaatagagaaaaataaaaaatcacaaggagattgaaagtcatagtgggaaggctggaaaggggcactctttagttaaatcagaggacatctccataagaagaatgttaggaagttaagatgaagggtaggaatttaccatgggatttggcaagatggaagcgatggtctccttgaaataaatggtgtcagagtaatgaagatgaaagtgtgattgtaatatgttaaaagaagaatgagtttcacaatgcttccctcactaaaaaatcacaatgctcagataatttcacagcacagttatcaaaatgttcaggaaagaattctaatcttttacaaaatcttgcagatatttttaaaaagaaaaacaataactctccagctatgttatttaatttaaaccaaaaaggatggtacaagaaagaaaaacttatgtatacaaaccgaattcataaagttttaacatacaatattgtttccaaattcatcatacagtactgttatcaaattcatcaagttttacatccagtattgtttctcttgcaaggatgcaagaattgcttaacattagaaaatgtgttaacatagttaactggcaaaagaagaaaaaacatatttctactagatggagaaaaatttgggaaacatcaactcctatttataataaaactatgaacatgctaggaatgaaagggaacttgattaatctgataaagaagatccaacaaaaaggtagaggatgctttatttttaatgcttatatattagaaatttttttagaattacaagtgagaatgctcaacattatttaaaattgtactttagtaacaataaagtgtataataattggaaaaacaaaaccaaaatagatctatagagttgtctacgtaggaatctctctctttccttttctctcactctatccttccatatgcatatacacttgaatgtcttttacaagcactttgaagctttctttattaaatgtatgcatataatttattagatgagataacaggtaatccacagctttgtttgctattgtaaattgtaacttttaagctattaatattttgctggcttatacaattgtgacagatttttttattctccttaattcagatatatatatatgacaaatacagtcctctttctatatgtatctaaacatatagtatgcatcattgccttgtaatatgtgtctgatatttttcttagctgaaatctatggtatcctttttcatggggcttttctccttttatttgcttggttatttttcactggtgctgataatatggcttaaaattctattattgggggttatctgtggcctatgacaaagacatattctgtatagatgtaccattgtttctgacatgctcctaaggtcatcaacaacatggcctacttttactttgattgtgaaactctttggtgtcacaaattagagtggagaagatcccttgctttgagaaggccttgagttttcattgctgtctgcctcaatggtgccaaactattaagaatcaaagttcaagtttgtctgggttggcaaacagctgagggcaaaagtagtttgggcagaaattctgttacttttgaatgccattttcccttggatttttacgtagtactttctctatgtacacacacatacacatgtacacattatatgcacaggtacacacacatacacatatcacataatatgcacatatgttcacatatatgcacatactatatgttcataagtatttgttttctgaaggttaagttagtcctaattatacagtcttgactgctacatttctggaaataaaaactacaatatgtgtgctacagcacagtcctacacaaatgacaaattaaataatggcatgggaagaaagcccaaatataaaatatatagagtgtctgcacagaagagagaaaaatatataccattcaattggttatgcatatggaaaaaaaccacttgaattggaaccttatatcttatacataaaattcagtctcaggagtattaaacaattaaatttaaaacatacaatttaaatcagttaggaaaaatacagaaaaaatgttattatgatctcaggtaatacattactttcttttttgttttttttctgagacagtctcgctctgtcacctaggctggagtacaatgatgctatctcggctcactgcaacctccgcctccaggattcaagcaattctcctgcctcggccccctgagtaaatggaattacaggcatccacaaccacgcctggctaattttttgtatttttagtagagacagggttacaccatgttggccaggctggtctcaaactcttgacctcaagtgatcacccaactcagcctcctgaagtgctgggattacaggcgtaagtcaccgtgcctggccaatatattgctttcttaaacagaatagggaaggatgaatcatgaagaaaaagattgagaaatttgtctaccaaatttaaaattaattaaatataaactttcaagttaaaaaatttgttctcatcagtattcaccattaaacaggaaaaatacaagccagaggtttgaagaagatattatacacatgttaatatacacaattaactagactttattaaaaactcattttgataacaaggaaaagaattcagtagcaaattgagccaaataacaacaagtaattcatagatgaggaaatccaaataagtaagtaactaaagaagaggcttagcctcacaatgaatcaaggaaatggaaattaaaaccacaactttattttccaccatcaagtaggcagaaactttttaaagattaactattagggctttgtatagatgtaaaacaatgagaatctttgtgcatgtcagaaccagaggattggggtgggaaacaaatgagatttttatcctacgtataagctaacaagttagcctgccacaatatcatgaatattagcagaagactggagactacttggtcagagaaaatgactcatgactcagcataaatcccaagctttattttagcattgatcctccttacctctgaagttccacagaagtactgcagatgtgccaaggaggacgctgcacatgccttgattgtgcgtcacatctgaaggactctgagtttaagaaaccttagtctttataactgatagtaaccaaatgtgtccaaccattgcccagaaaggagacatcacaggacatcaaacaaacctcccctctgttccagaagaagacactacattcaaaagacgtttgctatgctaatgactcgaaaagacaggttgtaataaaagggcaactggtgcctctgggcacaagacacaaagaaatataagcaatccatgaaaaattgtctttcaaacatgtgtccttgatgaaaatgcaaattggtataagtttggagagtaatttgcattaaaagccatgttacaatgagaacagataaattcttatacttggaaacaagtatattcatcgcatagaaaatggaaaatgatctatacctcaatcgtttaagaggtgataatgaaattgtagactcttcataaactggaatataaaatatagcatgaaaaaggaacctatgcaacatacatcaacatggaaaattttcacaaaatattgaactaaaattaattttgaagtagatatgttataaaatttagttttaaactatgcattttaaagaggatgtatagctatgtacatattaaagaataaagaaatgaagagaaataataaacactgagttgaagatactgtttaaataggttaggagagtgcaagagatgatgatgcagttgtgaggggtaaagaaaggacttcaactctaccaggtgatttttgttttgttttgttttgttttagattaatggtagatgtaaaaattatgattatgttattttgtgtaggcctgaaatgtttctctgtttttaataaagagaattagagaataagagagagaaggaattctgaattttcttaaaactctttcccccttgaattctatgacagtgctctctctcatattgcttcccacatcagcatctttggctactccttattttcttttcctgtgttctaaatgttgatgttctccagaattttgtatatggcgtttgtggtactctgtattagtggttctcatatttctgcatgcatgagaatcactagatgacactgttaaccaaaattctaagtctcaaccatcagcaattatggttcaatgagatctaaaaatacgatctttaaaaagcatctcctctcccacatagtaatttggacacaaataatccagaggctacatttagtgaggcacagattagtcctgctaaaccacctcattactattagtagcttcttctaatatctctacattgataacttcctaacttgtattttcagctcagaaaattaagaaaaaaaatacatctattagtctttaccatgtgccactattttaactgtcttatacctatcattatatgtaatatcccacaaaccctagcaggtagtaactatatttagccctatttcatgaatgaaaaaactgaggcagagacaggttaaggtaactcttttaagtggcagcttcagaatgtggttagacccaaaatgactctttttggtatcacttcctcctttgttttccctgaatatactgctcccttaattgtttttaccagagcccttatatatttagttataatacactatgtctggtcattaacttgataaaaatatgatgaaattaaacgccagcatacaatgtatttttaactggcctccaaggagtacggcagaaaatcaaagttatttcagtgaaaactgcatacagtcactgaatttacatacagtggtgaaggataaaaatcctaattccacagaaagcacttatctttcagataagcatgcatagttaatactaggtattatgaagcttctattagtttggtaggttaaaatactataacataatataaatgatgacacttttactgtctcttaattttagatttatatatatatgaacaataggcaaagtgctatgattttaaaagatagataaaatcaatttaaacacacaaaaatatatacagaataatttatttgatattttacttttacctaaagacacaagtttaatcaaggtgtactttccttgatgttaacataagtttaaataagagtttaataccactgaaaatttgtagtacattacaaagggacactgcaggtatcctcttgttataatgagtgttctactcaagtaattttagtcaggagatacgttgatgttgttacttattacaaactccagtgtccataacttcatatgtgtattaaaaaagcaataactttgattccaagtctttaatttaagctgtaatgaaagtgtatacttcagcagttggcagaataagcaattaaatacttcatattgtatctcagtgagctgtgcaaaatgtaaaaatggaaaactaaatgcaatgtttgcacatacataaaaggagatgcaatattattccactgattgaacgtaataccagaaaaccctcagagaagatgggttctaaacaatacagcagatgacaatcccagatcatacttataagcatgatgatatgtaagtaagtgttaaaccattttcttcatgtcaattttaaaaatccatttaattttttcttttatccccaggaggtatattccattcagatgatttagaggttagcctaaaacctcccaagtaccctaaagtgagactttttattaaaaactataatttgttatttttaccacagaagataattaaaaagctattgctgaaaaggtctcaggaggaaaaaacatgttaattttttctcttaattttataagaaacaaaattgactaacttaaaagcagaaggctgcaacagattctgaaatgtgaagggaataaaagtggtaatgttttcctcttttttttttttcttggactataaatctttttaaccactataatgagctccattgaaaagtaccaggtaagtaaaaactaaaatagaagaggaaatgcaacaactgaatacaaggcatatatgtgtgtttatttcatttatttttatgtaactctataaaagattgatatatccattttataggaaactcctattcatgtttagcaaccatactgatagtaaaaataatagctgacattaaaaatccaggtattacagaccctaaatcactcacactaatgattatccaacagaataagaaatcaggaagatgacattttcatggattaaaatcaaattgtcttataatcccaaataaaatgtaacactgatttttaagatgcactattgttttaataaccccttttagggaaaggagataataactaacatggcgttaaatgagtcttatttttattttctactagtaatagcaaacatttattcaactaattatataacttttcttctttcattaccacaaatttgagtatcatcttctttacattcagcaagaattcttctgagtaggcacttttcacatcatagaaatattttgcttatcatactttgctcgtgctattaacacctttagaagtgactgtgtattttttagatatccagaaatttataagtttttatctgcctttggtctttggaatcttgtattatttttcttaattgaattatgtctaaattaaagagttttccttgaaagcatcctggtgtggtataggagagaatacttcttgtttgaactcaacttcaacagttttttctagttgtgttctagcgtctagcatgcatagcatttattttttatgtccttggaactgtcttggcttttagtcactagttctattcagtctgcatttttcttaagcaaatcacaagttccttgagcctaacatcattatctttcccttttcttttgaagcggtgtgggattggtgaatcctgacagcttccccagaactacagtaaggcaaagaaataccaggccccattccttgaaaatttgactcagtctaccctactatgctacttgagggctcccccaagtgggacccagatctcagaacttctaggcaagtcttgcaatcttcctcaactacatgttgggaagtgagcatgcatccttctttcctactctggtgggttgtagatgccttttatcagggaatataggcacccactctattgcctttctttatcagggaatataggacccactctattgttcttctctcacttatgctaaaataatcctctttaccatgcctggaactctgtatttgctttgggaattgctcctgatattttttattcctgacataaagcatttcagaactcaacgctttttctcccccagccacctcctgctcacttccaccaccatgacctctatttgatttaaatactaggttttcaaggctactgtttttgcttggactttatacaatctattaaaagttcatttgtcacctttcttgttttgtgcaggtgtaggttggtcttcccattcttgtgccataagccttagccttctctgttgtaattttaagtaatgagagagcagttaataaagaaaattacaagaatagaaaaatgcatttgttaatttgccaaattctcaactgaccttttcaaaaagtttttaacttatatagcaaactactttcaacttgcatttagctttgagtatcttgaaaataattccctatagtatttcttatttatatttcttttagcatcagttactgattataaaacaaaacgaacacagcagccctcaggtaaagacagcattgaatgtgtccacagcatcagtgggtctctcagtctttcatgcagtttagcaagttttcttccctcacctatcttagtgagccactgctgtctgaagagatgtgaactggctatgcaagcagagtctctggtaaagctcaccagtaaataaatgaaaggccttgcaagtatacttcaaggatctttttaaagaaaactaagcattaagcacagagaacaaggtctttagtgacaaccaagggaaatattcttgccctgcgatcacagaaatagaagtaatagaaaaagtagaaattgaagttgaaaaaacattgaatctaaaacttcctacataaattaagggtgttatgataaagttaaatatgtagttccaaaacaactatgacacatacaataaaacagaactttggaaaaaagtaagttctttagtaacttgaaaaaaattattcctttcacagtagctaaagctgaagtgaagatgaaaacaaagactgtcattttacgtagtctttaatattcagtacatattttatgtgactttacattcctaatgtgtcagtttaaagtatattaaagggatatgtgagaatatttaaaatatagccaatatttattgagtgattgctatgttcttttaatcccaagcaaatcaatgaaatagctcattaactttaaattgtttctatatttttatattttaactctttctattaaaatgtgtagaattactgtttctaaatataataattctagaaaaaataaaatgataaaaatgaagagaaaagagtaaatatggtatctcagaaaacatacagaataaataatgttcaaatgaatcttgttagcctttcttattcctgcccctttgtaatatttgaaaggtaattgctaacacttaccttagggaatgattaatgtttttaactttcagagcacatttatcttattatattaatataatttatttcctgttttatatagttagcaatacgtttaataaggaattataatcgtgattaagtaaattatattgaataatactgttcatattcatgatttggtagagtttaaaacatttgacatttaatgaataggacttaagaaggtgaaatttcgatacattaaataattttttgttttagtttctaaaagaataggttattattatttaaaatccagcacatatataaaattctagtaactacaattttatcaccaaagcatttccttattattggatttttttaatgacaaggcttttttataatacttataataaatatcataataaatattttaagacttaaaaatgaaatgatatttgaacttttgcaagtttcctatctaaacttacaaaagtaaatgtgttatgtagtagaagttaatatgagacattctggctcataatagtcactttggtcacagtcaggttaacataccctcatctgtggggaaatgagcctctaatggaaaacatcaatccttaacatacaagtgacaactttattaaaaatgttttttaaataagcttatttaaagaaaataatataaaaatgtgttcacaaagcaatagtaatcaaaacaatattggactagcataaaaacagacatatagacaaatggaacagagagcctagaaataaacttaagcatatgcagtcaacaaatttttgataagtccaccaagaagacccaatgaagcaagaatagcctcttcagtaaatagtgtgggaaaatgaatatccacatgcaaaagaatgaaactggctcgtatcttacaccatacacagattaactcaaaatggattaaagatctatgcataagacctgaagctatacaatcctagaagaaaaagggatggaagccccttggtattggctctgacaagaaattgttggatatttaaccaaaagcataagcagcaaaataaaaaataaacaattgggactacatcaaactaaaaagcttcagtacaacaaagggagcaattaacaaaatgcaaagatagcaatgaactgtaaaaatcatgtgtgaaccacattatcagataaaggggtaatgtccaaactatataatgaactcatgcaactcgacagcaaaaaaacaaataatctgaccctgcaaaaataagcaaaagacaatagatatttctttaaagaagaagtaaaactggtcaacaggtagatgaaaaggtgttcaatatcactaaccatcatgaaaatgaaaatcaaaaccaaaattaaatatcatcttacatctgttggcatgactattataaaaaaaagatgagataacaagtgttggcaagggtttagagataaacgaaacctctacactattagtgggtatgtagattggttcagccattgtgaaaaacagtatgaagcttccttaaaaagttaaacatcgaactaccatatgacccagaaatctcttttctagatacctacccagaagaaatcaccaacttataaagacaactgcacacccatgtttattgcatcattattcctaacagccaagatatggaaacaacctaaatgtccatgaatgaatgaatggataaagaaactgcaaattacacaattgaatattacccagctttaaaaaaacaaggtactgctatttgcaacagcagggcggacctagaagaattaagctaagtaaaataaagcagacccagaaataaataagagtgcatgatatcacttatatgtggaatctaaaacaaaacaaaacaaaaactcaaatacacagaaatagaacatggaaaaatggctaccaggggtgtaagtgtgaggaaaatggagagatggaggccaaagggtacaacgttcagttatgtaggataaataaggatagagattaatcacagaacagaaggaccacagttaatagtattacataatataaatttgctaagagagtcaattttaggtacttgtaccacatatacccacatattgacaaacataagagaactatataagagaatgaatacgttaatttgcgagactgtagtaatcattgtattatgtatatttatatcaaaacatcatgttgtataccttaaaaatgtacaattaaaaaagacaaatttaaaaattattaatagtgtattcacattttaatactacaaatttctaggaacaattttgacgactacattattctttacataggaattaaaaatgtaatcatagagattgagctattttaaaagttatcttctgtgtttttagtacaaattgtactgtcagtctcccttaaattcactgtgatttcagccagtagggtgcctaaatatgaaatttataatgtcaccatggatattttataaatttttttagacttctatgtatatgtcccttaattccaccaccagacatcagaaaggctgagcctttaatggcacatttgattcattttccacaatttttagaattgcagtttggggtgacagttgagaatactcaactaaagtatttttgtttactaagaaaaacgaaaagtagtaactctaatatttttgaggactcactattgccagatattttgctaaatattttacacattattttaatttaaatcttataaaaaatctatcgaggttagtattattatcttcatttcctcagttgaagaagtagattaaaccaataaactttcccaggtcatacagttggtaagaagcagaagataatataaatattattacccaatattgtccaatttccaggctactcttgtaatcttaatcactattctccatttcttcttcttatatcaaatgtgttgctttcagtttttcctgacaaatgtgtgctttatttacattcctttagaaatttataaatttttttttcaccattgggaaggcctaattatgttgaactcaattacatagcaaggggcaacagaggaagataacaaatctagcttttatctttaggacaagggttagtcatacaaaaagcttttgattttgtgagacctgacagttaaagtgaattctgattctgctttccattttatttagagactccagtggatgtgtgctttggttgtgctgagtttgtactcataactgttacataaatcattaaatgacagggtatttcatactgcctcaggaaagaatttgtatgtattactgacatatccccctaccatgtatttattactcccatctgttaaagcaaaacaacattgaaaaccacccaagagaccatgtgtaacagtaaaaataatcattctttagcagcttctgataaattactatgaaagaaaaacttgcttcctatcaagtttggaaaaaacacattctaattattttcttgtcatgcttggatcagcaggtgaaaggacacctcaacctaaaaattaattttgttatagatttcaatcctgataaattggaattaagcagctcagtcagcatctttcttcatcaggtaggttttctaaggactactacaaaaatatccaggaggtagtaataaattaataattagggtttgagtttttagtttttattcatcttggtatctgatatggtttggctgtgtctccacccaaatctcatcttgaattgtagttctcataatcttcacgtggtgtgggaggaacccagtgggaggtaattgaatcaggggggcagttacccccatactgctgttctcgtgatagtgagtgagttctcacaagatctgatggttttataaaaggcttttacccctttgctaggcacttttctcctttataaattacccagtctcagatatttcttcatagaagcatgagaatggactaacacagtatctattttatataaggggaatcataatcacttccttcaattatttttaagaataactaggttggccaggcgcggtgcctcatgcctgtaatcccagcactttgggaggccgaggcgggtggatcacctgaggtcaggagttcaagaccaccctggtcaatatggtgaaaccccatctctattaaaaatacaaaaattagctgggcgtggtggcgggcgcctgtagttccagctactcaggaggctgaggcaggagaattagcttgaacctgggaggtggaggttgcagtgagccgagatcgcgccagtgcactccagcctgggcgacagagcaagaccctgtctcaaaaagaaaaaaaaaaaagaataactaggtatatttctataaacctacaggatattttactactgctatatgctatattctggatttattactaatagtcttaatattttgattctgcaatgccgcctgtcccttccatgtgtcattgataacttcctttcacagtctttcaactgaagttcttgcttctggtgagtaccgattactgtccatagtacgtattgctactaaagttcaatcttattctcctgctaaaattatttgagtcattgctcttttgtaaaattatttataataatagctactatacactttgatggattattcaatttaactgggttaaaatgtataatgtcaccatggatattttctaagttttgttaggctattttagcttgatgtctcttaaatatccatttgggcagtcattttggttaatatattttcatagactttacacagtagagaatgttgatatataaatttaaacatactgatgtaccatagctttaattcaattattgacaatgataaaaaatttaattctcaaagtgtcctaaaattatagacatagaagaacaaaagtaagaaaaacaggcaatgcttcttgttgtgaatacttacacaaatgtataaatagagattagcatcacttactacactttggatttaaaatgtcagtaatattttcttctcatagaaattgtacaacattaattgatacatttattcattcatttaaaatcatctaacttatgttggcacgaaaaaagtaatggaggatcaagcagagtaaactttttatattactgttatatatttgatatttataatcccaattttaatatgagcattaaaattggaagtgtaagggagaacagacatgagcatgaggatgttatctaaaacatattcaaatataatttaacataacttcaagctctctatacgttttctttgagtcttagaatattcaaaatttaaaattacctgaaatacaatattgtattttagtgattttatggccaatgaaacacaataactttctcttaatgaatatataggacaatatgacaagaaatgctacttgctaatcttttcccactccacttactcattaacaatttttagcagtgctgtatttctgagcatccctccaaattaggtgtggtcatatgacctagtcctggccaatgacatgtaagtgtaggtgctgtgtgaggcctctgggaaggcctacatcttttcagtagtaactattgaaatagtgatatatccagtagggttctttgtttaaagagataccataaacatgcctcccaaatggcacaaagtaaatcgataattgaaccaatcaatgacaatttagaatacatattttaaatgtttttcagaaagccctaatgtgatatccgtatttattcctatatgaaatccatatttagattattgttctctactaacatacttatatttactaagcatctaatctagtatcactctccactgaagtgtgcctatgtttaaatattattttaacttattatcaacctcatatttgtactgcatattcctgtcagtttctagaaaaatgttttttaattatcaaagatttcttaacgcattgctttaggaaattaacagttggagaaacacgtgatgtcttatacaaagatgtacattaaggtcatttgatattttgaatggcaaataactacaacattctattttaatggaaaatgttgcacaatatcgtagattgattcagtcattgaaagccatctgttgagagcctattacttaaacaaattagacggagtctttgttctccttatatgttaaagtctaacctatacctgcctcattgagttattctgaggattaaaagaattaatatatataaagcacttaaagatgtttaacagtaagtaagaattatacaagtgttagctaatgcaataataacatcttctattcctactaccattatgactaaaattacttggttgcaattggtacatgtgtagaaagagtgcagtgagcaattaatttaattatcactcaaaatgtataataataatctgggaacatataatatgaaaaacatggagatatgaccttgcttagaaatagtgacaatctttatctatttttggaaatcggaaaatttaccaatataaatgatagatagatcctaatttaaaagtaaaaaatgaaattataaagtgttacaagtaaatatttgagaatgtttttagatttttgagtgcattatgttttctaagaggatctgaaattcagagaccatacaatggaaaaattgcataaaaatgtaaaaatatgaaaaataaaaataacaaataaatgaaaagataaatgcatggaggactatttccaaaacatatgacataatccttcttaatatataaagggtctgtataatcagtaagaaaaatattagcaattaaaaatatgaaatataaatggaaaataatttggagaacgagagtttattttggaagagactctggtaatttctctggtaagaaattgaagttagtgatggtggtagatatgaataagggttgaatgatttgaagaatattgaaaaataaaattggtagaaattattgattaattggatatagagaataaaacagagaaaggcgtcaaggtacatttcttgctggcttgagcaatgggacagataatggccattcagtctaatggggatcacaagaggaggacaatgtttgagatagaataggttagaatatagaagcattaagtttgggaggccactgagatatccaagtacaggtttttcaaataaataggtctagggaggtaacattaaaactctgacaacttcattcatcaacatgttctttggtacttgacaaataatttgaagtattatggcaatcacatattgtgtgttggctcctttaaagaacacaaccaaagaaagggagttaggaaaataagagatttatttacttcagaacaagactacaagactggataggacatgaggtttggcaggaaaatgaaatatttcattaaggtcagacaactgactaagaacaaagggtgtcaatctttttaatcatatagatggcatcaacaaaaataatgaaacagtataaaaatattagcttaggataagcaaagaaagtatttaattgtccacactgcagttattaattaaaaagaaaacacaagaaaaactaacagaatctctgcccctccccaaactcaaccttggagacactataaaattagagggagattcctgaacctaaggggaaaatcgcagccgctaatggaaaggggattatgtcacaaacaggaaataggttggcatatgatattttactttttctctcccacaccacatcatttttataagtcagtcattactgaagatttttcctctgagaaaacaaaaattaattataccaggtaataggtcaggagtagataaaatttgtaggcaaactggcaacctgagtgttttctctcctccccaccctttttttcccaaaatgattacatgtgaaggagtcttttcaaagcagaattacaataaatttccctgagagttatgataatacatggagaggagtcaaatccagtctgcaatgccaaaggctatactctgagatgaatcatttgtaccattcactttctatttgattcttgaactcaggtggttagaaagaagttacgatttgagctttagcttatctcacagaaatatattactgcccaagacaattaacatgggcaaaagaatatgtgctcaccaaaagaatatgcactcaccaagaatatggggctcacagaaaagctcaaccatgataaataatgatagaaaaaaaaaacctagaccagctgaggatgcaattaatgttaaatttttaaccgaaatgtaagacaaaaattttaaatcaacaaaactatcctcaaggaaacagaagtgattttgtaagttgctagttggcaaaatatagctttaaaacctttgagaaatactggatactgcaatactaattgcaataaagaacccaacagataggctgaattgcaaaatagatctaacgtaagaggttttgaaccagattatgtcaaacaatgctctcagaaggcatcagtagagtatcagtatagtttaaaaattacaaaagaagtaaagaaatatgtaggaaagaaatgtgtcaatatccatatatacttagaaaagaaaaaaataaacaaagtagtcactacttgaaaatacaatggtacaattttctaggatattacctcatattttttaaaagtgggcaaaagacatgcacagacatttctctgaagaagatatacagatggaaaataaacatctgaaatatcatcgggcattagagaaatacaaattaaaactaaatagatatgactacacacctatcaggatggctgagatgaaaatagtgaaaacgacaaatcctgataaacatatacagaaagtggctcactcatatatttctagtgggaatgaaaagaataaaaccacttcataaaatagtttggcagtttcttttaaaactaaagatggacttactacaccactcagcaactgcactgctgggcatttatcccagagaaacaagtatttattttcacacaggaacttgtacatgaatgcttatagtacctttactgctaatagctaaaaacttgaacaacccaaatgtattttaaagaaagaattattaaacaaactgtaggacacccataccattagaatactactcaaccatgaaaagaatgaactactgatatatgcaacaagttggataaatctcaaagaaattacactaaatagaaaagttaatttcaaacaaataggtattgcataattccatttctgtaacaactgtgaaataatataattatagggatgaggaggaaattagtggtttccagggataagggatataaaagagtaacatcagggagtctacggtgatgatacagttgagtatcttgtttgcattatggttacacaaagctacgcacatgcaaacacagatacacaaacaaatgagtgcatgcatgtacaatgggtgaactctgattaaacttcatggattgtaccaatgtcagtttcttggttttcataatgtacttgtgtttgtgtaggattctggcttgaagtgggcataatgggagaaggtttcatggaactttcctgtacatttctatgtaacttcctgtgaatctgtaattatttcagaataaatgattttaaaaagaaaaaaaacactgcttattgaaaaggcttttaaagtactgaaggggatatgtaagggtgagaaaaagatacacaaatgacacacatgaatacttacacacaaacttgttatagtaaattttaagaatggaaggggaacatcacacaccggggactgttgtggggtggggggaggggggagggatagctttaggagatatacctaatgccaattgacgagttaatgggtgcagcacaccaacacggcacatgtatacatatgtaacaaacctgcacgttgtgcacatgtaccctaaaacttaaagtataataataataaaattaaaaagagtatcaaagaaatataaaatattggaaaatctaataagcatgagtattcaagcacaaaggatggaaaatcggactggcatgcttcttgatagcatctgtgcatacaaaagtcagtggaacaatattttcaaactattaaaggagaggaaaatcaaacctattcagctaaagtatcccacatgcattttattcatttattcagcaaatatttactgtacaaccactatgtgccaaacagtaccagacattgaggataatgcagaaaataaaatgagaaaaatatcttattccatgcttttatgcaattgtaaaagcaatttaattaacctgtaatgctctccacatttctcaaccactctggaaagctttgttcaaaccttttcctttcctttaacaactgaggctccctgctagggtttaaggatggtgagctgagcctgtgaccaaaactgagcattctctgaaccacattggcatggcagtcttaactgagagctatgtccaagtctgaaagtaaactcaaaaaggaaaactgtggcttgtgtggagatcttaattattcatcatcatgaggaatattgcttgggaatgaggatgacttttaagcaattacttcataaggtatatccagatgccactaggtttaagtgcagttgtcaccgatgaacccctctttcttgttccctcccttttagggatataaaaccatgacttattatttgccctcattttccccttgttttacaagaaggagttttatgcaaaccatatgccactgtagaataagtgtaatgtctttatataaatacatctatttttagtttagttgatttttttcaacagtaccaccatgacctcaattttgaaagtgtttgcatttgaattgttattactatttttgtttacttcccaatgttaacgtaagtggtaatcagtggaactgtatatttgcttcagaactcttttcaaaataaataaaactttgcagatatatggaacccacattctatcttttctcaaacctgttccctccctccctcactacagggaagaattatatacagtaggtacttttttttcttttcccaaatatggttttatacatttccagcatatatttgaatacatagaaattacactctttgaaggaaaaaatcttatttccttccaaaatatttgctttcttttctatgctaagagaaattttctacaactaaggttttgttttgttttttaagcaactgaaataaggtaagcatagcattgtattgatgcagaatgtatataatacaaggactacagtgagttccttcccacgatttgtctacttttattgcttcatatatggccatgatattttcacactctcaagtaataatgtctaagaatctgctgtatgttcaaggtaatgctatctagaattttatggtagagaatataagcattttctcaagatttacactacttaatgtgacaatgcttcatttgctataatttctaaggcactaggaatacacagacctagttaaatatacagattaatcagtgtttcttttctttatttcataacctaatgatagatgcaggaggcaaaaagggggagggccccagagaatctcccaccggcctacacactgcaagaatgggttggagccacgggaagtttgagccatttgcagcagggaggagctgcgcctcttcagttcctgtgctgtggcctgttattcaatctgtgaggtgggagcgctggcaggaatccttctcattttgctaagagtttttgttgttgttgttttgtttttttcttttcgtccaataaattccgttcctgtcacctttcaatgtgtccacatgcctaacttttcctggttgtgacacaagaacccagatttagctgaactaaggaacagaaattctgcaacactaatctcccttttagaatatattttaacagaaaggggtatggggttgtttcatgtcaagaagcacattcttttaattttattgttagggcagaattagtctagtgtaacctttataggtcagaatgtaagaatgacagttacttatataccttgactttttattacctcaaaacagtaaattttatttgaatgatttagaagacttatgttagaatcttaaccaaaatgtctaatcctatacttgacttcagagaatgtcattctatttccaatagatgaaagcatttcccctcttcatctttactatagagccattgctctataattaattattatacctctatttattatagatcatcaatataatttaatttttctccaaaaattccagttgaagttaatattagtctaatatatgtgctggttacattatttgtaatatgtggaatactggaatgcctgttttactctatggcaaaaagcctactttatctcggtttgtgcctttgcccatttactaaaaatgactgtgtgatttattatgattgcctggtttccaagcaacagttttttcaagttgaaataaaattgaataccttaatatataacaatgtattcatgctttctgtatgttcatcaaatttgaattgtcaaatccagttcacattataaaattgtcatttataaaggaagatgatttttaattgtcaatgttgagtcaattacaattgctttataaacaagggtgttttcagtgtatccatttgttactgaaaggaagacatataaaaatggccaattttgggccaggcatggtggctcatgcctgtaatcccagcactttgggaggccgaggctggtggatcacttgaggtcaggagttcaagaccagcctggccaacatggtgaaaacccatctctactaaaaatattaaaaattaaaaattagctgggcctggtggcatatgcctgtaatcccagctactccggaggctgaggcaagagaattgcagaaacccgaaaggcagaggttgcagtgagccgagatcatacctgtgagagagagggagactctgtctcaaaaaaaaaaaaaaaaagccaattttattttaaatatttgattaagaaattataattcgtatggccattattattgatactggcattaatagcagaagtgctaattaggaaaattcagtcaaaattgggtcgaatctacaaaagaatatgtagctatccagagctttgataaggctaagtacttttatgtgcctaatacaatccagccgtgagcaacctaaaaagcgttgcttattactcatgattgttcaaatgtactaagaatatttgagaaaattcataccaaagccatttatttttatcaaacatttttatgtctgtactacacaagctaatgtgttcccgtgttcatagctacatgtttacatttaaagaagtagaagtccataaataatgaaaacttacatagttcttaatccttaaactcctaagatgaaactcgactagaaaccccaaactcaggtgatttctctattgatatatccaacttcaggctttcaacatccttgtttcttagaaaattcacatttgtactattagaaggctacctccagtttctgaagttgtattatcagggtagtctatgtggaaccaatggaaataaatgggaatctctgtaactatgagaaaggatatggaagtcacattctattaaaacagaaataatggaacatgcagggacagccctattcaaaccagacaaccaggcacatttttaatgttgcacaagactctgtacctagatgattatcttttatttcatatttcattctcacaatatcattattaagttcccatgagataagttaagtccttaaagtgagtcctggaaaactcattttatacaagaagaggtgtggacagaaagtatttcagatattcaatgaaatttgcaatggtgaaattttaaggttagaaaaggctatttttaagcagttgggacttcttgaaacctgtgacaaaataagtactaaccactgcaggagcacaaataaaacaatttctttctatttttttttcacttggcaagtgtattcattatgcttccaaattccattttacagttttatttaagtcgttttgagattgcgtgcaaactatctcatacataattgttgataccaatttgtggtattatgcatatgcacagtaaacaatgcacatattgaaatgcatgcaaatgcaaacagattgaaaaagactatgtaatgtttcttaaatcttaaaatttatcaagttattatctgggtatccaatatgttacaaaaatattgtaaaagagttactatattgctagatgctttgagcatcaatatgactgatgatctacgtgacagaaaaaaatgaaatattcataagcataaagttcaattcatgatgacaaaaagaaaaaagcatgttcattgaaatctttgaaaattagataactgaaacaaaacaaaacaaaaaaacacaaatctctttggtgagcagccatagttaatcttttctggaagtagtaaaagtaaccaaattaaacataaatccctgagggtcaacaggtatatagtgggcactgaaaatatgcatagctgcatagataaaattgttgaaaatttaaataaaaatattttgttatattaatgttaaactcataaaattttcaaaacttacaatggcatgttgtcattatataaaagagtcatcaataatttactaatagcatataattagtattaatattatacagttagtattgatattgcatattaagccactctgtgctagatactgtactgtagaataagcagggggagagggagatgtacttcagaaaggaatgacatttttcttgcttttgaaatgatttcataaatttatctgtacaatgtatacccccaaaatgagtgcttaagcttacttttcttaaaatgagatgagtccttaaaataataataataataataataattttactgagagtttactgtgtgctactaaattcatagtcctaaaatacttaaaataggaagtaatagttgggaccagaattactgaactttctttttggaagtaaataggtgcctaggacatgctgaataaacctggatattgatagaaacactgagccttgtcattgccttgttttataaaataaaacctatcatggcactttctagtaaaaccattaattaaaaaagatgattatgcacaagttctgtttaaaatttggtaagatttcactattctatcactgatataaattagagtatatatttacttgccatctgttagctagaactttacactttataactgtctaacaataggttaatgtatcctttataatacaactctaggaagggagataattttctttgtttgaatcactgtaatattcccacagtctagactagtatttattaaaatgatgtataaccataatagagtcaattactcagtagagagatgtatctttctggatcagaaggaaatcattttgcccacccggacaaaatgtgccattatttaaatttaatggcacattaaaaatgtgccaatacatagattaattaccaattgactgccattaagcaatctcaattacaacactgcattctttgcttacctttttctttttttttttttttttttttttgagacgagtcttgctctgacgcccagagtggagtgcagtggcacgaactcagctcactgcaacctccacctcccaggttcaagcaattctcctgcctcagcctcccaagtagctgggattacaggctcatgccaccatgcctggctaatttttgtatttttagtagagactggggtttcaccatgttggcaaggctggtgttgaactcctgacctcgggtgatcctcctgccttggcctcccaaagtgctggggttacaggcgtgagccactgcacctggactgcttgtcttgctttctagcaaatcagttgtggattttgcattttcatcttccactaacaagtgttctatcagtcctctcattctaacaatttgagaatacctgctgatctaatttgcaaaatgccaattctctcctgttgacctctatattattctaatgattagattcacatgacatttttgaatttagacctctattgttctcataatataccactgtaaattttgtccaagagacttttgatgaaacagtgcctacagaaatagatattatacatatgtatttgatttccatatgtataatttgcttaggcttttattttcctattgcatacttatgtgttgctctcatttcttagctgaattactttgtgacaccatttttcatatcattcatgtctctactcaaatgccatctccttagagaggcattccttgaccacaatatcttatacaaaagcaatgctactctttttccattatctgattgtattctacccctcaaaaatattactagtacctgatacaacagtaactgtttatttgtatacagtattagtatttcttcctaaataaaaaggaaagtttcacaaagtaggaatttttcctgagtacgtagttaaggtactttctgtcttctccttagctcagaatgagaggcacatctttgtcctaggaattagcatattatgtaccaatttaaaggcaacaaaaagagttgcaggcaccattgtgttacattgatataagtccccacgaagagacaataaccctcacacatatcatcacaccactatcatatcagaaataaaaccaaaatgatccttaaaatcacaatttctggtgcttattacaaaatatgaactaacaatttggagtggtataaacctctttcaaaatttcagaagctaaaaatgtaaaacaaaagctatttgcagtgcctagagtaggctgactgaaaggggatggaaatagctaaagctctagctctttatttcctagtactttatatgctaactggaccaaattttatcttctgccacctctctcttagcttttgtggcactctaaccctgatcaattctttggagctatttaggattattctatcctattttaaaattgtgattattgagatagaaaatttaaaataattatttaagtaagcatgaaaatgtagtattgattgaaacatttaggagtcttaaccactttcaaagcaggactaattgcctccacgacaatgcctcctggattctcataagttcttattcgtcaagagtttgctgtgcaagtgatctgtcttataaactgtccataggtttttacatatccaccagacataatacatcctcaaaatatatagatttaaactgtattccagatctgaagatttctaatttcttactcctgaacataatttagggttataaatgtagccactaaatctttaggtaatttaccttacctcatatagtttttaagaataagtaaaatgtcaaatgaacatgagagaaattattgcttcatttcaattagtgtgcttgattatttgaaattagattccttctttccccagattgaagtataagtccactttccatcaagatggtttgaaaattgtcccaaaataatgaacatgtgggaaatgtaaagatcagcttctgctaccttcccaaattttcaatcatttggcatacagaatgaattttaacgatgccagctttccctctatgtctgttttatttgttgcatagcattaattgctttctaaccgttaattttttgtctgcttcctactctaccaaactatacgcttcatgagatcatggatattttctgtctggtgcacttcctatctcatgtacacataatagaacataatacatttaattgcaaaagatgaatcaaatctttattcttattcctttagtattctacaaataaaaagtagatctttttgaggttatatttttagaaaatcaaatgcactattaatatattcaatcaaatattgctgttcagaaaggcagaacttagtagtaatttgagatcttcataagtatttggttcttttatttcttacaagttcaaggaagaacattttttttcccatgttttcctcagatcaagtcaaggggctgcttgggtgaagaaagtgtgagcagaagcaccgtatgtccctttcaaaaggagaaattaaggcctggtacctgcatcaacatgctccctccaaaatacagttgacatgccaaagataattttatatcaacacatagaagcacttaactgagttcactaacattaatgggatactaagataccttctaatatgaggcaaggataatcaaaaaattatagaggagatattgtaaaggacaaaaatacatctaaattgaaactatttttaaaaattcttcctttataaaaattatgacctatcattgcagtaccttatattatagcataaacacatatatcttcaaaatcagcttctctaagcagagaaactgcttattcaatataggaaaactacctatgaattttgtattgtgtcattttgctaagatatggaactctaaaggaaaagttttagcttaagatctgtagaacacaaaacaaaagaacctcatggatatattagtacattgcagatatttttatattttaacttgaagctttcctattttgtttataaatgttacaattttacatttccttgaaaatattccattaaacctgtgcctaacatccatctcaataagagttaattttcatttttaatataaatttcatttttaatataaataatcatgttcaagggtatgttcttaatatatagaaatgagacaaatatttatatgaattgacataaggttatctaaagacaataagcatgtaaatagtgaacactgttttcatccctgcctttttgctctctcccttcccctagcctccattcaatcatcaaatcctccagattttgccacatatatttctctcaaatttccaatgcagcatcagattcaggtcatgctatttcatttgaaaaaaaagaacagcttttactttgtgcttgtcccctattaatttagtactgcattaatgactgtttgatttttctcttttgactcttttagtgtctccccacttttcaaggtaaagtttaacttctttggaactgttcctatggtccttcatgcctcaaaataataagagccatctatgacaaaaccacagccaacatcacactgaatgggcaaaagctggatgcattcccctcgaaaccagcacaaggcaaggatgccctctcaccactcttaattcaacataacaatgggagttctggccagagcaatcaggcaagaaaaagaaataaaggacattcaaataggtaggaaggaagtcaaactgtcagacttaatgacatgatcctgtatctagcaaacccatagtctcagccatcagtgctcaccaatggtagactggataaacaaaacgtggtacatatgcaccaaggaatgctacgcagccataaaaacgaatgcaattatatcctttgcggggacacggatggagctggaggctattgtcctcagcaaataaatgcaggaatagaaaaccaaatacagcatgttctcagttataactggtagctaaatgatgtgaacacgtggacaaatagagggcaacaacacacactggggcctattgaaggggtggaggttgggcggaggaagaaaatcaggaaaaataactagtgggtactaggattaatacctgggtgatgaaataatcttcacaacaaacccccatgaaacaagtttacccatataacaaacttgtgcatggacacctaaacttaaaataaaagttaaataaaaaagataagtaatgcctatgatatctaaactatcaccttcaaatttctactcaaattattgcttccatctttttacaaatggtttccaaaacttgaagtctgataaagcaatttaaacatcaatgatattttgcatttctttcttgaacattttaaaacagaaaacagaagctgggaaaacatagtccattactgagtagttgtacagcagtagttacgtagttttattgacatctgtcatgtcaaacatttattattcaaagataaatattgtttcagctattttagttaaatcttttaaatgttgaaaagcagtcaggtttttggtataaaagtcatgtaaagatgtggatgactccacatttcaagataatttaagaaactttaactacaactgaaaatgataaagctaaactaatagtcatttatcattaaaattataagaagcaattgagaatgatgattgattcaaaatcaactgcaagtttaagtgaaatgacatataaggaaatcaattttacctcaagttaatttatatctaaacaagagtaaagatcccatggcatatttctggtaataaaaacatcacgaaacttctaaataaagccccaaacacttataatattaaacataaaataaatgtgagctatacgtacatttaagaaatattaatacaaacaaggaagataattattacccaataattccagttgagggtcatggggtggggcagggcttattccagcagccagggtgcaagacaggaaccaacactgaacagggctccatcccattgcagggcacactcagacacacacccactctcactcagactgggagtgattcatttagacatgccaattcacctcatgggctcatgtttgggatgtgaaaggaaaccagagaaatccacagacgagggagaatatgcaatctccatacagatagtggtcccagccaggaactgaatttttttctcatcaacgttataaccatatgaccttaaacaaatgacattattcaaggacctgctgtactttgctcataagcaaatttgcattttcatattttaaaattttgtttgtaagtacaaacatacacacgaatgcacattcacacactgtcttcttagtttccatacaaatacaagatttttctaccctgcagttcgtttttgctggaaattctattactactgtcttcagatgaaaaatttatgcctaaatttttaccaccttcagtttcatatctaatgcttttgacttgtaaattaacatattgaagaaaaagtgttcacccaaattctagtagcatgtttctaatctggataacggttttatgctcccctatcactccagcctaacaagtccacatgtgaaaatatgggaatacttgtaaacattgattaaaaatcttatttatgtcaataacttaaccctctttcactcttttaagtgtctttgaggttgcttgtttcctccacgtttctaattaattttctcaaaccatatttctaaacagaattaaatctatacaaaggcaccagactcagagaaaatcctcaagaagtatttggagttttccaagacaaggtacccttattttacagaaccttctacatcagtcaagggtccatccctgacccaggtctctcaaatttaccatttatatatcccttctcataaacacattgtaaaattagtttgtaggaatgaagcagatatatgcaatgtccttcatttggaagatgaagataaacttcactttttacaactgacatatggcttatttcttttccagagccagagagaccatttacaaaatggtttctctacatttctctgagtccttcattctctctcatctctatatgtttaatgctttccagagcattcactaaagaaattgaagtgaatgacagagaaataaggtcactatctttttcaaaattgttccccaaaacaaagtcaaaattcaagttctgcctattttaacgttttcttaattccatttttcttcttctcccctttcactattctaatctaaatcatcagtacatgccccaaatatgtgcctaactgttgtacctgtctctattataataacattcagtatactcagtatggtattataagattaatctatgcaagatgtcattttattcatgatttaagattatacaaagaatccagattatcaaatctccacagattttcctggacaggcatgaaatggttcctccaaacagttcttgcaataaaatctatctaaatgggctaagtcaagcacaaaacaagcaacaataagcaaaaattattcactaaaataacttttaaaaatgttttaactggaaggagaaataagcaatagctcaaccattatagtcacatctactgaagaccaaaattaaatttgtaataaagttatccaacaatcaattgtatcaaacatatcttttttgcttattactttttattagtaattagtgattactcgtggtcaccgtttaagaaagtttaggaataaacctataaaattaacaaacaaatgaagtttgcacctcagtgatcgtgtctcttgccccactacctggcagtactaactgcccccatcgatttctatgatactctttgtttatttctattaaaccacttacttttataagacgttgaggacaatacttcgtttttaaattcctggaaattaccatataactaatttaatcaaattttattgactgaatgggagagcaaataagtatgataattctaaatattttaatacaacatgacttaaaaaaggaattggtcaattatggatttttttaaaataaaatatcctactttccaaagatacagtcaaaaagtcacatcattgtgtatttctatggctgaatataaaaaaggaaactgtataaaattgtgtattatttaaaactgtaattgtgtacatttcaaatgaagtaaaatgatgtttacgttgcttggtatatttagataacttagaaacatttttcctgttttttaattccttagataccaaggaaagtagatattcaaataatctttttctctttcctgttaagcaacaaatgaagcaaataattggaggttaatagctgtctaaggagattaaacaattgcttagctgagcctaaaaagtacaactttgttaggacataaagattctgagaaaacttttttccacaaattaattttttagcttctcattatatattagttctctttttaagtttcttaaagcagtgattccagaatttcagtgctttttttctagatataatgcattattttacaagaaaattgtgtaagtcaatactgaaatctgagacaactttcctaatcaaatttaagtacagaccatacagtttaaccaaaagggaatgctgggttcaatttatcaaccccctacatctatgagtttaataacacagcaatggtttttataatcctatttaatttaagaatgattaataagatttctaaaggtttctggattaaaaataaggtaaggtcttaggaagtgaatctgctattagtcttaaagaatcgaatttgttttcagacttcatctcatacacaaatgcattatgtaatcaaggcaatgtttgatattaagaggtgagatttttgtactagataacctaggtattttatggatagaagaaatcatgtacatgtataggctaaaaatagaaatattgcctaaaataataagactttaaaaatcacaaaatatgtaacataaattaataatcctttgaataaaatttggccttctagtaaaatatgtgaaccatagttattaggacataaatccatgtatttaaaaatgtatattgcttaggccacatgcctaactcagtgtatttaaaccatccaagttatgtttactatgttcaaaagctcattgatttaggattctgaaatagtttggcagatgaaaaaggctacatgcatgtaatataaaatcttcattaaaataataaacagttcagaattcaagagtgatttctttatccaaaggtgatttttaaaagttagtatctgattgtgtcctaagataatattgatatttaaatgtcaatgcctggtaaaggagaaatttaaattttctgagaaaatataaaaatgctagaaatcttcccaacacacagaaatgacaaatactcgaggtgatggataccctaaataccctgacctcataattacacatcctatgcatgtaagaaaatttcacatgtaccccataaacatgtataaatatagtgtatcaataagaacagaggggctaatctaatggagaaagataaaatcctatcactcatttaccaaacaaatcaacagatttttttaaaggttagttttagtgttgtaattatcatttcttatcttaaatctaatatgaagaaagcccatattctaaatctctttcctttctgaggaaggagaaaagcatcaaaatcaattgaaaaccttgaagttcagcagtccctcccaaggcagggtcacgcctgcttccactcaaggtctgcagaaggggaaggtaaggaagcaaagcggcaggaggcatcattaaggaactgcgggggacatgtggactagaagaaaaataaaccacatccaatacactggctgtgcatcagaattacttgggacacttgctataaacacagcggccaggcttctgaacccaggagcttgtattaaggaggagctcacaggatcttggtatctgcttctctgggtatctctgggcatctctgggcatcctgatggaggttgtctacaaacctcacttccagaaaacctggcttataatgtcattcctaaagatgacagagctggtgagacaggtcacacttcgaggagaacaaagaagtagtttcaactggtctgtggtgggacccagacattagcccacatgtaacactccccaggtgattccagtgggcagccagggttaacactgccctgtctggtaacatccgccacatagataaaactttgcctgttctcattaaaaaagctcatcacttcctactcccaagacttgttcaaaatcccattagtcccagcatcctccataggatgaagaggggcggaggagctggggtccatgagaaacgtacagagacctgagttcgagccttggctcagctactaactggcttcgagatcttgatcctcagtctccccatctccaaaaaggtaatgtttgcaataaattcctttagaatgtaaaaaaaaaaagcacctatttccattaatgcctttgtttcctgttattaaaaaggaattttttaaaaaagaactacatcgattttattgtatctagaatacttttgccctaccatcctaaacttttgtttgtaagtgaatcttcaaaggcaatgttgcttgctggggccattttgcatgtagagatgttttatgcaagagttcagtgcagaggttatagttttgaaaaaaagaggcgtgtgtctacgtgctccttctcttcttacaccccatctacaaacagcaccatcttattcacattggcagaacagcacaaagtcattactctttattgagacatccctgaaagatacatcaaagttttctctcccatggaaagagtaaaattaccaattagaatacggcatcataaaaagcaccctagaaaaaaacgcttatttctaaatataaaagaaaatcctaagaacaaaggagtacagaaaagaatgtatacagtggcaggtaaagagttagcttcaaaaattgagtaagggaaatatttgttttctgcaccatggtttattacactagaaatatgttttttttttcctctagtgaatagcatgcatcttacaaaacctggaaagaacagtattagtatcagacttactgatccaatcaagaaggcttgaaatgaaactcgaagtggaagagaaaaatgtgaatcaataacatagatcttacagaagacaataggtttgaaatgaaaatgagacataataaaaaaaggtctagaaattattttgtgaaaaccatgacttgaaataatgcttaggcttagaataaaactcaaataataaaaatactacacatgctcagctcatgaaatgtactcttttaaaaaatctgtatacaacactgacagatgagtataagaattgccataactgtttgtgcaaggagtgccctgcacaagagtacctggcctgtggaacaagtgggggacataatccacttcatattccaattgcctgacaggtataatcttcaatttacaggattaaaaacccaggcttagatatgctcagaaacatgctcaaggttatgtagctataaaaatatgaggccgtattggctagaattggaagccaagtgtgtctggaattcattattttaaaaaaacatagaaaagggaaatttatacatacatatggaatcatatataatttattctaaagaggaagagtaggagaaaattcactaatttttcaaaaggaacaatacaatgactgagaaatgtgtgtcactgcgtatcagggagttatacaccagttttatgataaaaaatataaaaaattgaatttggagatgttcatgtcaggaaaggaaaataaaagaagactttgtcactggaaaatggtgtagcatttcccagcaaaaaatattacagaggatagtctgctaatgagtacaagatatggatgagaaagagaaggcttaaatgacgggatctctcttgggaggaattctaactcatttaaatttcgcttataggtaaggattttgatttgcatccacaacacagatactaagtagaaacaaagtatttgaggtgcataaaagtaaaggaagaagatgatgagaagggttgggtaaattctatgaacttaaaacacacagctagtaatgggaagttacccagagactccaagaaaacgtaactgaggaagaaagtaagaaactaaagatacaattatgactctatctttgcaaatagacctataaccagaaaatagcacaataattacctaaagaaaacaattgattttacaaatgaaaatttagtcatagattcttacatttttacaaagcatgtataacaaaaaaatgaatatgaatgattaaacaatgtagtaaggagttttaaaaagagtatgaggtgtgtaaagtcaagaatccttatagatactccaaatatgaaaggttataaaatattagctgtgttaaggaaaaaagaaataagcccacaaactgagggagaaagaactgctaatttgttttgttgctgctattgtttctatcttctctgtttaagaaaattagcaaattagaatgggtagaacgatgttaatatagatttcggttttgctcagatttacctacagtcctttttcaatgagggataaccagagaaacactgtgaatgatccactatggtctgctgtatcggtagcctgtgtgcacttagagaagaatccagtaattatcaaaggccaggatgttttcactaggaaaagctctttcacttttttgagaatcttaaacagggtgaataagaatatgctacatacagtgtatctttttttttttttttttggaatcggagtctttttctgttgcccagagctggagtgcagtggcgcgacctcggctcgctgcaaactccgcctcccaggttcacgccattctcctgcctcagcctcccgagtagctgggactacaggcgcccgtcaacatgcccggctaatttttttgtatttttagtagagacggggtttcaccgtgttagccaggatggtctcaatctcctgacctcgtgattcgcccgcctcggcctcctaaagtgctgggattacaggcgtgagccaccgcgcccggccacagtgtatcttaatgtgagtaatgtgtcacacaagtattttattgtaaaacacaatggttttatgatagaatagctgaatgaatcgttggaggttgatcagtcttactcgatgaaaattttattctctctaccatcccaattcaaaagatttttctgtgatacagttaaggaagtggaacatgcactttgccaatctagggataatacaaggttttgggagagagctaaaagattatgtggtgatcaaataaatcttcaaaaatgttttgttatgctgaaattcatccagataatatgctaagaagaaacaatgtaaagacctccacttaaatttcaaaaatatcatttaaacaaaggatacgtgaatttaacattttaaccctttgaaaaagatacagttttttccacataacccttgatcttcagctcccttaagaaactatcatactttaatttcttttcattttacaaaagtatttctatttctcagacatattaaattagcttatgcaacattctgtatatgtcttgaacccctaaagcaaaaatatgtacaacttctggcttcttaggaatcaagacaaatgattatgcagtataggtgagtgtgagcacatctgaaataagttccttttatgaagttataccatgtaatttatctctcttatctagtgatgaaggattttagaaggctcaaaggctgtcactttagtatgtctgctgtcatagtgaaaaatatgtaatttcaaagatttttcaagtaagtcggaacagtttatgtggagtaatatacatagggtgaaaacatatctatctgtctatctatatacagaaacacatatacataaaatatattttggaattcatgcaaaactcttagaaaaatgataacaacaaggtcttcacagaggaccacaaagaaaaaaggacatcagttagatttctcacctgcctgatgcccaaccggtatgcaacaatccgatccactgcatcaggattcatctgtgtccactgtagactgtaagaataaacacggtgtctgttctgccatactggattgtaggtatcataatagaattctggagcataggcctttcctgaaaacagaaagtgtgcttaaatttgaatgatgacatattgtagtgtaagcatacttattccctttggcccttttaccatttctactatatttttcattagtaattataaaatccaatcaattttctggatatgttttgagaacagatgtgagatttcctggttgattggatgggcagtgtgagaaaagaaggaagaacacaaagcatttggcctaagtgattggaggaatgggattttcatcaaccaaaatggaaatccatgggaggatgaaatctggagaaagaagatcaaagtcatttttaaataatttgagtgatctaaatggatacaccaagtatgcagtaggatataactagtctggaatacaagagagatcaagactggagatataatcttgctaaccataggcatgcagatagaatttaaatttaaagccaagagacggatattaccaaggaagtgtgagtagatagagaaggtgaaagtctgacactggggcaatccaaggttaagagttatgggaggagataaaaaccacaccgatgcctgagagggaacaacctaaatttggggaaaactaaaaatgtggtatcctagaggtcaaaagaggtatttcgggaagtgagtgatccactgtgtagaaaacaattagtggaaatgaaaatttgtgtttgtattacctgcagctttcatcaataaagtgaacttaataaaacttaaaacaattaattaataaaagatctggtcaatatttagcttatatttagatttttaaagaaatgtgaattacgtatagtgtatataccacatacaaaccatctcagtttttcttaattgccaaaatgaaaagtttacacaccatttggaattatagatccaccttcccaatattctgaagtataattttttctattacaaataacatatttatttaataatacaacaatatttaatgagaacctattcaatgcaaaatattgtcctacgtattaagaacacaatgaatcaggtatggcctcctcattcatggaaattaattacattttttttccagacttttcatgtagcttcgcaattcttaataagttaaaagctgtatttttatcatcactcatttaacatcttttctttttttctttcttttaattagattaggccagctgtagggctcgtgcctataatcccaacactttgggcagcagaggtgctcggatctcttgaacctagttgttaaagacccaccaacctgagcaacatagcaaaataatgtctctaccagaaaaagaaaaaaaaaaagagccaggtgtggtggagtgtacctatggtctcagctactcaggaagacctacttgctgtggtgggaggatcacctgagtctagggaggcagaggttgcagtgagccaagattgtgccactgcactccagcctgggggacagagccaggccctgtcaaaaaaaaaaaaagaaaagaaaaaaaagaaaagtctcaaatgagaggaaaacaacatactgagtgaaggaatcaacaagcaaaacattcttgataatttgtatttgaaacaaaatttttcaaaatgaaataaaggaggtgaatttagtagtagctgagttagacagctagaggttttaattaaaaatacacatccaatacctacaaatttactaaagaagtaatgagctgcttagatgagtaacataaacctagagtgttttcattacagagtggtatctagattgaattggggaggtaaaagtctagtgtttcttttctatgaggactgaggggttgcttctgttatttaatcaaggaagaaacctaagggtgattgattcagttctaagtagcccattcttaataaaataaacaattcattcaaagagaatcaagaagagaatacagggacaactaggggttttttttagcatggataaaaaggcgggggggcaaacagaatttttaggagttgaaatagatcacagaaaaaatcagaataaatgttaacagatacatgaaataagatgaataccagtgatttccgaataaaatggtaaatattttgacttagaaatgttctaccaatgacctttgaatatggaatggcctacctcagtagactataaatttccctttattcgaggtatttagtcaacacttaaacagccatttagcaggactgagatgggtagctgcccacaagatggtcatttaaattaactttcagtcccgaaactgaactgtgtaggctgctataaaacatttgcctgtcaaactggatttgatatgttaactaattttagattaaatatggtttaaatacggaggaactggcacttcaaaattatctcataacattaaaaaagttcctcttgaaaggccatatttattaaaaagaataaggtctttccaaatatagtattcataaggatgaattcatctctaaggtggtgaccaggaatccagacattctcaaataccctaggttattctgatgcaacgaaatacagaccttacaatttggaatgctttaaagaggctgaaatttctctctgaaattacctccaggtctatataacaaaagatgtaaaaacttatcctaaagtcataagaaacatctctttggtcttcttcctcctctgagactggcagcagcatgcctgatccaacagccaggatctctctggggcaagactgagagacatcagataatgcggatggagcgaagtaggatagaataataacaggaaatattcgaagcatttcaggaagtagctatcttattatagttgacttttgttgactaccacgaggataactggctgcatgccatgaatacaaattgccattattctaggaacattatttatctaaatgaacacttttgaagttactgaaatagttttaccctgaagttgaaaaacagatcctcatgatcttgtgagtaatatgaatttgtttaccaagatccattttcaaggtagtaaaaaattaagctccaatctaacccattaaaatattgcaaatatatcaaatttcactataaaacgttatctttatatttaattgcatgctctcacaaagactttccaatgtatttttttaaatgctttatctgtattgggtaaatcacaggtaatattttttcatggagcattagattagaaaatactttagagattatttcaatatctcatattatagataaataaatgaaggtgcagaatggagatggggataacatatgaaaggttatacaaataaataatcaaatacaataagatccgttactttttttacttagaatcatgagattagaaaataaagttttttttagttgaataatcatattacttggaattaaaggtaaaaaacgtttttagatggtgcataaatagtaatgattagtaataagtaattgctaatgagaaataattttcagttgttacgattaaatataggcatgcttacttatgcctcacagcatactttctactgagcctactgtggaaaagctttaaaaggaaaaatgcttcctgattttattggaaaagggcatcttaaattttttgaaatgagacacacttaattttctcctctaatttcagagccaattatactttatgcttatatattcattcataagaaagacacagtaaaaccaaagaaatatccttataataatcttgggctttgacatccaaacatgacatctactggttgaacagggaaagaattcataaatatatatatttttaatgcctcaggcattttaattcttccaataagcataccaagaaaattttcttactctgtcacattctagttttattcctatactatgttgttccaatctaacttttcacattctagttttattcttatacaatgttgttccaatctaaatattttcagattaactaacctagaactatattcattaactgaactgggaggtaaattttggaatcatcatgtatgattatatataaatcttggatttaaaaaatatccctaaaatatctatatagaaaaaatttgtttttgaaaatttttatagatttatatagaaatactggtatttcattttgcaaaatggttttgaaaaatgattacattgagattgcaaaatataattttatgcataaagttcaaacataaattaaaaacaattattattcccactatgaacacttaaaatgtgctcggataaaggaactgatttcagtaaagtcaatacagattttgaaataaaaacaaaataaggtatataatactgatcaagaccacacatatcttgcttttgaaaataattcacattttggaaaatagactgtatgaatataaacttaaaagaattacacaggtttataggacatgtttgcaaatttagggatatctatcaatttttcactttgtaaaacagacaatacatagctaatacatattgctttcctacgaggtgctgagaaaatctagataaataaaatgagcccattttattatcagattgcacaatctcagaaaaaaaaaactcatacagacaacaaattctgatacagttggtggcataattgactcaaaacaagaacaaatttctttctttcatctagaaatgctagatgaaattatgccaaacctctttttagatgtatgtttgcaagcaagaaaaagaagtctctagggatcaaaaaacactgctgaaaacaagccatttaataagagtttggggagaaaaatagagtgctgttggtcttttttaccattgggagatggattttcaggcccatgggagataaggttaatagactactgcaagaagagaagttggtaatgaggccaccacctatgactaaaatctagaaaagttatagtttcagacataggatatgctagaaaacatttgactctcaccagtataggaagatgacaaaaatatttatgttaccataaaatttttttgacttttgatactgctggagtgcttgaaaagagccaatgacaaattgatcttgaaagacatgctgtcaacttaaagcgcagagaattcctctaaatcccaatgattataaattcacaaacattttgaatacacaaatacacaagaaaacgttccactgtgagagactaacaaggtaaataaatagtaagattagacttaagataatagaaaaataaaatagaatttaggctgggcacagaggctcacgcctgtaatcccagcactttgggaggtcaaggtgggaggatcacttgaggtcaggagttcaagaccagcctggcaaacatgttgaaaccccatctctactaaaaatacaaaaatcaactgggagtggtggcaggcaccagtaatcccagctattcgggaggctgaggcaggggaatcacttgaatacgggaggcagaggttgtagtgagccgagattgcccaactacactccagcctggaagacaaagcaagactctacctcaaaaaaaaaaaaaaaaaaaaaggaaatagaatttataagtatacttaataagactgaagtcatacaatagaaaaatataaacgaacaccatggaacattctatgaaagaataattgatactgtctactgggaccaaagaaaggcttcacaagaggaatgtctggcattttaactgatcttaaagaagaaaaaatcaaatctctcagacagaaaaggttggttcatgaagggataaaaaaagagaagaaataaagcatgtccttaggtggagaaaaatgaatatgttatagatactttagaaactactgtaggatatggtactgttataacattcagtgcccacctttcctaccaaactgtgcacttctcaagaacagggatggtatcatcagctctcaccactatggctgacgtaatccatgtgcttgcagaatacaggaaaaatatgtcagtgctaacttgtgaagcatcttagtgatataagatgttgaatatttactctaaagtccagttattctgaaatgactttaaccagtcctcatgaaaatgggagaaaagattttatagtgaatccactaattttcatttttttagtgtgaaaactgagtgatggcaaataattggataggaaccaaataatttaaatggcggtaaggaaagaattccacaaaagacacacttgcaaagtatcaaaaataataaaacctaatttaaaacttctcatttaaaacctaatttaaatgtatactgaaatccaaggtgaacttaaacgccaatgatgcactgatttgaaaaaaaaaaaagccttctaaaaatcagaaatcacagctctagaagctaatacatatagccaaacgatttgagaatcaaagtcatatagtgttcacatacatagactggctaaggcagtgggttatgtgttaaaatgttaggtaaaatacacaataaaaatatacgcagctctctgtcattcctccatagggcaaaacagaacatgcaattattggaaccaaaattacattatcttcaaattaatgaatcttgagtaaattaattagaaaagaagagagaaaaaaatgttgctacagaaacaggcatttttctaaatgtttaatcagggaaatgatataaatttattttatgttttacaacaataactgctgggaaagaagctaatggattgaatgagtgagaaaccttaggcaggaaactagtaaaaaaatactgcctatataaaaaaaaagatatgtgatttgagaaaataagaaaagctgatgaattcaaaagtgattgcgcatactgctgatcaacatgtgtcttctgaccggatcctgagcgtagactcctaaattttcagtcttgagagaagaatggtcactagcgtctctaactgagagggaaaatgactgtgagtatctcatcctggaaaaggagtcaaaaatttcattacctcttgagattctgtccttctgaaggcttattgttttagattcaaagccatataaaagtatgtgtcatgaaattgggagcataaagaatactttgaggaaagtaagatttaattctgtcaagtcaaaagaaaattctaaaaaatagcaatatactcatcgctgttatctatatttggcatttatttgtagggtatttaatattaggtcttatcatattaaaagtaagtaatacaggaattattaccaatttgatgggttctacctatttcattggcttgaaagatactaaattaatatgaagagggaatttaaaaatgttaaacatacaagcaatacttaagaaattaaacaattgtatttgattttaaaaccatatcttggaattaagatgaatgtcatagcagcaataaaactcaatgtcattaatagtttgttcaacagtgataacttgtcaatatgtatgcaggaaataaaaacataacaactaattaatacaacagtgaagtcaatgacaacatctctcagttgaagattcatttttaaaatgaatgcaagatgtgtgtaacaatttataatccaactaaatcatttaggtaaagcgcgtttgtacttgagacagagaagtgtttatcaaaactatgtcttcccatttagtaacagcaaatatatttttcaatgactagtcattatcacaacattatttttaaattgcaatatagctggtgtattcatcccttacttgaattcattttcttctgctcgaggcagagctgtacacatcacattaaggcagactaccctgcgaccacacttcagcactcaagagcttcctaagaatttatagccctggaaagcaggtttactgattagttaaataataaaactattgatacattgtcagtctttacaaatcactgggatctttaaagaaagcctttaaatctgcttgggcataaggtacaattgctttggttacaatattatgatttctcttgtaggttatgcctcttcaaaataaatctgctgaaaaaataaatgtctcatttcccagaaatgattttatttaaaacattctgtatcaagttagtcttcctattattaatctggaaaacttttttatgaaaatcaattttagcattattttaaaaaaattcagtcacaaaaacaatacattcagccaatatatgaatttatgaactgataaatttgtaataatatgtctaaagcatttttatgatgaacatataccaagtgaaactgggaacaagctttatggaatttatggctgaattcacttataaaaggaagtcttgcccagtcatctttttctgattcctctcttgcatttatagattcatcttttagattgcctcttctttgtaactattagagtttattctaataacattgaatctcactcttatcacttcacaccaacaaaagctttgtaactcagtatttattgaataaatcaatcaatgaactttccacatgatttcacttctcctatccactttctagtgactcagcatgccaataactgaatgtttctaaagccccagtttcatcttcacacaccttgatcccataaactaaaatactttcctcctgcagttcctctctgctttccaattgttatctatcttttaataccaaaatcatgactatccttccttcctttagtaactctttgttctatgataattatttacatcatagtacttagcatttaattacaaaaacatatcataattttatcccaatatgtaagaattctggaaaatgttttctataaaatcatttttatttcttgttgaggtcctttcccagatttagacataatatagttgaagccagtagagggtactgaacaatacaaagcaaccacactatttaaaatgtaaaaatcattcttagctcatgggccatatacacacagttggccagctgaatttggctctggggtcacatgattgctaaactctgttctaaattatttcaggatgttacagtttgcagtgtattgttactaggttcttatctgagagttcagaatatgctaagtttacatctaaaaagtgtctttcttaggcttgacctgtctgacgaattgttattttaaacaaatatgccatttatatatgtatgaaccatagctttggtgaagagtgaaagttagccacatagaatctctaactagcaaagtataaaacttgaaagaccccaagcctagattccctgtgctaatttgaatgatgtatatttaacatttatgttacatcaaacccctaaaaagggaaaatgaatattaggaagttacatctgatagatttggtacctcctaaatgtgaatactgggtctatggaattacttgcttggaaactttgctaattattcctcaaggtgaaggttatgaaaggcctatgatttatgtgatctggttttgacaacagaatttatttggtagggcaaatgtatatatatcaagtatatatacgtgtgtgtgtgtgtgtgtgtgtatatatatatatatatatatatatatatatatatatatatatatacattttttttttttttttttcgagatggactctcactctgtctcccaggccggagtgcaatggtgcgatcttggctcactgcaacatccaccttccagattcaagtgattttcctacttcagcctccagggtagctgggattacacatccatctaatttttgtatttttagtagagacaggtttttgccacgttggccaggctggtctggaactcctgacctcaggtgatccaccttcctcagcctctcaaagtgtgggattacaagcatgagccactgcgcccggcccatgattatataatttgagagggtgacaaatgcaaaagttacctaatcatgcaatgagttgacaggttatttgtgctcctatttttattattttcggaattgaccatgtcattccaattgtaagtattaatttacaactgaaaactatttatttcatgagtatgcaacacccaaagaagaaaaaaaaactgaaaagattgagaagttcaatatttctaacatgtaatacccaaatgttggcaaaagtttaataagtttaacaaagtttaataaagtttaacagaatttgtctcccacagatagataattaaaacttagtcccaattgcactttgtagatgcagtacaagcaatcctttttaaatttctctagaacaaattaaaagagatttaagatgtcatcagcatattttttttaaaagccaaattactctcatatcctttttggtattctatgcattattctttcatataccaacatcagtaaaaaaaacaaactttggtaaataaaaacagtaatatttagaacatttaatggacgttttaaaaatcacaaacttaaaaacccttagaagaaaacttcagctaaaataagtgcttattttccttgcttaaataatcttatataagaccggtttaatgacaaataatgactaagaagattctatttatcacgtgtacttgaaatgagaaagagttaatcactctggcaaatcttttctttccttaggattattcataaaatccctatccttataactaccttcattttgataaagcgactgctgttactaaatacaatacctccatgaaatgaccacattatattttatcaccctttcaatagttaattgtcttaatttatcttcctgttttttaaataaattataagctccagatggcaaatatctcttcttcatatattgtcccatcggttgaggatctgaaaggaaatcaattgtacttaaaataaaactctttttaaaaatctcaaaatctgggccaggcgcagtggctcacgcctgtaatcctaatgctttgggaggccgaggcgggcggatcacgaggtcaagagttcaagaccagtctgactaacatggtgaaacatcgtctctactaaaaatacaaaaattagcagggcatggtggcacgcacctgtaatcccagctacccagcaggctgaggtaggagaatcgcttgaaccagggaggaggtggttacagtgagccaagatcgcgccactacactccagcatgggtgacagagtgagactacatctcaaaaaaaaaaaaaaaaaaaaaactcaaaatctttttattgagatagtcttttgcagctggtaggaaagaaggagtaattcaggtacttacttcttacagagttgttatcagaaatatgttaaattttgtcaattgaaagaatatttttaaatttgttaatattatcagggaaaatatctcccctgaataaagcactcaaatatgtaccacgtttttcagtagaactttggaggacaatttcttttataatttttagttataatttagaaaaaaaatgtgtttcattccaattgcttttagtttatttttgctttttttttttttttgagatggagtctagctctgtcacccaggctggattgcagtggtgccatctcaactcactgcaacctctgcctcctgggttccagtgattctcctgcctcagcctcctgagtagcggggactagaggcatgagccaccacactcagctaatttttgtatttttagtagagacggggtttcgccatgttggccaggttggtcttgaactcctgacctcaggtgatccaccagcctcggcctcccaaagagttgagattacaggcatgagccactgcacccagcctacttttgttactataattgagaaatgtaatcaatttaattgtagtcatatgaataaaaacatttttaaatttttcattaaatttttatttaagtaaataaaaatgactggagtaatccatagaatatcaaaaatatcgatggaataacaataagtaatatagagcaaaatggaataatgtgtgtgtacataacccataattcgacaaattccaattaagctttatgttttttacagtactcaatcttcagagatgcatttaaagaaaatgccatatagcaggattctcatgatatacagttcatttcctttattaatatgtgttagcataaagaacgatagctattaatatgtgttagcataaagaacgatagcataaagaacgatagtaattaaaattatggcaacttcaattttcttttcctaaattaaaaaaaaagaaaggaagatctttagacttgtatgaaaacttgtaacttagtctttttataatttgcttcaataatgtaagttcacatgaatataatattacattatataaactaatttcctttagatactttttaaatgtttagatattcacagaatgtatgtttataaaaatatatacttgaaaagttatttaagtataatgagttaaaatgatctaaatttaaaaatcatttttcttcaatattttaaatataggatgaacataaatctagttttataacctttcctaaaatcatcttcctgtattaatattttataaccactagaaaggcaaagataattaaaataaggcccacgatgatgccctccaggcttactgctaagaattagaaactagaaaaatgatgatcagatcccaagactgtataattcaccaagaatcctgccattggttattaggaaacaagtcactcagactgaaataggtgggcaaactacttgggttttcagaaataacatggtttagtaattacttcatccttacaacattatgtctttttttttttgaaattaaactgtctttatttgcaaatgacacgattatcagcacagataatcacgagaaatatataaaaagatttctagaactaataagttagttcagtaaggttgtaagcaataagataaacaaaggaaaatcaattgtatttgaatgtatcaacaataaacatatggacattaaaattaacaatacaatataatttatgttcattaaaaatataaaatgcttaggcataaatctaacaaaacccccacagtacttgtaggtgaaaacatatctgttttaccaaaccatcaaatgttcactccacacatactccacatcagttgaatgctaacctgatatatttcccattgtaaaatttctcccccagtttaagacacgttccagaaaagttcatgtcatttgagtagagttctgtcatagaaaatcaagagactttactcacaaaattaattaataaatataggtaatcagcaaaataataatagcaatagattgatttcattactagcaagaagtctttaaaaaaatttttttttggttctcaaaatgacaagtactttatgaattgggctagaataaaaagacatatctgaagatccaaaaggatcataatacacaaattattatttttaaaattatctgattagtctatataatatacctatcagaacattgggcaaaatataagtgtttaataaatgttaatctcccactacacttcccttgccaccccaacaacaaaagaaaatcaaatcaaataacattctttgggaagatttccataagttaatttgattattgttaacatatacagaatttgagggaatttgaaaattaattagacaattttaaatgagtttgcatttattttcttgaaactttaaagaggcattatttcaacacaattatgtcacccatggcttctttttgacattgtcctacagaactatacaaagttctactggtttatgtaacaaatatatatatatatatatatatatatatatatatatatatatatatatatatacttttcttggacaatataaaataaattcctgcatttaacagataaatactgtttcaacttaaatgaataactccttgactctaaaatcctggatacactttgcaaaaaaatgatgaaaaatatgagtaatacatgtcaaattttttctcaaaataagtttagttaagaatcttatccaaaaattcaaaaggattacttaaatttgctgaaacgatagtttttacacttggcatgcaagtaggaaattgcctaggactcaaaaaatgttgggaaataaaaactatattttcatttatgttatacttggaatcttcaaattatctatcctcttgtttgtctattatagagatttccaaggggccttcattcaccactactctagcaagtatttaagacacataccagaattatggtcctgcactgctgtttataaattattcttttataatttacaactaaaaacatggacttatggagcaagaaaaaccttgataaatgaaaatggtatctcagttttatataggaatttacagctcacaaagaactttcacaaatattaacttagttcagtcttcacagagctgagggaggtcaaatacacagaggcatatttcttggcttgaactgcaaatcttaaaagttaataagactatcataattactgaactgacacgtactactgtccttgtctggtctgcaaatcttacctcaaaaagatccaaatggatattttgtcagaaggaagagaagttgcataattcacctaaacatacaaagaaagctggcattcaaactgagaggttctgtgtctaccttccttaaggtatattatattaggaatgttagggtaaaatgaaacaatcagaaatccctccttatggaaatattacagcaaatgctgtaagaacgcagaaagaacacaaacctacttttgcttaattttatattaaaaaaatcatttcattaatacacggtgtatgtcaattgtcattactacttttttgtcagtgggtgaggaaagcacaaggtcaaaatagctatgacatgctgcatttggcttttgtcacagttaaggctctgggtcaattttgcgattctcttttgcttgtacataatactctccaaactactgcttcaagagttatgccacttcatctccaggtggatagtgtcagaatttaaaaaaaaaaagagttatgccacttatttcaaatctcacaaccatatgttttactgaaacaactgtagagtatgtgaattggtggcatggagagcacagatattatcaggagtgcagaagaaattccacggatgttatttaatgagatggaagcagaaaatgattaatgtacattatgcccaattcctgagatcagcacaaatcgcccattttgtagtgagtgcacctttgttacaaatctcccatgttataggcaccgtgagcacactttagttctcttaccaatccagctcaccctacatatcccgcacctaagaaatactacttgattccctgctgaagactcaatccctaaagtatctagtcaatcatatagaaactcaattgcttatttgcatgtgggccataaaagaagcataaatgttatctgtactcctcctaaatacacaagatatacaaaagcatttataagccaatatgtaaaataacccaaaactgtgattatttattagaacccacattcttacaagccccaaaaccttttcctgcctctttctgggaatccccaagagatttctcacatgtaatcacaaagccacttaacattaggttttcctgcccttcctttcttgctccatcttccaccagtccatgataaatgcccacaaagctagctagacaaagctaaccactgtcttcaccttcaccatcaccaccactaccaggtattctatctccagaggcttccaacacttccttgagtgtggaatgcagggatcggtatggcagaaagtgtttgggttgacatggagagttgggagaagttgcgacacttccattttacttgacagaactgatttattcattaggcacaggagtcacagcacctaggacctatgataattcagaggtccaagaaaatgttttaaatttaattcattttaaaattggaagaaaaatgaacataataatactaaataaataataataattgggattgtagatcctatttatataaatacagtcatacatatataattttaaattttgatgtattactttattttttaatgaaggaagtggtccacaaagacaaaggtgcctatggttaaaagtcataatttgtccctgccagtcaatcacttgagctcctgttcatgtctacaatttcgttcttgaaaagttctgtcagcttctgacaccagcccataagataggggcaaaccagaagcaaagggacaatcagagaacagatatacacctttcccttacatcatctttgctcttctgctgggccttctcttctcccatgaggaactgctatttttcacctcccattattaaataaaatatctttatttatgggaatggaggtccatgtatattggtacatgtagggagatgttatatgaatttgaattgtataagtaaaataatatgtgaaaaaataccaacatacaaaatctgaaatagcatatataaccaaacaagggaaaaatctcacttacaatatattagaaatttaatttatttttgttcatctctgtaatatcagatactgaaggacttttctcttcccgtcatatactgtggtatggatagcttccaaatatcacatcaacaggataaaggacaaaaaccatatgatcatctcaatagacacagaagaagcatttgataaaattgaacattccttcataaaaaaaaaaccaaaagctctcaataaattaggtatagaaggcccataacacaaggaacttcaacacaataatgtctatataggacaaacccacagctaacatcatactgaatgaagaaaagctaaacatgtttttttcaaagaactggaacaagacaaggatgcccactcttaccactcttattcaacgcagtactagatgtcctagccagagcaattaggcaagagaaaaaagtaaaaggcatccaaattggaaaagaggtcaaattgtccctgtttgctgatggcatacttttatacgcagaaaaacctaaagactctaccaaaaaaactcttagaactgaaaaataaatttaataaagttgcaggacacaatatcagcttacacaaatcagtagcatttacatatgcctggagtgaacagtctgaaaaagaaataaagcaaacaatgccatttacaacaggcacaccgctcccccgacaccccccccaacacaaatacctgaaacaaatttaacaaaggaagtaaaagatctttataaggaaaactataaaatactggttaaaaaaaattgaggaagacaccaagaagtggaaagacatcccatgttaatggtctggaagaatactgttacaatgaccacacacaaaagcaatatatagattcaatgcaattgctgtcaattactaatcaaagtaccaatgacattcttcacagaaatagaaaaaaaatcctaaaatttgcatggaaccacaaaagattctaaatagccaaaacaatcttgagcaaaagaaacaaagctgaaggcgttatactaccaatttcaaaatatactacaaagctataataaccaaaacagtatggtgctggcacatagacgaatggactagaatacagaaccctgaaattaattgacatttccacagccaactgatttttgacaaaggtgccaagaacattcctttgggaaaggacagtctgttcaataatgatgctaggaaaactagatatccatatgcagaacaatgaaactagacatctatctcttactctatataaaaattaattccaaacagattaaaggcttaaatgtaagatctggaattataaaactattagaagaaaacataggggaaatgcttcagaacactgggctgagaaaagattttatgaataagacttcaaaaacacaggcaacaaaagcaataataaacaaatgggattacattaaaccaaaaagcttgtgaacatcaaaagaagcaatcaagagactgaaaagacaatgcagaatggcagaaaatatttgcaaactattcatattacagggaattactatccagaaaatacaatgatctcaaacatctctagcacaaaaatatacaatctaattttttaaatgggctaatgatctgaatagacatttatcaaagaagacatataaatggccaaaaaatatttgaaaaaatgctcaacatcactaatcatcagggaaatgcaaatcagaaccacagtaagatatcatccggctgggcatggtggctcatgcctgtaatcccagcactttgggaggcctaggtgggtggatcacctgaggtcaggagttcaagaccagcctgaccaacatggtaaaaccccttctctactaaaaataaaaaaattagctgggtgtagtggcgggagcctataatcccagctactcgggagggctgaggcagaagaatcgcctaaaccctggaggtggaggttgcagtgagccaagatcatgccattgtactccagcttgggcaacaagaacgaaaatccatctcaaaaaaaaaaaaaaaaaaaagagacatcatctgaccccaattagaacagctattatgaaaaagccaaaatatgacaaatgctggtgaagattgcaagaaaggggaactcaaacattgttggtgggaatgtaaattaatatagccactacagagaaaagtatggaggttcctcaaaaaactacaaatgaaagtaccataggattcaacaatccctctactgatatttatccaaagggaaggaaatcagtacagtacagagatacttacactcgcatatttattgtagtactattcacaatagtcagaatatgaaatcaaccttagtatccattaagggatgacttgaaagataaaatgtagtatatatacacaatgaaatactatttggccataaaaaagtatgaaattctgtcatttgcaacaacatggataagcctggagggcattatgttaagcgaaataagcaaggagcaggaagttgaacatttcatgatctcatgcatttatggaagctaaaaaggttgatctcataaatgtaaagggtagaacagaggttaccagagcctggtgggggggtagttgagaaggagagaatagggcaagatttttgagagaatacaaaattacagataggagggataaattgtagtgttctatagcactgtaggatgactatagtttacaatatattatatattttctagtagctagtagacgggatattgaatgtttccaacacaatgaaataataaatgtttgagatagtagatatgctaattactatgatttgatcactacatattgtatgtatcaaaacattgctttggaacccataaataagtaaaattattataagtcacttaaaaagtttttaacaagattctcatgaaatgctttccactgagatctttctattcatgaccttgtaaacctgcttccagtgttctaccacagaacactgttcatagaaaatactaaaaatagcagtttctaaagcattatttggaagcttaatctttgataaaacaattatttctaggcctaaggaagaattggtgtttaatctctcccagacagaacaaaatgttttaaggcacttttgttgttagttgctgtatttgtcaggcaccatgctaatcaacttgcatacatatgttttttaatattcacagtctcatgcaagatggcaatatccttatcattttgtcctttcacagactaaagtgaagattagagatcttaagccactttccctatagtaagcaaccatcaagtcacgaagctacattttgaactcaggctgtccaaagtccattttacactaatttccaatacctttgggtatggttgctcacaaccaagtgcatgccttgctgaaagcatgactgaggctgaaatccaggctgtattactcttgctacgactcttaccctggtataggaactacatctacttcaagaaaggagcttttctctcctcctaatttacagagttattgtataggctagtggactttctgataggatggaggacttattgcaaaagggtctccactttgcctctgtgagtatggaaacttaaactacaagtttatccctaggactcaatcatatttgctatatcactatttgaaagtattgtcgactcaggaatttacaaagataaggattgactaaatctctagaataagaactacaagtactttgttaaatatttaactcaagaataataaatatactataagctgcatataaatgtatttagtcttgactaaagctatatctttccttaaaacctaatagttccggccaggcgcggtggctcacgcctgtaatcccagcacgttgggagtctgaggagggtggatcacctgaggtcagggattcaagaccagcctggccaacatggtgaaacctggtctctacaaaaacataaaaactggccaggcatgatggcgggcgcctgtaatcccagctactcaggaggttgaagtggaagaattgctcgaacccggggggtggaggctgcagtgagctaagatcatgccattgcactacagcctgggtgacagagcgagactgtctcaaaaaaaaaaaaaagttgaacttaatagttccaaaatatctaaaagccttgtattcatttaaaggaccattggttgagtgtgtgcgtggaggggaacagatggatgaactgatccagcgactcccaggctgaaagaactgaatgttcaatggtgtacttatagaccacattaacttcttggcaagtgctgctgctgcacatgtgggtggtccatcgctgaatatgaatgtgctgaatatcatttgggcaaggagcaagaggtgttcaagtgagttggagagaagcccagaaggtatgctgtttatcttctaggaacatttattttctgcaaaacatataacttgagttaataaagtagatttagatgtgaataaaggaaaccggttattgaacctgcatcactgtgcctctccaggaataactaaaagttttgaatttgaatcctagaacaagaaaaagaatagagcacaaataactgctcttatcaccttgcaaggaatcactggactggatctgactgcaaagcaggtatctatctgcctgcagttggatcccgaggctcctagtaactgtctttgtcatacattcttttaaaatagacaaagtcattagaatgataagagaaggagatttcttaagtaatgctcacttaagtaatgtgaaattataagactgtggttataacctctggtctgaatccttgacagaatttgtaacaagaaaacgtctattgactttctcaacttagagccctgtcacaaaatctctcttgataaaagatgccagatcaggctgtgggctatcatctgtggattctctctcctgaccactcttagtttcaggcatgcccttggaacacactctgcactgttctcatccattaatcattccttcagggtgaaggacagaggccaggtgcttaaacagacaccgggaggtttgagagatggctttgattccactgaactaaaaagttctgtgattccttcacagattggttttattaccattcaatttctaccggaaaatctaaatgtgctaagaggtaaataggcccttaagaatagcagtactaaacataggatattaatatacatagatgtgcttttctgtattcagttttctttgttctattcttctctggtgtcagtacatattagaaagtttcttttctctcagaggaaactgtttgaatttttagactgtttcttattatttacaaattagatctaatgcagactcaaaagtaatgtgagcaagctgtaagacacagttttgcaaccctacaccctagcttgttcgagactgatatctctgtctttccattattttacacagcagtgactgtctctgcttacaaaatggtaatactccaaacctgactgatatctttctgatttaacttttatatatgacttttgctaccaacaaattgggtctttctatatttttgatgtaacattcgctgtctcttaatgcaagaaatataagagagaaacattgatatggagaggggaaatactgtgcagaataaccattttagcttccccaactaaaataattttgaaggctagtggaggagaaaaaggaacaaatcattcttgaggaaaaattaattttgctaaattactttgcatatgttactacaatatgcattagaaaaattacatacattataacattacatggaacaaatgtcattcacattatgaaacacttcctattctgaagcctaccttagctagcagatgttttattcatttacaacacaatagtaccttattcagatataatttacatataataaacttcataaattttaaatgtgattattgatgggtttggaaaaatatatattgctatgtaatcaccaccataatcaagatatagattcccatctctgcagaaagttacctcctgccccttcgtaattagtcacctccacccttgacccaggcaaacaaaaatccacttttcattactaaagattagtttttcctattcaggaaattcatataaatgaaatcataaaatatgcactttctgtatttggttcttttcactcgacattgtttttgaaatccatccacttgcatgtatcagtagttctttccatttttaacactgagtaaaattccatttcgtgaatagatcacaagttgttcatctgttgatggatatttggattgtttctagtttgaggctattacaaatgaagctgatattaaagtttgtgcataagtctttgtgtatacatgtgctttcatttctgttgggtaaattaatttacttaatagtatgcttaaaatcttctaaaatattagtgttttttatctccatattctatcaatcacgaataaatgggtattaaaatcttgaactataattatggaatagtgtgttactccttgtagtattttttatttaggaattttaaggctctattaatagatgttcacataatttgaaccgttatgtcttccctataaattcctgttgtagtattattgtgttcctctttaactctcgtaattactctatcttgaagtctactttttctggtaatagtacagccatgccagcatttttatgtctgctgtttgaatgctatgtattcccccatttcctttcagtctttttgtgtctttgtatttgaagtgcgtttttggtagaaaacagtgtgtatcttgtagatagtgcatttttttttctcagtccagttctaccatttctgacagctaattggaatcttaaactcatttacatttactgtaattattaacatgactgagttaaagtctaccatcttgctctttgttttgtctcttcaatatttccttcatctgttacttggtgtattttgactaaattcaaaaaacttttgaaggatttttatatggcttaaagtatgcaacattcacttactgattctacttagagtcaatattgtaccagttaacatatcacattccatacttcatgattctctgaggtccctatttacttctcacttcccacatcacaaatgtaataaatttacaacagtataattcaaattaattccatcgcttgtgctattggcatgttttagctctaaatatgctgtgaaccctaaattacaatgttgttattttttcttcaaactggagattgattggcagacttatttgtaaagggtgagacagtaaatattcttggcttgagccatatggtcattgttgcaactactcacctctgtggctgtagcatgaaagcagctttagacaatacataaacaaatcaggaaaggtgtgttccaattaaacttcatttacaaaaaacagtttgctgacctcaggctgctatttgttgaccccatttatatagatgtttattagggaaattgaaagataaaagaaacttagtcttttatctttacccacttatttactatacctaatcctcttcatttatttttatagatcctggtcttcactgatagcctttcccttaagtataaagatcaccgtttagcatatttttgtactgcagtttcacagactaccaattctctggcttttttcagaatatatatatttatttgactctaatttttaaagtatattttcactagacataaaatataaattgacagtattttcaaaagatatttaaagatttaaagatgtcccactttcttctaagctgtattgtttctaatgagaaagtaattgtcatacatatcatcagaatatcatttttttttctggctgctttgaaaattttctctttatcattagttttccacaattggactatggtattcttacgtgtggttttcttgtatttttcttgccttgtgcaccatgatatgcttggatctgtgggtttgcttcgtaaatttgtggaaaatttcagccattttttctgccccattctcactctatttcagaacttcaagtgcacctgttttcaactattttatattgtgccccatgttcttaggtcccttctctttattcttcaatccctctattttttgatctatcaggttgtatcagctctttcaatttgttttcaattttaccagtcctcttgccttttccaatatactattaagcccacccatagaatttttctttcaattattgtgcagttttagttgttcaatttgcatctagttgttttttagggttttttgtatgctaaaatttcttactcatttgctcacaaaatctgcatttttctttaattatttgaacatattttcccataatactttgaaaatattcataatagctacctgaagctttttgctaaatccaacatctggcctaccttaaggttagtttttaataaactactattattctggaccaaaagtaacattttcctattttcttttcatgtcaggtaattttttattgtttaatgaacattatgaagaatatatgataaataactggactgtgctctctttcaccctgtaaagagtgccaagttttagtttagtagacagttcaattacctgctgtcccttttgaacctttgtttgccatttacgtttaatgtaaaaagtgatgaaatctgtggaaatccaaggatgttcctaaactcttctaacttggtgggactcaccgttaaaattccgcctccctctaaattttagcagagcttggtgttagtctttgttaaggagtacctagaataagtctttactctgacatggtttttgttcctctgatttaatccttttggagtctcatcaggatgtttagaatttaaggaggtataatctacctgatgagctgaaattctggcttcctttaagcattgctagaactctattatcaattttctactcacaaaaatcccatagagaagaaaatggtaaatcacctcatccttgtagagtctgatccttaggtaaggatccacactaactcctatgacccttcttctacagagttttttactatacagtattttgtcctgcagatagatgcttttgctgctttgagttttaatatatgtttcttaaacttagccagaaatccatgctcggcttggaatctaccttgctatgctcatatacagcaaattcccccaaatggagagctagaataatcatggggctcacttcatgggtttccctctcacaggaaatgcagccttgcactgtctgtttttattccttaaaattgtaacctcatgtagtttgtccaattttatggtcgtttgtagtagaaaggctggctccattagtattttccagataacttccaagattttagcaaagctacaacacaatattcaaaagattttaaggaagacatgagttgtataatgcatgtattttaaatacatggttaacaaatatggttaagtagatagtgttgcttaaattaaaaatcaaagaaaattagcacaaagaaaaaaacaaataatatgctataacacagataaactgagtcaaaaagtggacaaaaatctttaaaactctaaatgatgttttaatttaatctgaataaaaattaaggtatgagatctaaacttctaaatttcctttctcttcctatagcttcactcattgaataagtattcattagtagtgctctatatatgaggaattcctacagatattggaggggagattgtaggcagtgagctcaatatgatataactttattgcttgattttacagctgtaatgccaatttatatgataattattgaaacttggtgtattctcccttgtttactcacaaaacaatctattaatgtgcctgcaaaaaaaaaatgaccttttcaaaggtttctgtactttgaaatgaatgaatgcatttgcttgtgaactgatattgcacttgagttgtgttgccaatacagcagtaaatgaaaggctaacaagcaggaataagtgcttgttaagagaaatattaatggcctgaaatattcattcaataaatggactgatgtttgctcctatggaacatacattatgatgtggatgtagtcaacaaacagttacataatttctgggtttgacaatattctgaagacagtctctgagagatgacatatattaagacttgtagaaaaagaaagagctagtcataccaagaccagagaagaggattccaaaactagaattttctcttttacccctaagttcctccagccaccttacttacaccacaggcccagggaaaactgacagtacagtgaaacactgatttttcagtgtcaacaactccctaccatgactgacaggtcgtaggaaggatgccaggtccttccccttatatcctcataagacctgccccttatgtcatattggcattgactcaagtcttaatactgaatgattatgaataaaatattttaaacattacttgtttacaaaaaacagacttgattaggtttttactcattctttcttctttctcatattccattcttttccctcagatccatctctttcttgcttaattccaacaaacaagaattctttttaaaattatctttgtaagataaacttttagaataggaatattttcattgtgtcctcgcaattaattgtacatttatttgcatgcaaaattctttttcaattactttttctttaatattttgaagacataactccattatctctctgcatgtcaagttgcacaaagtttaatgtctatataattctaaatcctgtataaattatctgctttatctctataaataacttttcaaacatttttgtacttgatattttaaaattcatttaaatttatcagagcatgtaaattttccccccaacatattgttgctgtcactccatgagccacatcactcagaagtctagccaatatggtttggctgtgtccccacccaaatctcatcttgaattcccatgtgttgtgggagggatctggtgggaggtaactgaatcatgggggcaagtctttcccatgctctttccgtgagtctcatgagatcggatggttttaaaaaagaggagttcccctgcacaagctccctctctctctttgcctgctgccatccatgtaagacatgacttgctcctccttgccttccaccatgactgtgaggcttccccagctacggaactgtaagtccaatgaaacccttttcttttgtaaatttcttagtctcgagtgtgtctttattaggagtgtgaaaacagactaatacagtcgtcctttttactttctaatttaaaaaaaaaatctcagttattatttttttcatttaattttatttctgcatttggtcttttacttctttatgggtttcctgctaagcagatacttattattttgtccttcacacctcttaagactttacttacctttgtgtcctctactgggagagttcctctatgacatctttcaaactacttatgcctgccttgtgcctattctgcaatttagtctagtaatatagttatttatatcaactgttacatttttatacccattgtcataaatttcttttctgcaatgctcttttttcttcatcatgtttcttatatcctccctgctttctttgaggatgaaattttatgtatttaaaaatcttattttctgattattaatactcctacctaatgtggaatagattattccatttgtcttcttgctttcataattgttttgctcatgattttgcatattttattcctgtgagatccctaaatatcttgaccagtactgtctatgagagtaaggatgacctaggctcttgcttgtgttccttaggtaaagggaaggagtgcttcaggacggagagatctggttgcagtatcatttttaccattctctatcttctcttccctctactcttcagttttctccctccagttctctcagtttgaaatactctaggtccaggcactgctcttaccctaagttggcctgcctcttgggtgtggtctagcttgagggagtgtggatggagatgtgaggagaggaagaacagtagaaactctgagagccaaccaccctgttgccctcatttctatacactgtcccttccagctctgattctctctcaacgtttctcctaatatttcaagttagaattgctgcttttctgctccttggtaatgtcaggcaataagccacccagaataatatacagaggggaaaaagctcacctaaaatgcaaagctatctctcagacaagccacaaaatattgtcactggcctcattggttccagcctaatattcttaccacacttcttttccaaccaaagctcaattgtgcattgattacttactttatctctgacatcagtcatcctctccatctctgcctttttggaggggcattttcaatgttgtgttactcaggcagaaagtagcttacctatgggtatatctggaaatcttctcatcttatttttctatgatcatactgctttgtttttaaaacactttcaaactgattagcttatttgataatcctaaaattatgtgagccatgggaagcagatttatcatctcccattttacagatagaggaagcaaggccacaaagaattaaatggcttgcacagagctaatctgttagaagatgttaaaatcttccattcatgggagaactttctttacatactgaccaagaataaaacacagtcatacccacagtacatcatccagaagagttccatgtggactagaggagttcacgtaatttgctccatgctgtaatttgatactgtgatttcttttttattattttttaagatttttggggcatatgtgtagttttttacatggctatattgcataatgctgaggtttgggcttctagtgtacccatcatccaaatagcgagcattgaaatgcttaccaatgtgtaattgtttaaccctcacctccctttctcttctccaattttggaatccccagagtctattatttccatctttatgtccatgtgtatccattgtttaggtcccatttatagatgagaacactgagttttgattttctgtttctgagtgatttcacttagaataatggcttccagctccatccatgttgctacaaaggacatgatttcattaatttttatggctatatagtattcctcatatatataccacattttttaattaagtcacctattaattgatacttagttggattccatgactttgctattgtaaatagtgctgcaataaacataggagttgaggtgtcttttttatataattatttcttttcctttgggtagatactcagtagtgggatggcagggttgaatgctagtggcactttaaatagtagatttttgatagcaacattgctctgaatcttttattggagaaattaaatgattttataatgaagaaaatgagtaatgcaaataatttaaggagccatcaaactgctgtaaaaataatgaaaattttaattgaagtttttatttaagtatgatatgaaatataaattcctcattatatgtttactggagaaaaataactgtttaaaaaattatatgaatttaaattgaatattaaggtatatattttagtaataagtgatagcattaacttcattaagtgatacttacatttttattcctaatttttcagatttcgcatggattcccctatattttatctagattgattattcaaatattcctttatcatcactactaaaagagtcactgatatgtgtcaaaaagagtttgaactatgttattattggcttactggacctctgttagtttatctgtcaaaggagggtgataccatctcttctgcacatgtagtagggttgttggagatgataaggatatgtatggaatcacttcgtatattacagaaggctgtacatagaagtgatatcattttctgcttaaagttatttttcagtacagctgcaactcataagctggctaaaatactgggatccactagtccatctgttatcatcataaataaaattctaataaatttagcaaaattctggccttgagaaactttgatttgacattgaaatttcttgccttttagagttatcacaattttactggcaattatttttcattttcaaagtatgtttagactgctcttacttctgatagttattaatgatttttaacaatattatgttgcttgtttttagacattattaagaaagaagtatctagctgaatagcaataaataaataaataagtaaataaaaacattgccagagactaaaatatattttctatctggtcactgttaattcagtccaaatttaaaaaaaaaagataaaatactttattttgatgtggagtcaaatctgctttagtagttgtttcttcccatttattcttcaggaataagaaatgctatattcctttaacatcttgttttaggtgatattaaagtcctcagtcatttttaatttctttatatactgaacatggagaaactggtagttccaatatgtcaatatgaatattgtaatatgccaaaaggaaaatacaggatgtgaaatcctagctcaaatatttccaaactagaggtgagagtagcagttacaggcaaaattttgctttgtaaaaccctatttggcaggattaaggaaagggattaaactatgaaggatttatttagttaatatttcaatagatacagcagtttcattcttatgtaggctatgttcaaaaaggactcctagtggcaggaaatgctgtggcagaaagaccctaagatgactcccaatgattcctgtctcttgtttttcatatatttgtgtaattccttcagtgtcagggaaaaaccgtgacttctttctgattaacagaacctaaaaaatgttacagaatgtcacttctgtgatcgtattatgtacataagattccattttagcagactggagctagagattcttcttgtgggtttgaaataagtagtcacttttgagaagcccatgggacaaactattgcaggtagcttctaggacctgcaggcatattctagggtctcagggtagctccagcaaataaccagcaaataccagggcctctatcatacaacacaaagaaattaattcttcacataacttgaataagcttggaagggacttttccccagttgagcgtctagataagaacacagcccaaccaacagtctgactgcagccttgtgagacccagaacagaggatctagctaagccatgcttggaatcctgacacatagaaactgtgagacaataaatatgttatttaaagcttttgactttgtataatgtaattctttatgcagaaataataaccaacacagcaccatcaattttattatgtttagcattaaaatatcttgagtcaataattaaacctcatatcatctatcttttgaaattattctgagactaaatgtccgtggctctgaaaaagggatacaatagtaatggtgcatagtttacagagataaaaccatagttcaaggattttccttggcaatctcattttaatttcattgcagtattttcaataaaggaaacttaaatatataataaatgcaatttaatcttcttaaaataaaatctatacccacaacattaattgacggtgaagcaatacaataaagttattttcaatgaaatccaagcagaaaaaaaaagtgtctaaaattattgggaagtctcctcaaaaagaagaagcatgctttacttttggaggaaatgtggaattaatagctggagtttaagtagtcagggttataagatgtaccatttattgatggtggttgaggattaagatggaagaagcctgaattcccaaggactttgtggaacagaaccatcgtgttactttctgaaatgatacatcacttaacctgagtgaaataattttctagactgtttaaataatggttaagccatatttaaatcctggttatttggagtttatttacatgttcagagaaaagcatttacagcagtaatcattaatttgtgaatcataaaatattatcacagcctgcacctttctatttggctgaagaataatgattaacataaccctggtaaagtcatatacaaaagtcaccataactgtagcatagagatatacaaaaagctagtatttcagaataaagtaacatgtgaagaaaggcagagtcccacaaatgtgtgatgatttgggggaaggcagcatagtcaaatttgaattgaatttggaataactggtagaactgaaatagagattatgctatatattttattttaaatattaatgaatgctttgaagaattatgacaatgaagaatttgcatatcatcctataggcaatgaacagaatcaacctttctcacttaagataagctaggttttctaggaaaataaagcccaacaatatgaaaatttcagagatcagataaaaggaaactgcagtatcccagaagagaatataaggcttaagaagtgcaatagatataaaaccaaaattacttcaagatactatgcaaatgtaaaactggcaaagtttttcagagaaagtttttattgttctctttctgatgtttaatcttgtacctcacacttagtaagtagagagtaaatacttgttaaatacattcctgactgtaaaaaaaatcagttgagagtacatattggtggttttatactcaattataatttatggttatgcaataaaaaatctattatatatatacactgttaacttttgaaaaaaaaacaccacccctttagtatctttcatttaaaagaatcttaaaatgtctccattgataaaattcctaaatattttacaactctaagtatatataactgtgtacatgcactttctggaagttagaagggcattctacttttatctcctggattatatagggaacattgattaccattttattttcctcttattttctttgatctaaaaccatgtaataaatgcatatgcttagactattgcatttaagcaactagacaaaacaaaaaagctaaatataaaaactatgctttttttcacattattgtcttgcctgacttgtcaagaaatattagtctcccgatgcccataaacatttcagtaaaaacataatgtcagaaacaagtctgttaaagtaaagaaatatgaagaaagtgtagttagtgggaacataattagaatagcttagaactaacatcttgattgctaaatatttaggaatatcaattagaacaatttgaaagacatagataatttaaaactttataaataaatgctgcattttgctgcagattgcctgtatcttcacgttcaaaaaaagaataaaagtgcatcttcattaatctctggtgctgtcaaccgaatctaccagtagattctgtcatctggtttcctatataatcaagctgctggaaacatcttttctctgctatattgtgtaatgggcataacatttcaatgttgaagcatcccttggggttggtttaagccaatgtgtagcttaaacctacacagtctactgatgtaggtgacctgaaacctcgcaggttgattttcctcattgactgcttcttgcagttgtaagcttattccagttagccctttaggtggcaaaagcaaccccttctcacaactttgctgagttgtaagacacgtgcacccatgtctccagggtctagcttgcttagtgtgataaaactgaggacagttgacaaaactgttctattcatctcgtataatttttaacagcagggttctttgaaatagtgagttgtaaagtgtatttgttatctaagactgccacgacaaacagccacaaactgggtggcttaaacaaacaaacaaacaaaaactatcttctcacaagtctgaaggccaggagtctgaaaccaaggtcttggcaggaccctacttcctacttctgtagagactccaggggagaatatattccttggctcttccagcttcttgtggctccaggggttcttcagattgtggttgcattactgcacactcacattgcctcctcttctctctcaaaactccccctgcctctctcttataagaatacatgctattgcatttgaggcccacccagataattcaagataagttccttctctcaaaatccttaacttaattacatatgttgccatataagttaatatccacaggttccagggattagaacatagacttatctttttcagagggcactagctagcttcctaaaatatatatgatttattttcaacttaagccatccttttaccctctctgtattcacttttttctcatttaaaaattattttcagaaattttctttcactgaatcattaactcttttgttcatcctccatctatttaatcactctagatttactggttttcttttctagatcaagaaatgtgatgggacataatggggtataacatagaatgatattcagtcatgccatgaaaaaataagcccagatattttgaagtattgaagtatatgtttttccagagttaaatattgagacattttgaatctttgataaactgaaatgcatgctccagttaaatcctgtgctataatattacagaactattaaaatagaactatttatgtctacatattaatatataagtaatatagataatacttggaatttcaaatttacaaatgggcttattctaataaatcaatatgctaccttaacctttagaacttgtaaaaaatagcccatcatagaagatgaaaaatggcatctgggtttctactaaagctcatgaagctcacttaaacctcataaaactgctatgacttcaccattaaaatacgagtaaataaaatatatgcaaatgcaaagtattttttagtattatagttaattatctttaacatggataatatactacaagctaggctcatcacagtttccaaaatacctttgcttactttgttctttttcctagcaggaaactattttcacaccccttctgacatttaagtgaacacaacggtattctcttagccccttactctaacatacatcataaacatagaattttaaaagaagaaagaaaagaggaataatcttttaagatttcctgtgagctaatacaggtatagacgtcattgcattttagttcaattccgtacatttcggtgtataggtagatcaagtgtactttgggatgactatacaaaattcatggtaagtggaagagtaaaataattgaaaaaataaaatttaaaatgtttttggttgagtctcagaagtaaacagcattatcttgaaagatttgctttgtgcattaaaaatatatggatctttgtatacttctattccctgactctcttacgttagattcaaagtttcgagtcatgagaaattcataaggaatactaatcctgatatgttttagtaaatgaactaattggtgtttcaaagtttcatccagacatctgatatgctttcctagattagactagctaatattacatttcagaaagcaaaaatggcgaaaggcagttcataattagagagttccctcatgagttagaaattaccacttagaatttatgctattaataagttttaagtctggaacattttaatcatttttatgacttctttttagataacacataatgtccagtttcttttttttactaccatgaacatttcaactattacaactaactttacctatgacaaagaaaatgaggagtattttcttttaatgcattcctaatttgtcactcataaataatgtacagtatatagattataaaaataacgtaaataattacataagacataatacagagggaatgtttaaaacacaatgacataaagagtcaatacttctccctaatttactatctgtcagatacaactctactgctttttcttggaatatttgtaaacatatggccagtcaaagacaaaattgaaagtcaccatatattgccaggtagtaaataaatacatatataaataagcaaataaacaaaagaaaaaaaattctggtaataagaaaaccagagcaattatctattcacatgagatttgaatagaaaaaaaaaaatgtttgcaacttgatctaattaaagccagccaacactacagtatgtcttattattattgaaacactcaaaataactgatatggtttggctctgtgtcctcacctaaatctcatgtggaattgtaatccccacttctcaggggagggctctagtgggaggtaattggatcatgggggtggatttcccccttgctgttctcgtgatggtgagtcagttcccatgagatctgatagtttaaaagtgtgtgacacttcccccttcactctctctctctttgctgccaccatgtgaagtaggtccttgcttcccctttgccttttgccatgactgtaagtttcctgaggcttcccagtcatgcttcctgtttagcttgtagaactgagtcagttaaacctcttttcttcataaattacccagtctcaggtagttctttatagcactgtgagaattgactaatataataaccaatttcctcctcactaactctactagaattcagataaccttctatgtaattttgtaggcctgtgcattcttttaactattaaaataaatttgacttaaaaataaatttgtagaaactctaacttgaggagtcaagctgttctatgctccattgatttacaaatgttttcattcttatattgacataggtctaagatctcttggtctaataaaacaaaatgtataaaaagaaaatatctggaatcctacctgtaacaagaaagctgcatctcccagctccagcttcatttatgatgctacagttataaaccccatagttttcattggaaagactcttcacagcgtactctgtgtattcctgagagtcaaattgacccgtccgtaataatttattgcccaagcgccactcataggtcagcacccgtattggataggctctcagtactctgcaactcatagtgacacttcgatcctgtccttgccggatttccaagaatgctggttccactgcagggggatctgtagaaaagatatgtaaaaacagatgaaagatgtgacttgcaataagccaaaagctactcttattagaagaagccatttgcagtaacacatgcagcaatagaggaggagtgtaggaggtgaatgaagaacatatttaagcccagaaattttagcttgggttgggaaatgtgatttcctgagggtaggaagtaaatgagcctccttgctttacaaatgcatttgcaggtgaaactactagagctgactgatccttcgtacctctttcagcaaatatttttaaactttcctattaattctaatattatcaatatattccttttttgtttgtttggggtcctttgtctaaaagtggtaagaattctttttttattatgcaatgaaaagattcctttcttcatttacttcatggtctgatactgaaggcagctatttaaaaagctaatttacaaaactgtatgaaaaataattctacagtgctaagtaaataagaagtgaatgacactatgagagttgaccaggcaagtatgctacaaaaataatgctcagctgtgtcttccagaatgtataggagatggtcaggtgagtaagcagtaagagaaggcattccaggtagaggaatgggtacatacaaaggtacaaaatctgaagaggaagggatgttcagagaaatgcagatggattagcatagctgatgcacaaaagaagaccataagcgcttggggggaaataaagatgaaaagaaagagactctattcaaggaatgcattttcttggtattgaggaggtcttctaaaatttttaaataaaggatttatatgatcaaataatttttttctttggaaaaacactgtggtagacaggaaaagcataaaccacagagggaagagacaagttgcaaaaaaattaaatcactggtgaaagcctgaactaaggtgaggtcagtgggaccaaaaatgatgccttaggcaatgaagtggataacagtgtcagtcatgaagacagtgaggaaaaggagaggtagattggtgtgtgttgaatgtgtccatttcatgcacctgtcaattacatccagaagcagtgtttcttcatttccaaacatatgggtaatgttttattttctctttgcttttgattttttgcttaactgaattgtagtcagataaaatagtccacatgttttcaatcctctgaatttgttaacacttgctgtatgacacaatatataatagatttctgttctgggtgtgcccactaagaaggaatagtctgcacttttgaagtgtgattgatatgtatctattgggccaactctaatatcgaggagttgtccaaatcatctatatggttgtttattcatttattttttgcctacttattccagttgaattaattcataagagtatgttaaactcctctaaaaaaagttaaaagttttagatatctaatttaaaaaattctccttgtagttctgcctcctttttgctttacctgttttgaggttatgctattaagtatatatgaatttagaattgttttatgttgtccatgagttgaatattgaatatttatcactataatctcttttatctccagcaatgctatatatgtgtgtgtgtgtgtgtgtgtgtgtgtgtgtgtgtgtgtgtgtgtgtgtgtggatacatacatatatatatatagtctaacattatcatggctacattggcatttattatgttagtatttgcatgtgatatttttccatccttttaatcttatacttttaatatctttataagtatttttattcttatactttcagtatctttaaattttacaagcacctcttttaaacatcatgagcttatgctttattttttaggattttttttaagtctgtcaatctttttttaacccagagcacttagcactttattcattgacatttactgtaactacttattttgtacttttattttattacatttttgtattaaatttactgtaacattattttgtactatttgttttctgctactctttattgccttcttttagatggatggattacattatcattctgatctttttgccactactacttgaagatttatttactctgtttctactactccgattgtctcaaagcttgcaacatgcatacttaagttatccaaaaacatcaatcaatacccttattatactactgaagaacacaataatctaaggataatttgttccttttattctcattctaacgtgttactgtgtcatgaatttcaatcctctttttttaataaaaagtctgttgtacatagttgggcgtggtggctcacacctgtaatctcagcactttgggaggctgaggagggcggatcacgaggtcaggacttcgagaccagcctgggcaacatagtgaaaccccgtctctaccaaaaatacaaaaattagccgggcatgtggcgtgtggctgtagccccagctacttgggaggctgaggcaggggaatcgcttgaacccaggaggcagaggttgtggtgagccgagattgcaccgctgcactccagcctgggaaacagagctggactctgcctcaaaaaaaaaattatattgtacattatagtataatatggtatacctatagtattttttaaaatgtccagatatttgctagcttatttgcccttcattccttctttcattgtagactttccatctgtgatgactttccttgtgtctgaagttatcatttagatctatcatatctttagtgaactttttgatcatgattttctaaaaaatatattttagtttgtgggctgggaaaccaagagctcttaatgctatacccaaagactgaagttctttataggacaccatacacacgaaatagtgctatgttttcctaaggagatccaagacttagccactcgtaagcaggcaataatccatgattagtgatgtggggaagtaaataaaggtctcaaagtatatgtatgtctgtatgtatgtgtgtgtatacatttttatgttatatatatacacacacatatacatacatatgtgtatatatacacatatatgtacatgaaatataattttcattttatatgtatatgtgtatatgcacacatatgtagaatttgtgtacatattatacatatatagaattatacatatgtatacacatatacatatgtgtacatataagttaaaatacatatatattttaatattttatatatacacatgttttatatatacatatatgtatatatatttaatgttttatatatacatatatgtgtatgcgtatatatatatacacacacacacacacacacataaaacattaaaaggtattttccttgtaggttggcaggctttgttctttcagcgcatcattatataattccactgtcttcagatggccattgttggtgtaaagaggtcaactcaaagtctcacactttgacgtgaatgtcttttttttcctccagccactttcgaaatacctttgtcattgctgttctgcagtttcaatatacggttcctagtgatgagtttctttttacttatgggtttgaaatttgttgggcttcttagatctgttaagtttggtgtctttcatctgaggtaattttggaaaattctcatcattagctgtttaaataacacctctatttccttctttatagcctcattagatgatcctgttcattctgcttttgatgtcttttaaccccttttcaaattttgcacttgttggtttttctgtactgcattatgaataaattcgtctgagctaattcagttcttaattctttctccaatcctacttaatctgcaaaatatatattgtgtattaattccaataacgtatacttcatttattctttttctgtatagttattttgtatacctgcacaccacttttttgtatgtttccactacctgaaaaagtagttaagcttatcttccatttctttaaacaaagtaattgttttatactgcctgataattttttttttttttgagatggagtctcactctgtcacccaggctggagtgcagtggcgcaatctcagctcactgcaacctccacctctcaggttcacgccattctcctgcctcagcctcccgagtagctgggactacaggcacctgccaccacacctggctaattttttgtatttttagtagagacggggtttcaccatgttagccaagatggtctcgatctcctgacctcgtgatccacctgccttggcctcccaaagcactgggattacaggcgtgagccaccgcaccgggccactgcctgataatttcaattgaagttttgaggaagtttttctgttggttttctttcaaagtactgtcttcctgtgtgttcttgattaattttgatcaatttgattctatgctatttgttgccctttaaaaatatttataggatatgctgatgactaaaatgatggtttctttctccagagaaaatttgtgtccacgggcaactatagacatcactgtctaggatcacatttaagtgcatgacttgaggctgatttgaattatcaagtgacttgaatttgagttaaaaatccatataaaggtcaacttgtaactataatttcaagaatggataaccacatcatcccatcctgttcatttcaaagtcacacatttcctgcactcccttgggagtgggaatgtgtagattgggtttacttctgctttactcctaccctacagatataatcctttgagatccaacttcttgggagacagttctaccaacagatccctcccctagtgaatattctgggtttgaagttctgcaccccttgcccaaagatgccatcagaattgaagctcaaatttgtccatattcagcaaataccctcaaggcaaatgtaacttcattgtacttctttcattaaatttgacaaagtatttttcaaataaacattttaaatgtttttaatattaattttacaatattgtccagattttagttgtttacattggagagattttacataatattttgtctattacatgcctagaaacatgtatctgattgtcaagggaaaaaatggatcttaaactcagaagaaagggctgactgaaggttacagttattaagatagctcagagtgagtatagacaaaaataagtaaaatgccaaatatgaactttactcttgaatataatcacttatggggttagagaaaaataaaagcttttaaaggagaataatcataaacaatcagtgagatgtggggatctagagtgttgtgttacaaaaattaaaggagctgcatgttttagagaacaagagtggtcaaaagtaccaaatgctatcaaaaaacaagttaagactgaagatatgtaaaatatatattttttctttgacaagtttagtaccattaaggaatatagtgaagcattttttctgtgtattatatataatttgggtttggggtatgtgaattgatggttaaactgtagaaataatgagtgataactgttcaagaacactgtccatgattttaaaagataattatttatgatgattctaccttaaaatatattaggagcttatacatttgtcactatatccactaccactactattatttctcacatggactacaacaaattccctgcagtatacctgtaataggtcaatgtacttcttttgttctctcattcttctgagatttgtcaaatgcgtgtttaacagaaaaatcagctcatgttactttcctgttcgaaaaactttatggactcacccttgtttgctattcaggacttcaaggtcctgcaagttctggctctggccatattctcaactattcttgtcttgatgactatgtcccaaacacataagttttcttcttgtttctacatgacaagtcttttgtagactttagacctctaatttgttctttctgcctgagatgttctttcctttggtctttcaatagctggctcattctcatcattcagattttacctctttaggaagcccatctttgatgacaagttagtaaagtaacttctcccttggttaatttttatttatcattgcatatattttctgcatatgttcactctttgttcatatcttgtttatgtaagctccattacaaagggacctaaaattctccaatcattgttgcatcctatgtgtctattacagtatctgtcattataattggtgatatatcattattcattaaataaatgaatacttgagtggtgttaaaagagtaaagatgtacacattctcttcaaaattcctcccatcaagacctggagtttatgttcatttcattaagtctggatgggctctgtgattattttcactattagaacacagagcagaagtgatgctgtgccaatttctgggaccaggacacaagtgtctggcagttccacttcctatcttttgaagcacccactctggaagtgctgaaccccatgtaaaacttcaacctctcctctgcaaaaaccatgtgaagaggcccagagacaatatggagaaggagagggcagagtttagcttagacttccacttgtcccttccaaggttccagacacaagaaaccatcttggacattagagaccagatcagctatccactgttagaattactatgattagatataataaaatgtggttcttttaagctctgaagtattggagtagtttgttacatagcaagaaataactgaaacagatgccttctatccttcaaaagtcaagagtctgacactatgagtggagtcaaaaggacaaggaggcaaaacattaaggcatagtttaagggacagtctaagctggttcaggaaggaaagaattcagaaggaaactcataggggaagacagccaacagactgatttgctagaacaacttgaaaacttgaaaagcaaatacattgaggacaaaggtatccgggagccagaacgtttcagttaatgaacagcatattgttgcaatttaatagctcacaggtagagaagtttggaatgattacaaaatcaaagatatgaccgttggaatgtaatactgaagtggagattaatgatactacagtcaaatactaataagttaagtgaatacagtctttgctgtcaagttatatttgtatttgcctagcaaagttaacgtgtttgtagctattttttttcttcttacaaaaggagaaatttccttttaagtggaagaggttgtcagtgtaattcattatacctaatgggaaaatatccccaaatatatatttacttttttttttttttttttttttgagacagagtctcgctctgtcgtccaggctggagtgcagtggcacgatctcggctcactgcaagctccgcctcccgggttcacgccattctcctgcctcagcctcccgagcagctgggactacaggcgcccgccaccacgcccggctaattttttgcatttttagtagagacggggtttcaccgtgttagccaggatggtctcgatctcctgacctcgtgatccgcccgcctcggcctcccaaagtgctgggattacaggcgcgagccaccgcgcccggcctatatttacttttttatagatgatttttgtgagaattctttgaaagtatccgacttaatgaattattaccagcaatgggggtttttctagactctctctatatatgaatgtcatttgcccacacctgaaagattcagcccattcaattttcaatggcctgtaaggaagaatgataatgttgggttaaaattcttcaaacatagtctattttcataaagtttaatagagtctgagttgcaaagcatccctaaattaaaggctatttaaaaggccttttatttaaaagactgcccacactactttgattccagggtggtttcttcaccgcaaaaaagctaaataatattaaaccaagcgcactcattatagtgcactcaagtctgtcaatggaaaatttctcctgatagatggttcattttaagcatactagctattaatagttggacatttcattctttggaatatccggtgagaaggataggcctttgcagttatgatgaaatgtatagtgtgaaaatttcgaatatgatgaaagaaatcttcaggtgttaaaaaaaagttagagctcactattgtgatagaatcagttttttatggcataaaatttattcagaatgtttttatgaagtattcaacatgaaggaaatgaaatatataggaatattatgagaaaaatctacttagcatattctgaaatgcttaaaagtaggatttcttaagaaaagtaggtgcctgtgttttgttcaattaaaatatatgactcttatattattatattatacaagttttttcacttatactaagatagttggttaaaaagtctatttatgaaactaccacactacatgtatactgaaggatgattataaaaataaagattatatttcttgacactgaatatttactaaatgctagatactgtgttaagatattcacacagattatctttttataacaataacccatttatagaagaaaaagaaaagacgaacagaaaaattaagcaagtcacccagctaaaaagtagcagactaaggaatcaaacaaggcaatctgatttcagaatgcatgctcttaaaaacagcctatgtcacattatttccaattgcagatactaccagtggttcatgaattagctctctccctaaaagaggacttcgaaaatcttgccttactggttatttaaagttatcaattaaaatagaggttgacctactcacaccatcatttaaaattcacagccttgcaaaggcaatgaagaaaagtcatgctttgtggaaagcatcaaagtattacaacaaaactactaatttaaagaaaaatgttacagaattttgaatcaaattcaaactgcagtttatatggcaatgtacttcatgtaaattaattttggtattacccatatattataatctatacaagtgtttgtagaatattaaatgtctgaaggtaaaagtgtaacctttcaaagtaattaaggattttagttgtaataaagtcattaagtaacaagtgcccaagattaatgattttagcattttctttttgtatctactggctcaagatgtccagcaaggtttctaaatacttagttctaatatttaaatccatatagagatatctaccttatttgggaagaataatgcatgaaaataccagattataggaaaatgtttatttgtgtgtatttcttaataaggggatgagagagtaagtagttcatgcatttttttgacagcatgaataaaattttgcatttatttcttgaaaaaaaatgacagtttcaatgagtaccagaactgtaagcaaagcaatttttttaattttaaaaacaataaaagatgtttaaataaataatagaaccttcaaatgaatattaaaaaatattaatataacctgtttttaaatatttaagggagtgtgagacaatggacgttaaatatgcatgggctgtcttcaatcacgtacagttgaaagaggagttgaaacagtcctgtctatttggaggacttcgtataagtacaatcttaattatttaaccattggaggagcactgagaaatatgtactcattagagtgatttcctctcgagccacatcttcccaagtcaaaagcatgcccaaccaaatacttgttgtctggttctttgttgggattaaagtcatttaaggaaaattgtgctcataattatttataaatgcaatatttataaaagaaaatctaggagttagagtattaggtcagggaattaaattcttccattgcccattaagaagagttgaattgctacaattaatatatgacaacctctctctccatgaacacatagaagtgttggcagggtggtgtgcctgaagacagcatggaagatctatacttcaccttcatcaatccttacccactgcatcttttctatttggctgttcctgagttgtattcactacagttgtccccccttatccatgcaagatacattccaagatccccagcaaatgacagaacttgcagatagtactgaacactatatttactgtttttttcttatacatgcatacatacctatgataaattttcatttattaattaagcacagtaagagatggacagcaataactaataataaaagaatgattataataatatacagtaataaaagtgatgtaaatatagtccctcctcttctctcttaaaatactataataaggaaagaagctgcagatgccgggaaagagtgagtgactgacccccagggcttcacaaccccaccaatgacttcaataatccgaagcatgagaaaaccgcttgactctctgggggcctccagactaacacagaaagctgcctagatattatgtagaggaattgctccagaactgtgacctgccctggggctaacaccatctctggtgcagctggccaaggtggagggcaggaggctgggcactttcacacaccctgaagacaaatctccctgatgctgatgctgcaggctattatgggaccaagacaaggggagatcacctgttccacaggtgcctgcctaagctgctcccactgacagtggttccaccctctccagagacaggcttacagtgcagcaggccaaaatccctgaaggtagatgcaaaaatcccaaaaaaatataaccacatagaattcagcagcacatcaacatagtactggatgtccgaggcagagcaattaggcaagaaaaagaaataaaaagcatctacattaaaaaaatgaagtcaaagtgtccctctttgctgatgacatgatcttacatctagaaaaatataaagacttcatttaaaaaattcctagatttgggccgggcacagtgactcacacctgtaatcccggcactttgggaagccaaggtgggtggatcacaaagtcaggagttcaagaccagcttggccaacatggtgaaaccccatctctactaaaaatacaaaaaaaaaattagttgggtatggtggtgtgtgcctgtagtcccagctacttgggaggctgagacaagagaattgcttaaacctgggaggcagaggttgcagtgagctgagatcgtgccactgcactccagcctaggaaacagagcaagactctgtctaaaaaaaaaaaaaaaacaaatcctagatttgataaataaattcagtaacgttgcaggatacaaaatcaaaacaaaaaaatcagtagtgtttctatataccaataatgaactagctgagaaaaaatcaagaaaacaatcccacttgcaatagctagaaaaaatataggaataaattgtccttggaatagtttgctgagaatgatggtttccagtttcatccatgtccctacaaaggacatgaactcattattttttatggctgcatggtattccatggtgtatatgtgccacattttcttaatccagtctatcattgttggacatttgggttggttccaagtctttgctattgtgactattgccgcaataaacatgcatgtgcatgtgtctttatagcagcatgatttatattcctttggctatatacccagtaatgggatggctgggtcaaatggtatttccagttctagatcccagaggaatcgccacactgacttccacaagggttgaactagtttacagtcccaccaacagtgtaaaagtgttcctatttctccacatcctctccagcacctgttgtttcttgactttttaatgatcaccatgctaactggtgtgagatgatatctcattgtggttttgatttgcatttctctgatggccagtgatgatgagcattgtttcatgtgtctgttggctgcataaatgtcttcttttgagaagtgtctgttcatatccttcacccacttgttgatggggttgtttgtttttttcttgtaaatttgtttgagttcattgtagattctggatattagccctttgtcagataagtagatcgcaaaaattttctcccattctgtaggttgcctgttcactctgatggtagggaattgaacaaggagaacacttggacacaggaaggggaacatcacacaccggggcccgttgtggggtagggggaagggggagggatagcattaggagatatacctaatgtaaatgatgagttaatgggtgcagcacaccaacatggcacatgtatacctatgttaaaaacctgcacgttgtgcacatgtaccttagaacttaaagtattccatatatatatatatatatatatatatatatatatatatatatatggaataaatttaacaaaggaagtaaaagatctctgcaagggcaactacagaactgatgaaataaattaaagaggacacaaacaattggaaagacattccattttcatgaataagaagaattgatgtcattaaaatgattctactgcccaaagcaatctatagattcaaagcagtccttacaaaaatgtcaatatcatttttcacagaattagaaaaaaacaatcctggaatttgtatgaaaccaaaaaagagccagaatagccaaagcaatcctaagcaaaaagaaagttaaaggcatcatattacctaacttcaaaatataatataatacaaggccatggtaacaataacagtatagcagtcgtataaaaacagacttagatcaatggaatggagtaatgagtccagacataaatccacatattttcagccaactgacaatttgtatagtgccaagaacatacaatggggaaaagatactatcttcaataaatggtgctgggaaaactgaatacccatatgcagaagaagaaaactggatgcctatctctacccatgtacaaacccaagatggaataaagacttatatgtaaaatttaaaactataaagccaactagaaaacaacataggggaaacactttaagacatcagtctaggcaaagagttaatggctaagacattgaaatcaccggctactataacaaaaatagacaaatgggactatattaaatttaaaagcatctgcacagcaagggaaacaacagaatgaactgacaacctgctgaatgggataaaatattttcaaactattaatctgacaaaggataatatctagaatatacaaagaacccaaataactcaataattttttaaaaatctcattaaaagtggcctaaagacataaatagatatttctcaaaagaagacataaaaaatggccaacaggtatctgaaaaactgctcaacatcactaatcattaggaaaatgcaaatcaaaaccacaattaccttaccaattaccttaccccagttagaatggctattactaaaaagacaaaaaacaaaacaaaacaaaaacacaaaaaaacagatactggtgaggatgcagagaaaagacaattcatacactgctagtgggcaagtaaattagtatacccactacagaaatcattatgacaattactcaaaaaaaataaaaatagaactatcacaatctaccaattccactggatatttatccaaaggaaaagaaatgtatatatcaaagggatacgtacctgaatttgcacatttatcacagcatgattcacaatagcaaagatatagaatcaacctatgtgtccaccaatggatgaatgggtaaagtagcatatgtacacaatggagtaatattcagcaattaaaatgaatgaaatcatgtcatgcagtagcatggatgaaactggaggacattatcttaagtgagataagacagtcacagaaagacaaataccacatattctctttcatatgtgagagattaaaaaattagatcttatggagatagagtatagatagatatcagaggcttggaaggtgtatgggtgggaggaggggataaagatatgttgattagtgggtacaaatatacagttagatagaagacataaaccccaatacttgatagcagattagagagagtatagttagcaacaatgtattatataataaaaatagctaaaagacaggtatatagttaaagaggtaaacagttaaaaaatagctaaaaatagctaaaagagctatgtatagaaatgataaatattcagggtaatggatagcccagataccctgacttgatcattccaccttctatgcatgtaacacatcctcacatgtacctcataaatatgtaaaatatattgttatcagtacaattgttttaaatcctgtagtatttttggaacactgttgactttgggttgttgaaacaatggaaagtaaaacctactgtataataaacctgtaaatgtaattaaaatgttttcttgtgttccatgagttcatctagtcaactatcaaacctgaggtggcaggggttatcatgggaacctcagaatctatagctggtaggttagaagtatggatggcaaacagggatttgtaactggcatttgaaatggggccaatctagtggggctgagtcctttaacttgtaggatgtatgctaactcaggatatttactgtgagaattaaactgaattgttgaatacccagttagtgctggagaattggagaattgatgtggaaaacacaccaggtatttggtgtcagaaagaacaaaagaactgccaatcaagtttttaaataaatccaatttattcagtagagaactatatggaaatcatctacttgagaaaagatattgagccatttgtaggatctgtctgaatgtatatagaagaaaaaaggattgagatggccaacattttttaggttaactcagtatataattgtgctagcacatttcatatacttattacttcatttaatatttataacaaatgtgtaaagtattatcactatctcctttttatagataaggaaattaaatctgagaagttacattttcaagcaacccacacattccagataacaggtttagatccaaatccaaatcacatgacatcaaagtccaaagctacacaactcctacaaactaacatagaaaaaaagctagatgaccttgggcttggtgatagctttttagatacaacaccaatggcataattattgaaagaagtaacttttaagcgggactctattgaaattattttttcattgttctgcaaagacacagtcaagaaaatgaaaagaaaaactacagactgggagaaaatatttgccaagacatactaataaatgattgttactgaaaacatacaaaaactctaaaaactcaataataagaaaataaatgacctgatttttaaaatgggccaaagaccttaacagacacctcaccaaagaagacagatggaaattatgtttatgaggagatgctgtgcatgatgtcatcaaggaaatgcaaattaaaacaataaaataccatgatacggctactagaatgcccaaaatctggaagactgacaccactaaatgctggcaaggatgtagagcaatgtgaattttcattcgttgctggtggaaatgcaaaatggcacagccactttggaaaatattttggcagtttcttacaaaagtatacatattcttaccatgtgatccagcaatcatagaccttagtatttactcaaaggagttgaaaacttatgtttacaaaaaacaaccaacatgacagtgcagttaagttcagctggtaatttttttgaggaagactttttcaataaaggaagtagtgcatcaacttacattttaatacaaacaacataatcctattgtgcagcttatacataaagcttgcagatcagcccctttgagaaacactgacctggactccatgccttaatcaaataattggtcaatgtttaacagacaatgcaggaaggtctgtatggaaggcaaaactgtcatgacaggacccagcctgctttgaaataaaaaaaatgaatggagatttagaatatatgcatttaaaaatgtaggtatcagtgaaacgtaggcagctttttctaaaaggcaaaagaatgtttcagctaaagacgtttcaggtacaatgaaacaaaccccaatctaatggcatccaaattgtaaagaacaaactaaaattacctctgtttgcagatgatagaaaaccatgcagaaaaccctgaagattccatgttaaatagctgttataacaaataaatgaaatcagaaaagtaaaaaagcaacaaaatcaacatactaaatcagttgcatttcttcctttttaaattattgttatttttttttttttggagatacagttttattcatgattacagctcactgcagcctctgactcctggacttaagtgatcctcctgcctcagcctcccaaaacgctggaatgacaggcataagccaccacacccagctaatcagctgcatttctatacactaacaataaacattttgaaaaagaaattacaaaaaaaatccatttataatagtatcaaaagtagtaaaatatgtaagaattcatttaaatacttaggagttaatttaaccaaggaattaaaggacatgtgcaatggaaactacagaacatttctgaaagaaacaagacataaataaatgaaaatacatcacatattcattaattggaagacctaatattgttaatacgtcaaaactacccaaagacgtatgcagattcaacgcaatccctatcaaaatcccaatggcattttttttggcagaaatagaaaaacccattctaaaattcatatgaatctcaagagaccctgaatagccacaacaaatcttgaaaaacaaaacaaagctggaagactcgcacttcttgatttcaaaagtcactacagagctccagcaatcaaaacagcgtggtactggcataaaaatagacatatagatcaatcaaacagaatggagaacccagaagtaccccttgcatatatggtaaaattattttgtacaaaagaggcaaggtcattcaatggggaatagatagtcttttcaacaaatggtgttgtgaaaactggatattcacatgcaaaagaattaagttagatcactatgtacagaaattaatttaaaatgggtcaaaggcctaaatgtaagattcaaaaatataaaactcttagaagaaaacatgggacaaaaacttcatgacatggaatttggcagtaattttttgggtatgacactaaaggcatggatgacaacagaaaacaaatggaattcgtattttttttcaagttgtgcattaaagtagcaacagagtaaaaatgtaacccacagaatgaaagaaaatatttgcaactcagatttatgataagcaattagtatggagaatggataaaaactcctaaaactcaacaaaaaagcaatagctcaattcaaaaatgggcaaagaacttgaacagatatttctccagtgatactcaaatggccaataagcacataaagatgctcaacatcactagtcattagaaaaatgctaattaaaactacaatgagatgccatttaatatccattagaagagctactactttttaaaaaaagaaaataacaaatgttggtgagaatgtagagaaattagaacccttaagcactgttggagggaatgcaaaatggtacagccactgtggaaaacagtatagttgtttctcacaattttaaaaaacgaattactacatgatccagggattctacttctaagtgtatatctaattgcaagcagagtctcaaagatatatttgtacagccaggttcatatcggcattattcacaacacctaaaagatgggatcaaagcaagtattcatcaacagatgaatggataagcaaaatgaggtctatgcatacaatagaatatcaatcagcttttaaggggaatgaaattctgacatatgctacaacatggatgaactttgaggacattatgctaggtgacataaactagtaacaaaaagacaaatactttatgatttcactcacatagagtacttagagaagttaaacttttagagacaaaaataaaatagtggttgccagaggctgggggaggagatatcttagtacgtttgagttactattaaaaaataccataaattgagtggcttataaatatttatttctcagagttctaaaggcagggaagttcaagatcaggaaaccagcagattcagtgtctgaggggggccagtttcctggttcagacataaggcttcttgctatgtcctcgcatgtggaaggagcaagacaacaatcttgaacctcttttatacaggcactaatccgattctttacagctctgacctcatgacctaaccacctcccaaaaggatcaaccttctaatacctaaccacgttggtggtttattttcagagaaaatggtgatttattttcagagaaaatggtggaataattttcagagaaaatggagagttattgtttaatatattgagagtttcagttctacaagatgaaaagtgttatgaagatggatgacagtgttggatacacaacattaggaatgtattaattccactaaaccatatgcttaaaaatatttgagatggcaaattttatattatgtgtattttaccacaataacaaaaatgaagtcagtggcttaaaacaaacaaaaaacaaaaacacagtggcttagaacaaaacaaaaaagaacaaaacagaacatcaatgaaccactgttacagaaattgaaccaacattactgtaaagtttaaaaaatagaactgaaaaaggacagagacatcattctttacctctagaacaaatgatactatttgatgtgacttcatacttgtgaatcaggaaataagaaaacagcttggttagagctgttttttctaacagttagttagacattcaggcagaaatttgcttttattttacattatctagcatgcataaaaaccaatctatgaataattctttgaaaatataaaaaggttgatcccaaaatgaagctatcatatccgttattggtacatataacgttattaatttgatattgaattgagtttgctgtcttcattgttttatttaatgactgtcaagatcgttcattcgttcagacacttcttcagttatttaacatactttttttctcatatttttctaaaagtaattcttctagaattgagtcttcaggaatataatctcacagatagaaaggaactgtgcttttcttactcatctgctctcaaattatatgcaccattattgaaactaatgagtagataattgcagattaattgtaattttaacaagttcatgccttggaatgtaaacataccattttatattattcaaacttcatcattctcatggaatttaagacagaagtcaaaaaagattgtttatccaaattatgttactaatgacatggagaccaaattctcaattctttattatttacagttttgctttataaaatagatatttacagttatgcttcataaaaaaatataccatattagagtacacatgactatatgacatatgtatcatcaagctccaagattaaaaattaactctagaaatttcatatcagaaaaaaagccgattttcaaatttcttctctttttttttaaaacactttcactagtcattctaggattcaaggccctcacttttttcttaaaggatgatatgaatgggaggggttgaaataagaagaggttaaatttctaatatttttttcctgtcacaaggactgacaaacattaatgcaagaaaaaaaataaaagatgaaaacagagacttcattttctagaataagtaaccctaactatattagtaagtaatcacaattagacaatctattttattattgtccacatttttacatccaaatatgaaatggtcatttgataatagccacaattaggcaaatattggcctcccagaaatgtagttaaaatgttgccgtttgcaccaggaagtctattataactaaccattttatatgctgatagttctaattaagtcagaattttacttaagaagacaaatagtttgacaaatgcaatataaattgatcatcttttataaaccagttacagatataatattgatcaataacatggtagtaaacttagtaggtataaaacttttcagaaataaagaattttttcacaacagcagaaattggggagataatgtagggggactcggtaaaaaaaatatccttgaaaatcttgctggagaaattgtgaaggctcatcttaggccaaaaaagtagataatgtgttgctttagtctcagtagtaagggactataaaaataaatttcatctccaaaaatgagagtgagtagaggttgttttctttccagtttttgcttatggcttaacagtttttttcagagtatctttatattgaacaagtatgtttctcattttatttttcttgaggattaaagacattcattatgttctaggtataatagtttcaacaaaacaacaaacaaaacaaaacaaagcaagaaaataaaactaaaatgattataattccagtagctgtaaaattgtgtcatatcaagcatagtgatcacattgtcttaatttactcttttgtctattataacaaagataaacattcagatgaaaaatatgttaggaaccattcatatttagaaaatgttttaatacatcactgtaattaggtttcaaaattggcttcttcatttattataatttaaggaagatatttaacatatatgctaatattgaagtgctgaattaaatgaagaaatgaaataaagaatatgggcattaatttagacagtaatgtgttttgctgctgatattaattaccaggcattatagtggatgctctcatgatatacttcaaaatagtcaacaactataaaaatatatattttcactatatttcacatacaggtactgagagaagaagcaatgcactttttaatgtgccataaattcctttatatcaaataactgtaaatatgaagtttcagcttttggagattattgttgttaacaggaaaaagactgttatcattgcctctgccaagtcatagttgctgcatttagacacattgagaaaatactatagaatccctattataaaaaatgctaaatctttcctgaatgactcagagaggcaagataatatttatatctccattcacattcagtattatggtaactacatttttcttagatactgagtttgcaaaaaggtcatttcatagactttcaatatatagatgaattgactgctcatgtaaacacaggttgctattcaacattgtaactatgtaaaaacataccttgttttattgtgctacactttattgtgtttcacagacaatgaattttttacaaattgaagatctgtgccaaccctgcattgagcaaatttattagtgccatttttccaacagcatagtactcactttgtgtctctgtgtgacattttggtcattcttaaaatatttccaactttttctttattattatatccaaaatagtaacctttttttcagtgatcttactattgttatttctattattgttttggaataccgggaactgcgcacatatgacaaacttaatatgtgttgtgtgtgttctgactgctctaccaaccagctgcttccccgtctctcatattctccttctccttaagccttcctcttccctgagacacaacagtgttgaaattaggccaattaacaaccctacaatggcctttaagtgttcacatgaaaggaagagttacacatctctcactttaaatcaaaagattaaaatgattaaacttactaaggaaatcatattgaaagctgagataagccaatagctaagccttttgctccaaatcgcccacttgtgaaagcaaagaaaaagttcatgaagaaaattaaaagtgctactccagggaacacaaaaatgataaaaaggcaaagcaactttattgctgatatggagaaaattttagcagtctgaatagatcaaaccagccacaatatgcccttaacccaaaccctaatttacagcagggtcctaactttctttaatggtatcaaggatgacagatgtgaggaagctgcagaagaaaagtttgaagctatcaaaggttgattgatggtgttaaaggtaagaagccatcatgataacttaaaagtgcaagatgaagcagcaagtgctgatgtagaagctgcagcaagttatccggaagatctaggtaaggttattgataaaggtggctacaccaaacaacagattttcaatgtagatgaaacagccttctattggaagaagatgccatttaaacctttcatagctaaagaggagaagtcaatgcatggcttcaaaccttcaaattacagattgattatactgttaggggctactgtagctggtttaagtgcattagtgtaagtgtaagtcaatgctcaattgccattccaaaatcctagggcccttaagaattatgctaaatcaacattatgaattatgctacaatctacatttgtgattaataggaggaggtcaaaatatcaacactaacaggagtttggaaaaagttgatcccaacactcatggaaaacttagagaggatcaagacttcagttgaggaaatcactgcagatgtgctggaaatagcaagataactaaaattagaagtggagcctgaagatgtgactgaactgctgcaatctcacagaataatttcagtggatgaagagttgttttttatggagaagcaaagatagtggtttcttgagatagaatctacttctagtgaagatgccgtgaacattgttgaaattaccacgaaggatttagaacattacataatgttcattgataaagcagtggcagggtttgagaggattgactccaattttgaaagaagttttactgtgggcaaaatgctatcaaacatcatgacatgctacagataaatctttcatgaaatgaaatgatgagttaatcaatgtggcaaacttcactgttgttttatcttaagaaattgccacagccttcagtaaccaccaccgcattgagtcagcagccataaacatcaaggcaagaccctccaccagcaaaaatactatgactcactaaaggttcagatgattgcaaacattttttaacaataaagtatttttagttcagctatgtacactttttagacataatgctattgcacacttaatagacaacaatataatgtaactataaatttaatattcactaggaaaccaaaaaattgtgtgacttgcctcatttcagaatttgctttattgcagtagtctggaactgaactcccaatatctttgaggaatacctgtgtttcaaattctgacttttgaccatctttgactttaaaaagcctttattatttgtctctggataacagcatatatttatgacaataaataaatatctattgagattgaagactcctttcaagagactttttaagagtctgggcctggcgcggtggctcatgcctgtaatcccagcactttgggaggccaaggggggggcggatcatgaggtcaggagttcgaggctagcctgaccaacatggtgaaaccccgtctctactaaaaatacaaaaactagctggctgtggtggtatgcgcctgtaatcccagctactcaggaggctgaggtaggagaatcacttgaacccagaaggcagaggttgcagtgagcagagatagcaccactgcactccagcctgggtgacagagggagactccatctccaagaaaaaaaaaagtctgtactaggatataaaatataaatttatgcttttattactactgtatgcaagtcagcatttcaggcattttgagaaataatacaaagtccctcttttcatagggcttatggctaagttaaagaagataaggcgtaaatatatgaacctttaaataatacaatagataagtttaatagtttaagaatgtcaagtggtaggtgtgaaaagagtgatatagagttccagtactgtaagttttcacaagaagagcgcatcactgtaagatgaagtgatccaggttatcatgacctgttttgtaaacaagcttttgatcacacagagagaaagaagtcgagaaaattgtgagaaggtagcattcacagtagagaggggctgggactaaaaatcagagcactgtacactttctgagtctgcatttttaatatacatgggtcttggttaactaaaagatatggactggccacagaggtgaatgattctacaaacaaaatcacagggtgacaaaccaaaagcatactgacagaagtgatggataggaggatatcatcagttcaacttagagcttcagaagttgagcaatatgtgatatgcatataatcggatttatgagtccaatcatacattcataagtatttgagcatcacctaaatattaaatactctttcagacatagtatttgagtgatgtcacatacaagtgttgtaacaagaacttttcaattttcctcagtgtttcagctatgtacacaagtgaccacaataaaagacaccatatcatacgagtactaacatgaaaagactagtatggtaaccgtataatttatcttccaaactgtgtaaaggaggtccataaattattaaaatagtattatactatgattaaaatggtgtaaaagtagtattattaaaatggtatatattaaaataaaaatatttatttacagatggacaaattagttttaatatattggtataaccaaaaattagttcctttaaaaaacaaatgctggctgggcatggtggctcatgcctgtaatcccagtactttgtggggctgaggcaggcagatcacgaggtcaggagatagagaccatcctggccaacatggtgaaaccccgtctccgctaaaaatataaaaattagctgggtgtggtggcacatgcttgtaattccagctacttgggaggctgagacaggagaatcacttgaacctgggaggtggaggttgcaatgagccgagatcacgccactgcactccagcctggtgacagagggagactccatcaaaaaaaaaaaaaaaaaaaaaaaaaaaaaaatcatgtcatctgcaaccagggacaatttgacttccccttttcctaattgaataccctttatttccttctcctgcctgattgccctggccagaacttccaacactatgttgaataggagtggtcagagagggcatccgtgtcttgtgccagttttcaaagggaatgcttctagtttttgcccattcagtatgatattggctgtgggtttgttgtagatagctcttattattttgagatacgtcccatcaatacctaatttattgagagtttttagcatgaagggttgttgaattttgtcaaaggccttttctgcatctattgagataatcatgtggtttttgtctttggttctgttaatatgctggattacgtttattgataaaaaaactgatgcaaaaatattttcaaagagtaaaatatagcccatatctatgcacactcctaaagaaatattctaaattacattgtattggttaaaggagcattacaaataaaataaacaaaactgtttttggcaaataatcatgtaccttattcagtggcttagctgaatctctctaatattctcattaatatttttctgataaatatattttctaatgtggtcatattatttttaatttttaaataaaattttctgaaattttcttcacagttatattttatgacttataaatttgaaattaacagaatcttcaattggcttttctctgtcaaccgaaatattctattaataaaataatgcctttaagtgtgcttccagcaaagcatcatcaaaaaaattcctaccaaaagttgagatatcccaagtgccactggagaattaaaaattaaatgacatacatttgagaacttgtttaatttgtttagtctccttgctctgtagggatgaatttcaatatcttcctggttgcagacctggttttcagtaatatcaaggtgctgaaagtgtcaaaatttaaattttttggcacttcacacattaaaagagaatagtttcagctgtgtggtaacttttcactaacatatttcttgtctttgccattcaaaacagatgggagacagtgagaattttgattaattctcttctccatctgacaaactgctaacctcctaatacttattgggactctcaataaaattagtttgaatatttatttaagtgcatagaattaatattataattaacatgaatagaatattacaagtatatttatatattaattataactaatctgattgatgttacaagtgcaaatatagtgctgtaagtatattagtaataaaacatagttatattacttgaataaagatacgtcaaatattttacatgattccactggatatctcagaactctagattccaacccccagggcatatgtaccagtctctacatctgcatcatcagtcttgcttctttacttatgttatcaaacacagaaaatcatatactcagtatttcattttcctggtattccaaatgagtatctggtgtaaatttctacttcctcaaactgcttcacttcctcttccttaataatgttcagtagaagtattcctatttgtcatacaaatacggaagcattcattttatttttacttgtgtgtgggcagaaagtattttctaattggaaatattatgagtgtttcaattatattttgtatattttatgtaattctatttttgattatattttatataatcaaagcacccatactatttccaattagaaaatagatgctttctgctcacaccatctctaactagaaaatcagtgcaattatatcaaaatcatgatagtggtttccagtggattcttgtatccagctgtccccattacatttctcaagaatacttaccttgtccatcaattccacagttataatcttacacaatggatttatagtactacagtttgtccttaactatttaactagatgtgttctggtaatcatatcaaagtactgatagatgaatagttagttggaattgccaatttgcaaaagaattaacaattacttccacgttctaattttctgttaagaaaaaatacaaaatttatacttaattttccactttgccctttcatatttaacacctagttttgctaacagtggcaaaacttaagcttggacctaataacagtcattctaaattatacttaatcctgaaatttctaagtaggcacttgctgaatttcccttaaaatacttttaactagtaattgttctttaaatatcagtacatttttttcatattcattttctcccttaaatcttcagaagagaattagacagcagtaaaagaagaatagagtagagctacagacatggaaagagaactctcctcccattgctcaagctgatagcttcagttactaggaccaaactactgaccttctgtgggattcaattcctagtttgcattttgtgaatcttagatttagatttctcctgtctttatcaatgagttcttataaagattaaatgaaataacgtgaaagtgactagaaagaagtgataaaaatataaaataataccttggcaagggataatctagtagtatcaattttgttttctactactaatttgtttcatctgtgtaaggaatccagcacaagtacttaagtatatgtaggagtctgttgaaaagaactgaaccgaacctagtggattacacatttatatgtaatcatacatgtaagtttttatgtcccatgggatgctgaattgctttatcaattttttggagaagagtaaattttgtgggggcatacttatttcttacctgagttactgctaccccaaatactgtgctgtcaaaaagatattacgtacttaaaaagaatccaaacaacagtagaaaaatctgctctcaaaattaagcaatagaatatggcacttatcctgacaactgagcaaacctttgcttgaatggtttactgtggagctgataaagtcgagcattagtgagttgcacattcaggacggtaacatctactgatcatgaaaataacacaaagcaaagtcaaagaacacttttacggaccttacataatttcaatgaacaggttaatcaagtgaaaagaatgttaagaatcacagacctcttcaacttttcttcctgcattaataatgccttattcaccttattgagagtcaccattagcgatttacaactgagtcattttttttctaggaaaaagacacaaaacctcaagacttctaaggtttcaaaggttgctgtaagaatgtgattcagcaagaggcaaacataaggagtgttatctttgcctaccaaaaaagtgccattgtagtttgttagccttgacagcctgaggaatcttgctaaaatatcaagttccaagggaaggtagtaactagtatactacagtgctcacagaccactgtttttttgcttatagtgttggcacttggcacagacacaacataacagatggcacaaatatatcaattgttctcaattcaagaacagtgtcacacgcagaactcaattatgcacatatggatacagaagccctttgtacaagaagttttatcagctacctctacatctgtgcctttattatttataccaacaaagcctcttcaggaattctttctgaggtaaagctactccctttaattataaagcaccagggtgatttgctcaacactaaagaccacatgaaatgggaaaacaatattgaaggctgacaacctgggcatctgccaacactgatcccagaatatcccaatcatattcccccaaaatactgatgtaagatctttctgattctcatgtacaggctgattaaattcataattaactctgctggattccagatagtctcaaacaggctattgatgaaatttccaaaagataaatgtcttaaggaaattagtttcaacagaaatcaactacccaaaagacacaactagctgcttagcatgctgtcttataaacacactggcaaattgtttgtcccaaagcatcaagagtaagctatattttattgcctaggactgatttaattattgaagtcagtagaactgagtaacttattctacactttttagcataacctgccaagtgtgtctgattttctatcagaaattacttagaaagcttggttaacaatgcttattgattttcatgaccattctgagagatggactttataactcatgaaggcaacttttcacatttattcaaagtggccctagctcaatttcatgtcattacagtgacactcacaactctgtaccagttttatgtaggtaggcatgtaggtatgcatgtgtgtatgtatgtgtctgcatattggtagtaataacagttcatgatagtgacactaaaacacgtaacatagaatgtgcatttacctccacttattttaataaatttattgacagaaaacttattttcaaatgacagttctctcaagtaaatgatgaacactaatatgcccacggtgactctttgggatcacactggtcaagcaaacagggctgggattttcatcactggtttgtttgtccatgtgatgaatgagtcctcttggttaatgctgaagcactgtcacaaaatattttgtgatttgccctgccagagcataactgagaattcgacacaaaaatgtctaatgtacagaatgttgttattcactatttattcatgatatccacaagagctactctttatcagaaaccacggagcagctttataggtattcctcctttatgcagagggcagaaggcctgtgttctgagtttttctgaagtcagatgcagccacgcgtcactcaccacattgaaatattgagaaggaatttaccttggtgatacgaaaatagaaaatcattttaaggagcaacactcctgtatctcaccgtttttgtttaattaagctcctaaatatgcataagactaacaaaaagttagaacaatgcctccctgatcttgaagggaagggaatgacagtgaaacttacaactatgtgaaaggcaactactatgttgcttctatgtgcaaagcaatttaacctggattaagttaattcaaaatataataatataaaactgttaagggcctcagaaggggacatcttccttactaataaactgctatatttagtagggtaagggaactatatatgccaaaaagtgttgggactgaatattctggggtgggggggggtgcgcgcgtgtgtgtatgttgtaatttgctgtagaagtatgttactattatgtaaagtacagagtatagtatgttatggtgaaaggaaaaatgagtaatataatattgaaattaatattattaaagtaaaatagtagtaaagagtggagaacatggcttcttaggatggtactagctagcagtgccatatatgaatgtatgagaagggttgtatttttttttcttctctctggtttattattgtgtcctcagattcaaaatgggagaatcatgctgattattccataaattatgaagaaggaaatagaaaactagagtcaaataaaaagaagcagagttactaagaatttatatttactttacagactggatagaaacaagaagggttgatggaaaaaatcaaataagagtagcataattttgattcgacaactgagacagctgttgccataaagtttaatttgaacataagcaacttaataaaaactgaaacaccagggaagcaaaggttagattctgacatgtttgctgataggaagctgctgacgtggggcatggtgacagctgtgtttcagttttcagaagatttagtgtagcggttggacaccagggtaggcatattatggtcaggaagaagctaatgagtggcagaaggactcacggaaaaccaaatcttaatgaagagaataaataagtgcagctttcatatgcatcagtgaggatgccctgtgtgagctggaaagagggatggatggagtagagctttaaggaatcttagggagatgtcatttatctatctcttctcaggtagaattgaaatttgtgttctataatgattctaccagcaggaatgagatgtatttcagaatagattctttgagaagagtaattttcaactgtttctccaccatgacgcttggaaaatagtagcatgcgcaacagaatcccatgtgttctcagactagagagaaggattttaaaagactgtgcaaagtacagtttctggactgctagagtaaactccatccttcattttaaagaaagcatatccatggcataagctcaaatttgcaataatctcttttcatttatatctacataaacaaaccaagtcacagattttagtactttacatgaacaaaaaattactcattacatgcactcataattctctgcttggttatcacttttctttgtatctgtccacacaactctgagttctaataccatttcaaacttccactttctgtgtctatgtagttttccccaattctgctagcagctcttagtggcttgctccatttatatgggctaggaatacttgcaagatagtggaaggaaaatggaactccccccacacatatcagaaaaggatagctgcactggaaaaaaaaaaggggggtatccttgtgaagacaataaaaaagacttgccttgggtaacatgatttctcatcagagtgaactccaggtacatttaaacacaaagtggaaagctcataatttttcatcttggcaggtgacaatatgtgactaatccatctttttcttcatggctagaattatacaatgctagtactatcataggaaagactaaatattacatcaactttaatcttctgttggcaatagctactcaataaagatccagtaaactactgagtaatttgccagtgggaaaggaaaatatgtagacaatatgagataatggattgcttctacttctaaaatgacttccatatagattgtgtttttttcagattgaactatatacaggcacttatatatattctacacaattagctatctaggcaggaccaaaccagatggcagaggagacagctggcagggaccaccaagtgaatcatgaatatttcataaaatcaaaaagaattctcagaatttgaaagaacaatagaggaggctagcacttcaacagcccatttagttgaactgaaatttctggtactagtatcccagcattcaatttatccatattatgaaattaaaataacagccccaatttttatgtatacaacaaagtatttgcttttgtcttttataggacaggctgtcactaaagaatactcttctatataatacaatgttcctaagagttcataggttcaaatccagactttatcacttgttagacatgtgaccttgaaatgtgttaacttcatttcccttaggtttcaatttcaatgaggataacagtgcttaactcttaggtttgtcttgaaaattaaatgagatatcatatatgaagcacttattatagtcccttactccctctcagctattacaaagtttctatggaatattagtcataagagactagtttactgtgagagtaggacttgtaaagctttgtttactatagaaattcaagtactcatttagtatttcttaaataaattactagatataaatcatgagcatttaatgaaaactaaaatcttcatagtaaaatttgtttaaaaattctgctacagtttctattctcctcttgaaaatccatgatattctttaacaagaaaaaaatgttctgagaagtattgcaaacatatacaggaaacaggtaaagaaacatgttaacatttgttacacattttcaaaaaattgttaaccactccttttatctccttttatttttgaggttctgctaatgtctagttacacattagaaaataggagtctttgaacattgtgtgatttattaaaaagcaagatcaaagattaaaaataatttatagtaaggctcctagatccagatagataataaaatacaaatttttcttggataatatgtcaaatgttactttgctggttatagcaatgtgcttactaatctgattaaacacaaaaaggtataaacatcaagcttctagttattgaataatcatatatggattagaacacacacacacccacacacacacacacacacacacacacacacacaccccgcgtaagacacagctagaaaatacagaagcaagagatcattgattgtttctttaaaggattatgggattacagtgcaagtatcagaacacacactctgaattaggctttatcctcaatgattttgtctggctaccatctggtccttcaatatgaaataagtagtggtaatatatttaacttgtcttattggggtcatatggccagacattttttattattatgaatgtacttccttttctgtcctttcatatttctatttaaagttctgtggaaatgtcacatagtttgacaggagcatcaagatacagaataataaaagtgaagacatcctctgccttagaaaggtcatttcctgaggattatttaaatcttttatagaatgtaaagaagatcttatagttttcagaaagaaaagaaatattatgctcatcttgggacttagaaaacaacttttatttttaagtactgacttgtccattctattatcaaagagaacacttattaaagagcaataccagctgtcactggataatttgccttaatagtctctagtatcatctttttgtcatttgtgtcttaagagtcaaagcagcaaagtttagtcatctatggcttggacatttaaattatttggaaattttatatctactaaatggtacacatgaaaacaatactttttatggaaaaagttaatgatgtctgtgagaacatttcccaacttacaacaatagttaatcagtttttctcctctcatactggaatgtttctaagggaaaaatatgaaattccttcattcactgaaactaaaacttggtcattttccctaatgtttgcaagagaaacaaaatagttaatacaactgtgttttataataaactcctaaaattaaaagttaatgttcaaatattttgtgccttcaatacactagctagatcacttggctagaacttagctagatcactatctgtaataacacagaattcaggataagactctcttggatcccatccaaaggttgaaatacaaaaagagacttgattataggttagcattttgtcatggactcagaaaattgcacagttgtatggtctcactaggaggagaataatggcttccaactcataatttcatgatttagtaataaaagctacgcctaacaatacactctttctgtcaaaagatcaaaactagcagatactttcaatagttgaggtacacaacacgacaataaaactgcttccactgacactgcttaagaaattctcaattaaaatctatccacaatatgaacataagcaaaagaaagaaacgagtgataataatctgtagtaaatctaatttggaattttaaatttggaggtggctaaattgttaaaatgtccacagtaaaattaaatctatatttttattcaaaagcaaaaataaaatgtagattaaaatctaccaatgttaccagaagacgttcaggactattcaccattcaagtgattagttaagttttgaacaatttttttttaaatctcagttttcttcttcccataaggggacaattattggcagctccatgtttgttacaatgaaatgcttcagaacaattaactagtaatttatatactgtaacagttggtagaaatcatttatgcttaaatttattatgcattagaatagtataatgtagtgacttttatttgtataatgtttttcactcaagaatagaatattctatcattcagatcatttgttggtactacttcatagtaatttgatagagaccggagttctccagtaatcatatacttatttgcactttgccaaaagctcctataaaatgagcacagctgtgtaaattgtttcactttgatatgcagagaaattaaattttgagctcagtgctacaaaatgaattgtgagcaaaaatagcatccatgtctcccctgatgattcctgaggcttgcatgaagttgattaatagcatagcaatatgcctcgactaaacctaatcgcttacatatcatttaatattgacaagtgaaaatgagtgatgtgaaaacattttcaaccaaaagtactgaaattgtatacttcattccccaataactataacttatacaatcttgagctttacttggctctttagttattcattgtaaatagttatccttaaaaaaaaaaattcttctcatacactaggaaagtaacctctgatgaaaaaatgttaacagattattagaaatataaatacattttattattctagcattatgatgatgcgaggtatgcttttaataaaatagcattgtttattaagcacattttatccattattcataattgaacagagattgcttgaaaacacctggaagcaatttgccttctctatcaacattttacttccagaaaggttatttacttcctaatttggtttcaaatttagtttggttctcaattgttcataattaataactatttataaatcctgaacatttacaccactgatgataaataatacttattatacattttacaaaattatcactttttttctatttttttgggggggacttttttttttctgacacagagtgttgctctgtggcccaggctggagtgcagtggtgtaatctcagttcactacaacctatgcctcccgagttcaagagattctcttgcatcagcctcccgagtatctgggattacaggtgcatgccaccacgcccagctaatttttgtattttcagtagagacgggtttcaccatgttggccaggctggtcttgaactcctggtctcaaccgatccgccaatctcggcctcccagagtgttcggattacaggcgtgagccactgcacctggcccctatgttgttcttatatactaggatccatactggctatctttttatttaatctttctgctttataaaactatgtagtataagattttgtcttgcccaaagaaaggtattgcctttgtattcagcttctgggaggtgtccatgttatacgtgatacaagtgtctttgcttaggttgggaactggtcacacccaacaatcttaggttgtagcacagacatgccagaagaaccatccatgtgatttagggaggaggctttgggtcagaccatatcagttgacctgagttcaaccacggggtaatcgatcaatcaatcatacctatataatggacctttaaagaaatatctgaacacagaggcttgaataagttttacttgttggcaatactctgcgcatattgtcacaaatcagtgctcggaaggtaatgcccatcctgcttccaccagaaaaaggatggaagcctcacactcggaaccctaccaagctctgccctatatgactcttcctttggctgattttagtctgtattcttccctacaataatctgtaactttaagtacagttgctttcaatgaattctgagtccttctaacaagttatcaaacctaacagtgaccttcaggactgcaattggtgtcaggagtgaagacagtctgcaaaggattgtgtcctcaagctttgcagctggactaactcctgggcagaagtgcttggatgacaaattaactaaaaggcaaacatgcacacatacaaacacacacacacacacacacacacacactcaaaacactcaaatacataaacacagaaactcagtccacacataaaaatgaacatcaacagaccaaaccgtagattaataaatatattttaataacttactgtcagtgccacgttacttcctctcatgcctcttgcactataaatggattttaatagtcaattcaagtgttgatgcaaaacagccttaaatataagagcaaaacacccttaagtataaagcttctaaaattgaaaatattaaatcattaattgtttgtcttgatgaaaaggtaataacatagggtagtggaaatgcaattaaatataattccttatactgtgttccttttttaaaacacaaaggatagctcctttaatcagttttctgaagacatcattttcagaccttgctcattactttatccacaagtatcattcttgtggatacacccatattggtcaataccaatattaaaataaaaaatttggaattctgaattctaagtttatcttgtttagtacagagtaaaatcatacatctaaaatttaatgagtaaaatagcatttctctgatcagagatggcgataaatattttatgaaaaggatttgaggcatcaaaaaacaatttaagtaaaacaaaacaaaaattatttctatttaccttaattccattttgttatactaaattactattactggctatcacatcaatgtccattagaaccaattagggagttttttgattttcagatcctaattcatgctatcccaaattgatagactgggcagaatcctgagtttctgcattttaacaagctcctagatagtactgttgcagaccaaagtttaagaactactgataatataaattaaaggttgaaagactggacctagcacactgctttgtgttaaataaatatggcagaatttaaattaattacattttaggaagttaatgaattacaatttctaaattaatttgtcatttttgacaggtaatcaatgtgtttaaactatttcataaccattgctttttttttgactatacattttgctgaatccattataagaaaataagtcttgccagttgttctgaatgttttaatgtttcatttgataatatttatatcaaagtattttcagcagaaacttcttcaatatacttttataaatatgaaaaatcagttcacacacttaaaataaggaaaagattagtataagaaaattatcaaatgtttgtaatacaataataaacatttatattcatttctttaatataaaattatttcttattcgtctaacaggataaaaatatttagaattaaagcaagttaaacaacaaatttcttaaattctgtatattatataatatattttgtgtaaaggtgacatgtttaattcagttggttgaaaaaaatgaagaccgcatttcattttttacatttaaaaaaaagcactggtctatatccagtggtctatatccatccagtgtctactcacttctaagcctgtggtcataaaaggaggaaaatggtaagtttatgttaagagttttgtaaagtccttaagcagcatcctgggagatatgagataagtgccactatttttataggttttaggaaaagctttttattgtctaagttttgccattgctttcaaagagcactaaatttctgctgataggaaattaaattcttacatacttgaattatctttctaaatctctactcaacattgttcgtatccaaaatgccaaggaaaaccagtgaaaggtagactgctgcaggagcaacagggttctgaggtgtcttggaaacccaccagacctaagccttctgggcctctttcctgagggaaccacaaccaagatgtggaatagtgcattggaaatccatggctactccagctatggaagagccagtggttgtgcagagtcctctggggctttggaacactgacgtcgtctcagaaaaaaaatcaagagcccaagcccagaacattgtactctgtaccagatctcagcgtctttttgccattcttgttggtgaaatattcaaaatttggaatgctgagatttctcaaatcaatactgtggagataattagatattgcagagaggactccagccaatattgttgatgaaatggatgacacaacagttgcatcaataggggctcaccagtgatttaatgcagacagtgtcagtggtaaccacactgtggttccttcaaaaacatatgggaaagtgatggccatctgagatcttttcagaacaaaaagagcctagtagcttttaacatcatgcccctcaaggatatgaatgagctttccacacatattctggaagtagccaatgcatatgatactgagcaaatctaacagcaagggagagcacctagcagcaacccaggaatgggtgaagtagggaactttggtgggaatagcttcatgccaggaaatagctttacagtggccaaaaactaggtgttggatttgattaaggtttgcccaaggtttgaaagattgagctttcaggatcttaagaaacagctccaacacatctgtagcctcaataaaggaagctgtgaatttttcttagaatacagggatacatttatcccactgtgaatgatgatcatttaaaatctatagacacaaataactagatttaattgggtattggagatattttccagcaggatctgttttcagaatccattggctacagctgtgtatatatttggccagttgacttctaagaagtaggtctcatgaaagtttcagttggcatccttatgaaattgcctagtcttctgtttttgcttcttgacttttttaagctcaaaggagattgatagagatgtatatactagggcagaatttcccgaagaaattacaaataagcttgttataacatcaggttagatggaagaaaagtgccaccaacagaggtaagcagtattacttaaataacatttgggggtttgttattcttaaaatgtttccttaaaatgagcagtactaaggcccgtggttaaagagctagctaagaaacccactaacccctgcctatttgtgtttcccactttggttatttagcattactgtcagaattgcattttctttcacttttttgttgttactgctgccaaaaatgcatttataggaacataaggttctggagaggtggcctcaaggggcagaggagaggaagaaatgtgactacattttgtaccaaataagtgcattcacatgcttaataaaactgttgtattgtaaaaaaatgcaaaagagaagataaaatgtttgttaaatttatgagtattactaatgaaattctattataatgggaaggaagtagagtgaacaagttttgtgtgtgactgatttcaaaatcatcaacaatcaaaacttctgtagacactttaagtttaaaggccaatggtgattttgttatttgaagacttttgaataatccttattgaatatcatcagaaaaaaaataagaaacaagagtcagacatttagacaaagaaatagatggaagagaaggaaaaaagagttatttttgaagagccctgaagaagaaaagggaaatgaagtgaaatatcatagggcttagaaaataatttatctagaccaggcatggtggctcacacctaaaattccagaactttgggaggccaaggcaggaggattgcttgatcccacgagtttgagactagcctgggcaacatggtgagatccagtctctataaaaacagatgaaaagaaaaaataataatttatctgtctatgaagagtgaggaaaccaagtcaactgtaagaagggtggagctaatgaagctatcttgagaaacctagggttatataaacatacgtattagaggaaagtttagaaatatattatctggacatgtttaataaagctaagtaggctaaataaaggttacataaacttctgtatttaattttaaaactccaatatcaagctcttttgcatttctgaatccagtatgagatccagaagttgaaagccaataagactgagtaacaaaatgagaaaagctcgtggaaagtctgatactcgtacaaaattctttttagtatagctattctttgcaaaataaaaataattaaaatcatttttcaaacctctcagagaattttaaagtttatgttgccaattgtgaatactaaatgaacactaattatccactacccatcattattaactaaatatgtgtatgattttatttatataatcttaattagtgggtcaacttttatcttattcaaggtacttacaaattggacaaggaatttgatgccttcatttctaaccttaatttcccttgctctgtttttcctatataatgttaagttgttcaactacaaattgttctatcataagaaatctcaggaacctacccttcccagtaggaaacaatccactgttcactaaattacttgtcaataaaatgataaagtgaaatagaaatgcagaatggaatacagtagatgaaaaatattatctctggcatacactggctattattatttttattcaccaatcaatagtgttgacttttttagtcaaatttaaaatacagcaccttaaaatacgatttaagtataaattgtggaatcagaaggcaaaaattctactgttgtcacagcaggtaaaaaaaaaagctgtaaagcaatgcagtccacctattttacaatataatgctaaaaaatgtaattaaggtaataaatttaaaaaaaaatctttttttccaattcttgagatcataagcactagcaaaaaagcagtatttgcagacactattgattggtttttaaattaaggtcaagtgtttggaaaggtattgcaaaactagattcatcattactagcccaaataggcacaaaattactagattctaaatgaagtgcaatatctcaaaaagaaaatatattttttgcactgtaattgaagagtagaaaaaattttcccctgatattcctctttgcaatttattgatagatgtatttgcagtgaggtaaacttactgtcataagtataactgaataaacatgaatccatcattatttaaatatttaaagtattgactaagaaagaagggggctgtaaggaaacaagggcagccatatcttccctcgtctgacagcttggaaaccaaaaagaaggcactcctccacccccttttctctggattatctttgtgggtatcaaacttcattctgaaattttgaatcatcctgactaatatttcaattgatgaagaaatagcctggaagggcacacatacctaacaaattaggacatgtaagatcatctgctctgtctaccttcacacatgtctaaggggttggctttcacaagaatgatacatgctcattagatgtaacacatagtatttaattatggtgaagtttgaagtgaatcacctggattgaaataccagcattgtcctttgatagctgcacacattttacaagtcatttaccctttacaacttttagttatcttgcctaaaaaaaactgcaattatatgtataaaaataaaaatattatagctaaaaagttacatgaatattagtggttgccatttatctgatacttactatatgccagatatatttaattctcacaacactgtgagttagacataattatatctatttaatacacaaggaatttaaagggtagaaagcctgacttcaaagcatgtaactgctctaaggataataatagctttcttgcttaggttccagacagctgtgagtatatatatatatttatatatatatatatacacacacatatatatgtatatatatatttatatatatatatttatatataaatatatatttatatatatacacatataaatatatatacatataaatatatatataaatatatatatgtataacaggttgcaagaactttgtaagttaaattgctaactgtgcattgttggctattatatcatgatatttaaatataagaggaagtttaactcccaaatttataagcaaatggcatagaatgattataaagttttaggatccaatataaaacaaaagtttttgagatcttttaggcctttgtaatccataagttcaaatattaggtatagggcagttaagtaaattgcctaaggttgcagcagacctgggaagagaactgaatagcttagattcataatcgtggtgttttagcatgcaaaggaagctacactttgaatatttgacttttcagagataatgttccttcaagtatcaacatagagaagaaaataataccatttaaaacctaagtaattctttgattattaaagtaagcatagtttgattctaaaactaagaaaactacatattatttcaatatgacacacaaagaaaataggttagcttatcaaagtattttaggtgagaaaaaaatactacatcatcagcccaagatgtggacagaacataaaatactcagacttcgaacactaaactaggggaggaaacagtggaactacagtcaggaagtcaattgcattatatcacagcaagtaaattgtctcttttaacctgtcaaatcaggaacaagatggaaaaaatttcaagccatttatgcagccaggttaggaatacaaaatataagcaaattttaaaaagaaaaggaatatgacgtacaaatatagacaagaaatccagctgaataaaaaaaaatcacaattgaaggaatggaagaaaattttacataagtgctctgtgaaataggatatcttaataagaaattgagttctgtaaaataggtgttcataaacgaggagttaaagcaacaaaacaggatgaaaagaaacactaagcactatgaaaacaattcgaggaccaaaacaaccaagaagataaattagaaacaaaagggaacaaaacttatgtggctgaaagttgttactaacatggtagaaagatttgatgtaaccaggatacatgcatataggaaaagaaagagacttttcaaataagaaaggaactaataaatggagaaatcaaacactattcaatacaaaaataaagtattcctgaggtagtgacctgaacaaatgaaactgcaaactacacaaaatgtaattttttttcttaaaataaagaatccacattaccccaagagaaaaacaaaatgatgtataatactcaacactggtacatatcctggttaggttactgaaatgcaaggttataagacatagttcttcagcaattcacacggacagaataaattgcctgggagaagtattggtagcagcagtggtggtatatacattctagacattttcacagcaataatcaatggagtggggagggagagggagagcacaggcaagagagatctccagccaaaatgttgctaagctatgaaagcaagaattaagattctcaactacatatttttaaaggcaaaatatattgtatctgttatctccaggttgtggagtgggggcaactgaattgaagatgctgggaatggagaggtgctgagtaaacaggactggtgggcactaaattaatgtaatgcaaatattagactaacactaaatttaaaaaataataattataaaacaatgtaaatttcataaaccttcccaatgtaaaactagtaacaaaacttacaaaaacaaggatagaaaatcagattgaataaagaataagaaggcttaaattcatgaatatggtctgaagtcctatatactgttaaaaatatataatggtttatgtgtcttaatttttctcataatttctttttttaagtttagagaaatggtttaggacaaaatatctgttgtgggaaataaatattcctgatggattaagaaattcaataacttatctcttacattaaaaatttttaggccaggcacagtggctcacgcctgtaatcccagcactttgggaggccaaggtgggtggatcacctgaggtcaggagttcaagaccagcctgaccaatatggcaaaaccctgtctctaataaacagaaaaaaaattagccaggcattgtggtgcatgtctgtaatcccagctacttgggaggctgaggtaggagaattgcttgaacccaggaggtggaggttgcagtgagtcgagattacaccgttgcactccagcctaggcaacagagcaagactctatctaaaaaaaaaaatttaatttatttatacttgaatttaacatatttgataaattaatgatatttttagataaatatatgcattttgtgtaagtctgtcttagctttgttgaggtataattgacaaaaaataaactacacatatgtaagtgtgtaatttgataattactgacatatactttgacaaacctgtgaagctatcaccacaattaagttagagaacatgtccatcaaccccaagtttcttcatgctccttggtaatccattcctttcaatccttcctcctcaccttgtccccagacaagaaatgatctactctctctcaccgtacattagtttgcattttctagaattaatgcaacttgaatcagaccatatgtacttttctaaaaaaagctggcttcttccatgaagaataactattttgagattcatatgtgttgttgcgtgtgtccatgattgaagtttgtttccttcatctatttgtggacatttgagttgttgccagcttttgactatcacaaccaaagatgctatgtacctttgtgtgtaagttgttaagtagacttatggcttcatttttcactggtaaatacctagatgtggattataataagtgaatgtttaattccaaaacaaaatgaaaaaaaaaacctaccacactgtttgccacaatggtttgtacccttttacattcttcaacagcagagcatgttaagttccatcgcctattcataccctccaggacttagtatggctagtctttttaatatcagccatcctaataagcgggtagtggtatctcactgtggtttgaattgcatttctctgatgagtaataatgttgagtactcattctggtgattatttgccatccatatatcttctctgatgaagtgtctatattgctcattttttttataattttctcatcactgagttttgaaaattctttacatattctaaatttgcaaatattttattccaaaccatggcttgtcttttcattcttttatcagtatctttcaaacagcagaagtttatggcatttattctgtagtgtctaatttattatttatttcttttgtggattgcattttgggtgctacatttaagaaattatgaaatcataaagcttatagaagaaaatatttgtgacctcagattaagcaaagatttcttagatacaatgcccaaaacagaatttataaaagaaatgataaattagactgtatcaaaattaaaaataaaacaacttctgttgaaagacacttagaagaatgaaaatacaagctacagactgtgagaaaacatttgcaaagtatacatttaatgaaagatatatattcagaatatgtaaaggtgtttcagaactgcataatgaaacaatggcttaaaaatagataaaatttgaattgacacttaaccaataaagatatatggataactaataattacacggaagatactcaacattattagtcatcagagaaatacaaattaatgataaattttgtgtcaacttttgtatatagatcaataggtggaccaaagttcactttttggtgtatggaaatccaactgttattgtataatttgtttaaaacactatcctttctcagctaaattgccttagcattttttgtaataaccatatatatccacatatatatgggtttatttatggatctctattctgttccattaatctaagtccatctattccaagaccacattctatttttgcaataagccatcagatagtgttagtcacccaactttgttgttcctttccaaattactctggccatagttgttcccttatatttccatctaaattttagaattaacttgtcaacttttgccacaccaaaatccaaaaacacaaagaaaacttctagaatttcaaatgagcttgttttgaaaatatagattcaattgaggagtattaaaaacaatattgaatatcacaatttgcgaataactcatatctctccatttatttaggtctttgttaatgtttttctctcagcagtattttatagcttttagtgtgcaggtctttcacatcttttcacagatttttccctgacaatcatacagcatcacattttaaatgtttttaaaatggtattctttcctaattctaaattctgtttattctttggtcatatatagaagataaacagaagatatggggtgaattacaattaatttttgtatattgatatcttattctgcaaccttgttgaactcatttattagctctagtatcttttgtagattccattgtattatttacatagatgataagatcatctgtgaataaagacagtttatttctttgcaatattgatgcgatttatgttttttccttgtcttattgtaatagctagaacctctagtaggttaatgaatagaaataataagggaagacatccttgccttttcctaacttagatgaaagcattcagtcttttatcatagaatatgatgttaactaggattttggtatttagttttatcaggcttagcaagttcccttctatgtctagttatctaagaggtttttgttgttgtttttgttctccaggaactgttgttggatttcaacaaattttgggggcacttattgaaagaagcatacggatttttttcttcagtttattaacatgatgaattatattgcttaactgttgagtgttaaaccaacttcatattctcagcataaactctgcatcatcataatgtattatcatttttatatattgcttgattcagttactaaagttttgtttagaattttcatgtccatgttcatgaaggattttggttggtagggatttttttacattcttgtatggttatttacttttttatatatctgaataatgttggcataattgaatgatttgggaagtactctctacactttggttttctgaaaaaatgtgtataatatgacctaattttgatattaaaattttatacagttatttttctatttttcatctccctatatgtatattgataccaatctaatgctattgatactaactgctgggtggtaagaattatgatgctttgtctatatttttatttgtatacttaaacattgattgtatgttttataagccacgtgtagtatttttaaaactatgcaaatctattgttaaaatttttttaaaaattaacaactgtattataatattctgcaattataaatggatgctgtcggcactttaagctgattgtcagaggattacacttttcagaatgttttctgagaaccactagtttatctggagtcctatgttgtggtcatcagtaaacatggttgttcctggaacataacagtaagttcaactatttcacctctgtttaccaatttgaaatgtatgattaggaattgttttcaaaaaaattttgttaataataattattttatttcaagtgttgagcatacattgcaaggactattatggtcagttaatctcaggtatctttcagctgtcaagatgcaattcattttgtctcatgttgttttcagaatcttgtggtattaatgtttacagtagctaaatttgaaataacgttgtctccatttcacaaaaacagatgtaaaagtggttcactacaacatatattaaaaatattataattataattatataattaaaattatatttataattatattatatgtatatgttttaattataattataattttaaaatatataaaatatcattaataacataaagagtgaacagaattccagtttgaatataaaatgtgaatttgtgagcacccagtcaactattatatcatatcagataacttaaataatataaatcaagtgtacaataagaaaaggaaaatgcctttaatcctccatattagggaagctgatgatgtctattatttagttctttctcagcattgacttgtttggagtaccagctgatgaggaaatggacattgaacttttattttctattattttttaagctataagaattccatttaaaatttgcttttttcctttaaaaggcaagatgcaaactgatctttaaacagagttcctgtgtcataaaataaccccctaggtctctcattttagctaggtagatgtaaaacagaaaagtatgcattattctcggagaatagtattaacagactattattgtcctggagcaggctggagacttagataaactttttgaaagctaatttaagcaatgttctttctcattgcaactcattacctccacaaatttatgtacataccaagaaactttaagaatatttcgttttaaaagttccaagttccaggtaactgataaactgtggtaacatccatggaggatacattgaggacttcatatggaatttgtatcatataagagtgataatctggtcttgtggtttaatctccacttctgggtcaagatttttagagaaatgatggactaatgaacagagatacctgatggtgaataatgttatgtattgaacaagcagagtaataaatatcaaatacaaatgcttaaggaaaaaaatccaaacattcagtcataaattgctgccctacaatttttcacattgattctacttaatgaattgaagtttgagatttcatgttgggtgtccaccatggcttgatatgtttgctgtagggtttcatgcatctggtaagtgaaggtaacaagaacgagtctgattgttggaaagtgctcaccatacacctactcataaaggctattttagtatacattaaaattttaccgtatctccttaggtgtgagatgaacacagataactaaatgaagacaccgtgaacatgaccttgctactttgagaagtaaggaataaaactttacgtagcctgtttagaatgtaacaatgattagagaaggtcaatttgtttttcctccaagattagaaaattaaagaagataggtaggaaaattaaatacagtgcaaaagtactgatacttttcaatgatcacccaatcatttctcttgtccctcaattatctgtttactgatataaatgtgtatcagattgttttgcctctcatgtaagcgatactcattttaatgccatgagttgtttcctttgctagaattatattaaatttgagtggaacaaattctaaaatactcaagtatattcatttccaattatgatctaagaaaataaaatgagcacagagtgtatcgtaatgataaaaattattttggaaagcatgcaatttccaaatgcatttgtttcatttgtgacctttatttgtttctacaattctacttttgagtttactaagcatcaaatggtaaccagtagtgaactactggataaccatgagtttgaatattccataatggataaatatatactgagtctcattctatatataaattatgtggaccaggggacctatgttttagaaatgtgtatgttagagaaacaaaaaacgtttcagaggtcctccgagtaaatatgaagaagggcaaagatactatgagaaaaacaaaagcataaagggtaaatacaatttcaaagctaaaggtggataaaacgattcctaacaggtagtgttggcagaacaagccaatgcctaatgttattgttctcctaattggctcatacaagcagctaaacaatatatctggcataaggcagtaagtctttgaaaccaaatattccctggaccaccttgctaaataagctgcaatttctaagactgatatcccttggtttctacagttaagaagcatgatatattttacatttctgcccagcaaagctattttagacagacttaaatatttaaatcctttatgggatttgacagaatgggatgaaatggcactgctctagaaattttggccccagttctgtcactaatcaggtgtgtgatttagttaagtcacttaaacttttaagctataacgtcattgtctataaaatatctgccctggaagtacagttaaaataatgtgcttggaggggtttttaaaaattaaaatgctttatacatataattaacaatcattctatcagatctcacactccagtatttttatttatttttgcaataatatttatgctatttaaaaataggtaaggtccttatttaaaaaattcattcaaatgtttatttctccctgagcacatcttagctgttcaatcattaaatcttactcagcaaattaagtgattatcctttctttctatttttaaaataagagcatggaagtacaagaaaatattcccattgcccaactcataaataaaataatgtgtatttgttcctagtgagtatcaccaggtttacgatatttaattaagcagtgcaatgtaatgtagcactcattcgatagataaataaaatggtacagtatagcactccaaatagtcctatagtttagttcacattttccacataaatcaagttggtactacaataagttttttgcttatatataaatttattctactctctggaataaacattaaagcaataatacatgatagaaatactcaaatacagtgattagatgttctaaaaaagttagccaatttaatatgctatagtttctcctaagataactattatgagaataaaacataaatgcagctgatttcaatttgacaactctttgcaaatcagattacctgaaacttttttacctcattacctaattatggaatcctgacatgctatctggcctagccctctggttcccaattattaaaatttaatcagtatccacttttctctaaccaagcacatttaagttctatcagcaatacaaactcaaaggggaaaaaggcagatctatagcaactaggatgtgagaattacttttttatggtcaatgtgacacaatgaatgaacactatgtatacaacactaaattgtcattctgtcttctcccagtgaggcagtgcatttaatttcctcaattggacatacttactgaatcagattagatgtaggtaagaattttgaacttttagtttctcagggaaagagggcagcagcaggaagagacagacaacactttagcattccgtaacttgatccctacacaccccttgcgtccgagctgtgccttttctatctttaattttcattctacaaatgatcagcctatctctgtcatccatatacatcatgctatttctagccctctgaatcttcatgcatgctggtttctctgtcccttacccccctttcccaacctattaagtctgatcatctttcaaaactcaatttagacaacaccttacggaagagttctgattactccttctactatgtaggattgaatcttcctccattaatgatcttgtaacatcaagtccctgtggcatctttgcctttactgactggcatggaaatgatccatgtatatttctgacttcctggacagttggaaattgtgtaaggatagaaattagatcataataatctttggatcctcagcacttagtccaattgctggcatgcaaatagtcaatagatgctttttgaactgatccaaagaaatcttagagataatctaagtgctagcttaaaggtaatcagataaggatttaagatcttaggaaaaaaatagatataaaaaaataacataaaattctaatttattaaagctgaatgtatacactctgacgtaaaatattagtggacttacctggttaacatatgggtaccttattcacctttctgacatattccaataaagtaatcatttttttctttaattatgcctattataaaactgattatttaaattcataactatatctttatttcccagttttgtctcctaccccactttaaatatttggtgggaacatttaggggagtcattaacacaatgcaaaacacataaattttgcattgtattgttgactcgcctaagtgtccccacaaaatgtcattaattttttgcattgcattaatgacatgggtaagtgtccccacctatgtaattaacacaatgtgaaatttaagtttttctagtcattgaatataaacaattgcatagaaatgtcttcatctaactcattcagtgctttgaatgtctagcttccttttgttaaccaactaaatactgtattaattaaacttggtacctcattataattaaataaatataagtcatggacagatggacatgaattaattagatcagatttattttccattaatatccatttgcagtaagagaatggcgttttattttgttaactcatacttcacattatgtttatgtacagagagtatttaaggttaatgattagaagtttactttggagaataaagaaagtagataactttttagcatcatagggaaaagtgaatttggagctgggcaaagataatcagaagaaaagtagaacaattgcaaacaaacatacaaacaaacacacaaaaactcactctactgtggaattagagctcggagaaaaaaaatgacttcccacatagcatgaaattagaactatgaccttggaataacattgttcttactacaattcatgaacattacataaatctgtggttggccgtaagaatgtacataccattcatcacattattttctatgtgaatgcatgttcttaaatttaaaatttaaataaatgccttataagtgaacttttataagataatctaatgaatctcttttctgctcatatgttgagaagcaaaagtaacaagttcagttgggtggttctgttgaacctataaattctacccatagaatgtttcatcaaaacatgtttcaaagcagtacactgggagttctagaaataaatttttcataaattccactaactgtatatgtagagtctattagtttcacactctagcatatattttttaatttatttaatgacatgttgacaaaaaatgacactgttaaatgcatatttgtaataggctgcttcttatatatacaggttattttttacagtttatttctgatactatataacaattaggacaatctacattaagagatccaaaggaaagtagagaatatcagcatgtagatagctctgatatcccccatggaaaacaataatatacttcataggtcatgtaaaagtagaaataatgaaatcgtatacattttttctcaggttctctctttgctgtttttcttaatttcagtcttcaccagcaaagaagaaacataatgtcaaagtgttcagttgagtatgtgctattgtcatcagcaccttcctgaattgtgtcatcgttagcttttaggcatttacatttttttacattaagattttgatgatttcctcaatctccatgtatgtcaggactatattaattaaaatagtgtatgatgacaagatcagagaaaaaaatgcaaaagtgaattaatttaaaaatcaaagattggtataaaggatagagattcactcatatgtctcctgaaaaatctcttctctataaactgaatatacttgtttgcataaaatgatttgacttgtctgtaaaatagtcagttgaatcaacctccatgatgcaaatggtaaatcagttcaaacatacacttcaggtgctgcattctcagagtgaacattttccactgatttattatatcatttagtaattttttattaatagttcattttcaaataccaatttagtgtcaactactgaactgtctataacagaaaatacaaagataaatcaatcaccactttagctttaacaaacttaataagcttagttcctaggttaggaaagtaacatagaaggcttaaataaacacaaaaccaaataaaaatacatgtacatttggagagtgacttaaagtttaaaccaaatagtgcatataaagcacttactatagtgtttagcataaagtgagtgttccacaaatactgttttcattgttactgatgttatgtttgttaacctgggtgtagaagcaggaggtcatatttcagtgggaagtttcagtacagatatcttgacagagttggcatgtacaagcatacctctgagatactgcagttcatttccagagcactgcaataagcaaatattgcagaagagcaagccacgaatttttttggtttccctgtgcatataaaaattacatttacactatactgcagtctatacagcattgagtctaaaaaaacaatgtacgtgccttaatttaaaaataccctaaggcaaaaaaatgctaatgatcatctaagccttcatcgagttgtactctttttgctgaagtgtcttgccttgatgttgatggttgctgactgatcaggatggtggttgttaaccaccaccggcctgtggcgatttcttaaaataagaaaacaatgaagtttgctgcatcaatgaactcatcttttcattcaggattctctgaagcatgtctggtgtttgatagcattttacccatggtagaacttccttcaaattggagtcaatcctttgaaaccctaccactgcttaatcaacgaagtttgtaatattgtaaatcttttgttgtcatttcaacaatgtttatagcatcttcattagcagtagattccatttcaagaaaccactttctttgcttatccacaagaagcaactcttcatccactgaagttctttcgtgagattgcagcaattcagtcacatcctcgggctctatcttctaattctagttctcttgctatttccagtatttctgtagttattttctccactggaatcttgaatccctcctccataagggttgaaatcaacttcttccaaacacctattaatgtttatattttgacctcctcttatgaattatgaatgttcttaatgacatctagaatggtgaattctttccaggtttttaatttattttgcccagattcatcagaagatccactacctatgatagttataaccttataaaatgtattacttaaataataagacttaaagtcaaaatcactcctggattcatgggctgcggaatggatgttgtgttattaggtatgaaaacattaatttccttgtatatatatatatatatatatctcctttttttttttgacagagtgttgctctttttgcccaggctggagtatggagtacaatggtatgatctcagctcactgcacctccgcctcctgggttcaagtcattgtcctgcctcagccacccaagtacctgggattacaggcctgcaccaccacgcctagctaattttgtgtttttagtatagatggggtttcaccatgttggccaggctggtcttgaactcctgacctcaggtgatctgcccaccttgtcctcccaaagtgttgagattacaggcttgagccactgcccccggccctccttgtatatctttatcagagttattgagtgaccaggtgcattgtcagtgagcagtaatattttgaacagtaagtctcatcagtgggcttaaaatattccataaactatgctgtaaatagatgtgctgccatccaagctttgttgttgcatttatgaagcacaggcagagtagatttagcatgattcttaaaggcccttggatttttgaaatggcaaatgagcattggcttcaacttaaatgcaccagctacattagcccctaacaagcgattcagcctatcctttgaagttttgaagccagtcattgatttctgtcctgctatgaaaatcctactgacattttctttcaatagaaggctgttttgtctacattgaaaatctgttgtttagggctagccaccttcactaatgattttagctaagtcttccagataacttgctgcagtttctacatcaggactcgctgcttcaccttgcactttttatgttatggagatggcttcttaccttaaacctcatgaaccaacatgtgttagcttcaaactgttcttctgcagtttcttcacctctctcagccttcatagaattgaagagaatttaggttcttgttctcaagtaagctttggtttaatgcaatgttgtggcaggtttgatcttctatccagaccactaaaaccttctccatatcagaaataaagcattttgctttcttatcatctggtgttcactggagtagcacttttagtttccttcaagaattttcctttgcatccacaacttggataactggtgcaaaaggcctagctttcaccctctcagcttttgacatgcattccacactaagcttaatcatttttagcttttgatttaacaagagagatgtaagactcttcctttcacttgaacacttagaagacattatagggttattaactggcctaattgtaatattgttgtgtctcagtgaatagggagacccaaggaggagaggaagaaagacatgagaacagccagtcagtaaagcagtcagaacacaatatttaacagttaagtttgctatcttttatgggtgtggttcatggcacctcaaaacaattaaaataataatgtctaagatcactgctcacagatcaccattacagatataataataataaaaaagtttgaaatattgcaagaattaccaaaatgtgacatggagacataaagtgagcacatgctgttaaaaaaaaaaaaaatggcaccatagacttgctggaaacgaaccttcaatttataaaaaacacagtatgtgaaaggtcaaagaagtaaaggacaataaaacaaaatattcctaactatcttcaggtaaaaaaaaaaaggaaggagaaatgtaaatcaaatagacatgaacaaaaaggtggcaatatgaaaacatggggaagtgaaaactgagctatctatggctgcaatggagagtaggtgtggaaaagtcatgactgggaaggcttgaggccaattaagttgtgccaataatccaaggctaaaggatttgcaattcattcataagaggatgagaatcacagaatcccaagaaaagagaatatccaaaaatgaagtcaggactcaagaaagggtaagcaagacccaaggagtgtctgaactaggactttggaagtgaaaacaagaatgtaacatatgcttccaaataagaagtctgagaaagatactgataaaattagagaggagaaaaaataaacccccaaaatgcagaattacagaaatctaaggagcccagatgtaaaaaacaaaaacaaagaatgaaataagaatttggagagttataatgatcaagcaaaaggtaaaccatttggaagtagttacccagactaaccattaaggtggcaccagtaaagcattactttactggtaatgcttgtctgtttatttggtagagacataactatgttattagaatacaggcaaaaatatatttaaaaattttaaaacttatttctttaattgtatttttttacaagtatctaggttgaaagagtctgcaagctgtcctgtggattccatctcttttagttgattcaattgccaactcagttacaatatttgcatggtttttaatggcttagccatttaaaaaatggtgagtaggtatgcattcttcataggattgctctgaagagtaacagtaagtccttcataacatgaggtccaaattacattaaatcattaatagcacttcaaatattttcccaaataatgtagtatcagttattatattacatccttaagtctgctaggtttttaagattaacaaagaaaactagctgagatcatttctttatcattcacaatttgttctttatgtttcactttgtatagtcaacataaagttataactttatatgaaaagtatttccaaatatacacttaaaaaataaatgcactgaaaaagctatgatcatatgaatttccgtgactcactctgaatatgcatatatgaggaaacagctcaaaaccatcattattactctactaatttgaaacctatgatgatgcaacttggacacagcttttggaactgtgaaaatgttttaccaaacaaattcataatgaatataactaacatgagtatgttttaaagcaaagtttattatttattgtaaatatatattcataatcaaaaaattaaatgaaattaatagtctaaactctgttttctttgttaatccacctcgtatagatccaagttaacaggaaattatggagcgtttatgcaactcacctgcaaaagcctctaaaacatttgctcaaaatatttttatatctcttattcgtagtcatttttattatttttttccatattctatcttattttctgttttgttgtgtttccagcttgcaaaatacttgcattttatgtgtaacctcctttcctatttaggaaaagtatatgatattgcatatctatttatgtctctatttctcttggtttccatttgtgtttatctagtctgattgacttttatcaaggtgctttatccttgaaattgacttttcaagcttatcaaaggaaaacattttcctgacttcatgctcctttgctgtccatagagacaggttttattttagatctagaaagggaagcattgctccataagggcctctgacccagagggtcaaaaagaattcatcaaggcccacattgaaaaaaaaaaaaaagaagaagaaaatttaaatctagttttatttttgtactgtctttagtgagagatataaaatattccactgaatgatatttaaactgagtaggaaatacatacaataagaaataaaatacattccaattctatattatgtccagctacaaagagatagagccataaaaagggaaatgagaagagtcgaggaacaaagtatgacacagtctgaggatttaaccaaccctgaaatcagagcaggaacatttatataaatatacgcaatcttcaacattcagggggaaaaaatacaagaaaatattcacatgatttcttaagaaaattgttttaaaattccacataaagctgaaaaatacagattaaaaaaaattgccctcatttattagacagataggccctatcttcctgctctagtgagtgaaaaatatatgttctcaaatttcagagatcccatataaatctatgctaccatcttgtgttctaaatattgcttctaatgatctaaaacacattgcaagaaatgaaactaacatgatgtcaaacccttaagaggagtccatgcaaaatgtctgtttgcttagatatttttattttatcactatgctgaattttagacttaatatttctggtatttattgctctctgttctttttcccagtgcattctgcctgttttatcttcgatagtccttcctacagacacaagagcactagtacatgcagaaacatatatactcacacactataaagagaagtaaaaagtgtactgttttaaagtccaaattgaccctatgttgtggaaatatcataatttttttttctggggtaattgactttttttttccccccgttcttttttttaaagaaacgcctttattagtccattagattgtgacaggagtctaaacaggagaacattaccaggaaaaaactaaattgctatacatgataagtaggatgtttatgagttgtgccttctgctagtggcttagcactaaggataaagagaagtaaagatctcactcagatgggaattaacaaaaggcttaccaaagaaaagttgcttctgcagaaaaaggctaatgatggctatctgggaacactgataattcattcagagtatctctttcttttacttcccctcctcttagcttctagaaatcttcaataatctgttctgcctcttggccttagattaaaactgctttgaaaaaattataaaaagattatgtctaataaatgaagtaatgtgaggggaaaattataattgctaaaggatgatagcaaagtagatactgagaacacaggaagaattcaaagcaagagattcacaggagacttggagtttccagaaattctcagaaatattaggaaggcaggccaagcaacttcccaaactgtaaggctcaagccattttactgaaaaaaaaaaaaaaaaaaaaaaaaaaaaagtctccattgagagaatcaaaacaaagtgggaaaatagggggaaatccttctacacattcacatctatacctattgatgctgttgaactcaaatgtaaaaacacacaccagacacatatggctgtcaggacaaaacataattagcgtacaccgtccgtcctctgtgttcacatggcacctctgaaacctaccttaaaagtctttgtctgcttctacattagattataatctttctagtatacagattacctttaattcttacttgaatttcccttcatctagcagagaaatttattgactgaattaacatttattgaatgaattaattgaagtaaatatttattgactgaattcctcacagctttcaaatttgaatactgattaaagtcaaaaaatatgaaaaatagtttcattaccttgaaaagaatgaagcattaaaaagtaaccatcactaagccaagaatgaaaacaatgccgatgtcttgagtataatgtaggaagaatcatcataattttgacaaaattaaaggaatacgtaagtacacaaaacaataataatgagatacagaggatacactataagcagatgttcttttgtaatctggctttttaaaaagtcagttcattgttatttttgttgttgctgttgttttattaggttggtgcaaaagtaattgtggtttttgacattaaaagtaatggccaaaaccgcaattactttctcaccaacctaataacaacgtgtaaagggatttggaacaatcaacatttcaagtcaaaatattatctacctggtgtaggccgggcgcggtagctcacgcctgtaatcccagcactttggaaggccgaggcgggcggatcacgaggtcaggagatcgagatcatcctgattaacacggtgaaaccgcgtctccactaaaaatacaaaaaaattagccgggcgtggtggcgggcgcctgtagtcccagctactcaggacgctgaggcaggagaatgacgtgaacccgggaggcggagcttgcagtgagccgagattgcaccactccagccggggcgacagagcgagagtccgtctcaaaaaaaaaaaaaaaaaattatctacctggtaaaggagataaaacactttaaaacctcagcatcatatttaaaaggatttgtgtagcattactattgctaaaaggaaaatagtatgcatttatatttgtattaggttcagcgtaattggatgaatgcagaaacttcactttcagtagggtcatacatacattttatagacatattgtgcacaactttacaggtccccactcaaaactaaagctgcgaattcaaggcacagacattttgggatcaagtgtcaacaaagagaatgtaaatgcggatcttcaatctttttccaactatgggaaccgctttatctaacaatgaaaacgcatcagtgttaaggaattctatggatgagctaattaaaataaaaaatatgaaattactggaatctacatttgagaattgtaagatcaagatcagatgtgattcttagtaaatactagaatacatttatttagtcatcaatgtcaaaactctataattatggtcaagctacaatttgggaccaaacatatttcataggatggtacccatcttaagtacaaaaatgaaaaaagatcgggaatgtcttatgtagaattctagagaaaaccaatctgattgtttaaaacaagtgacagatatgttccatcttcactcaaggagcaataggctcaaattacaatcccctaaaagtatgtatgaatgtatgtgtgtgtatggaaagagagaggaagagaggaaagagagagaaaaactgtctgaagctaagaatattcaaaagcagcctaagaaaataatcatattttcccaagactattgaaggaaacctaacacacctactgtggcactgtcacgtgacttattaaaagttactttgtgtgttgccaaagatcaaaatggtcatttcaattcaaatgtttttcaactccagacaaatgtatttgtgtgggctgaacaaattagtttttctcactcgaatgaactaatacatgtaaaacactggaagcaaacctttatgacagtgtactttcaggaagaaaaaaaaaaattagaagctttttaaaaaagacaataaaagaaaaagaaaataatttttaaattaggcatttgacaaaaaatggcttttgagagagaaatatgaatttccaggctactatatttttccattgctttgtaaaatttatcttctttacagataagctgcaaagaatatctacaaagaaacagacatgcagacaaaaataaaataatttaagtcaatttatcaagcattgtgatttttttctttgtatttgtgtaaaagtttggctacatcaagaagaaataatatagtagtatccttcataagttagcagatccacagtctttaaaactaaggaattgtaaaataacatatgtttagatgcatgatatatggatccagtagtgtacctagcaaccatcctcattctaaacagaagctaaccacaaaacaaccaaagggaaagattaaggtaaaattcacaagacatcatcctttataaactttcaaaattttaattcatcgggcactgaaattttgtcattatatatagcaagaattgcttttaataagattgcaaatgcactgcattttctctagatgcaacaaagccaagtatatataattatgtatgcctctagccttcaatctcttattttttattcttgtctttcattataacacatatctgaattattttaacacagataacttgttgcaatgcaattttgtcatccatgcatcctttaattcaagcatgcagtttctaggagatttctgaaacaattaatagagtatggtttctgttacatatgcattattatataaatcagaaaattttgttggtaataacttccatactcgaagattacttagagaccatcatactaagccctttatttgcatagaaaatttgatggtagaaacagacacaagtcacacaattaaaattggcactgctagaatttgaatccagagccagacttagaatcgatactccatatttatagttccttatcatgcccctattccagactgtaaccgtatttatagttatggttaaacctgttttgcattttattatttattattattttactgtcacctaggttgaattgcagtatcaaaaaactgtacgtgtagagttataacttcactgacaacactgtaactgaaaaatataatctaaatcatttgaaaataaaacaattgaatctaaaatatatttttttcgagacagggtttcactctatctcccagactggagtgcagtgacacaataacggctcactgcagccctgacctccacaggctcaggtaagtcttccacctcagcctcccaagtagctggaactgtaggtgtgcatcaccatgcctggctaatttttgtagttttttgcagagatggggtgtttcccgggcttgtctcgaacttctggactcaagcaatctgcccaccttggcctcccaaagtgctgggattacaggtatgagccaccacacccagcccaaataaataaacattgaaaatgaaataaatgaaaaacataaccatatttcaaataattcaccaatgtatgcacttactgatctaggcatttttacagtatgcaattatgtcatgaaggaaagagtttataatctcttatgagagagacagagaaaaaaagaaacaggaaaaatgtctccgtatattaggagttgaagactgaaattgctaagttcagaaaatttttaaaaaggtacagacttagaattttaaaaaattacacatggctggagacttcagggaatagcaggggggaaatgatattggagtaatgtcttgaagattgtaaagagtgggctcataaagattattttaaggatattcatgacatagggaatgaaatgacaaaaagcattgagttcaaatgtgcataagagaataaactgttcaccttgactggaacatgaaatatgatctcacaaagggtagggaatgctatttgccagtttaggataccaaactttgaatcacaggtgatgagtagccatagagaatttccaaatagaacaatgcttgcatttatgcctctgctgtggagtgtggttacccaagccaaaccaatcgcgtctctgtagttaatctctgggtgagagacaaaggggcaagctttttcaggtggactggaaatgagaaccactaagtgaagcaaatacagaaagaactgagttgatagttgagaagatggtaatgtttacattcctggaacccactacactttcctgcctataacagttagacaagaattttccatcaattgcaaccgaaagtattcccactcgtaaaaaaaaaaaaaaaaaaagaaaaagaaagaaagaaaaaagttcatctgacagcaatgcagcaatgttgccaagggaaagagatcaaaggttgtaaaaatagtaggaatctcttgcaggaggtaaaagggtctgacctttgaaaaagcgctggaatggaaaagcagggaagaattcagaggattttggaaaaaagaggcaaccttaaggagtactactaacattgtcaaacactggtctaaatgctttttaggcatcatctaatttaatcctcagaaaaatccatcataacaagatttcttttcatcatggcaaataagaaagtgaatatttagagaaattatgaatacatagcaaagctggaattcaaaccaggtctttaattcagaatacaatatcctaatttgaaatgtatgctagaaaaaggaaagacagaatgactttgctcttgataatagagaggagaggaatctttttggtgaaacagggaattcaagaggagaaaaaaataattaaaaggaattactatacttttaattttagtcacattagattttagaattcatacagaaactaagttattcatacagaaactaagttgacattttgcagtagctgaatatttcagatacaaatttggggaagatctgcttagcaatgacagtttgagtcattatattgccaagcaagagagtatagagtaaggaaacaataggatcaaaatctgatatacagagaagaagaataaatagcagccaaaacaagattgaaaagtaaaaacggaactagcatttacaatatcataaaagacaaagaagaaaaatgcattagcaggaatgagtgttcactcagtaaatatgtcctctgcatgaagataagacagacatagacagatagacaggtggatggatagatgagtagatagggatacatcactgcattcatacatagctctctaaatatctgcatcatctgcctctatatctatgtatatctgtgattgaatgattgattgtaacttagagcttcaagtgagcacttaaagtgaaaactttgtgtactgaaattacttacatcttttaactgagctataaagcactatattcatcattttatgttgtacacaaggcaattatgttgtgtttatgaacatatggcttcaaacactggataaactgttgaaactgatgggcacaaagaaacagaatactcaagaaacatctgatcgcttctgtcatttcatccatatatttcaaggcaaataacttataagaatgaatacttcctgtttcttaaatacatttcagtttcctgcttagctttgaatagtttcctcccttgattaatttagtgtaattatcttcttaaaaagaaatgctactcaagttaaataataatctttttctagaaaaacattttaaaactcgtatttcattgaatgagaaacaatatcaaagaaaacaatacacatattaaatttcaagaaaagtatttgacttctttctttaagaaaatagtttgaattaagaagaaagagtaatttccacctttaaaatgtcttaatggtatataatcaaggagattttattttaatgttataatgcatggtcagtttaagtcctgaggtgtccttttgaagaacctttatttttgcttattataatatttaaggcttcaaggaaatattcatttgccaggagaaaggaactcacaaggtagattgaaatgatttcatggaacagcatgaaatacagctactccctgccaaacccagacacaaagccaaaaggcctatgaaggaagaatacaggcacagcagttcacaaaagatgaatcaaaaggcaagttaaaaaacaaaaatatattggaaacatgctttcttaatatatgaaactataattattattatcaaatgcagaaaaatataagagtaaaagaattgctaagagtttagtttggcagatgaaaagagtaggtgcaattaaaggaataaacattttccctactgtacaagaatttgaccttcttttaaaattctagctctgatcccctgataacctgacaagggaagaatgtcaactataatcttaggtgacatttctacattaaattgcttctggatttgagaggaatgttaatacttaataggaagccatggctttgagcttagtgcagtggctcttgtaactggcatgtctcttcaaggaccctggaaattctgcctatagatttgttacaacagagattttggctcctgtggggctgaggattctgccagagttcccatccccaaattatgtagactttgtctccttgtctatgagtcatcatctaggcagcagttcttaacctggggtgattttgccagtcagggacatttggcaatgtctggagacagtttttattgtcatgacataggggagaaggacatattactggaatctaaagattacaagcctaagtagcctctaaacaccatacaataaacaagctagagcctccttctccaccacaaaaaaaaaaaaaattatattttgggcaagaaaactgtgttggaagactgccatatgtgtttgggacaattagcagtagccatggtctctactctctagatgccaggagcattcattttcctccactgattcaattaaaacatgtttttagacattttcaaagatctgcagggaataggagtggaagggcatgttggcaagctattgtttctgtcttatacccttgtgtatgaatttgataccaaatacgcctctagtagtcccgcaagtttaaaagcagtggaatctaagacccttggtagattattcaatacaggaatttactacaaagtaaagttattagtgtcacataatataacccaacgtaatatgatatatgcaaaaccaaaaaatgtgtggctagtactaaatattaaaatatgatattacatcaaacaattgataataaagatacaattgctaacaacatataagctaaaattctatatgaatactgcctgtaggtggattaaacactctagtaaatgtgtatctcttgctggagggagaggaagttatgtctttctctcaaatactgcctttgatttctcactttcagattggctttatcatgcattaattaaagtactcttttgacaatcaatttcttacattgttgcttaacttctgaagttctttgaatttatttttttctaatcaaagaccaaaaggcatgggtctttgattagaaaaaattaacttaaactctgtaagttaatttgatagcactttatatttcccttagcactaagcatattattgttggtatatttaaaataaattgataatatcacaggaatgttcatatgatatattattgttcacctttatgtgtgatttattataatcatttattattattacctttgtgttacaggggagatgatcatagtatgtgtgaaatgcccaaattctgtatttgggaagaaagaatttaggttttggaagaaagacaaattcctttttaactaagaaagattatgaaggcacagaacttttatagtcatacttatatatttatatatgtgtttatgttcatttttcttagaagaaactatatttgcataaagcaaaaaagggaggaaagaaaaaagcccccaggaacagaggcatgtaaactttttattgaaaatttaactcagtggggcgtagtggttcacaccttcaatcccagcacttgggaaagctgagatgggagggacgcttgaggccaggagtttgaatccaggctgggcaacatagcaagactctgtctcttaaaaaaaatgtaaaaattagcccagcatggtggctcacacctgtaatcccagctacttgggaggttgaggatcgcctgggccaaggagttgaggctatataagctatgattgtgctactgcagtccagcctgggcaacacagagaccctgtctcaaaaaatggaaaaaaaaaacctataaaataaatttaacttaatcacatatgtgaagggtttcaaggggagaaaatatccttacggccttatggtattatggaaatgatataatgatattatccagttgaattcatttttgcacagttggggtggacagaagtacctagctgacaatatcaataaaaatgagtcttgcctggcttaatttgtacctttaatcattctgttaaaactagctggtcactctcccacttctttgcatagatgctgaaaaataaaaattttaatacatacactttatctaaacattaaattatggttgtacttactttaaggtagcagcagagaagaaaccagaaaaataaactatgtgcttattttccttacatgagccacatacttgataaactgatcttcttttcagataatgtatagtcaattgctctatctgaagatattatatattatatatatatatatatgcaatgcactcagtccttaagagactgaaaatttctttctattttcttgaacaatttccttagatggttatttgccccttagttatatatcatgctgtgttctctggaagaatgaaaatatagagagcaaggaaaacgcccagaatgtcaggagcagttcaactaaagtatattcatcctagaaacattctggaaaataatgtttatttgtgggaagctcagttttcaaatattcaagagtaatgtaaatccatggaaagataaagtaagatatatgttgactggaaataataatcctagatcttattttgtacagagtttaaattggacattatcttataatacattgtttctatatacattgtttcttcttttttaagataagatcttaactacagagaagaggtagatgatggaatatgtaaaatagaaatatttatgtaaataagtggtaaaactaagattctatgagtcaaagaaaatcctccaagtcaaagctctcttcgaagtcattatccttatagtggcaatggatatatagtcttaatgcagtcatcaccaaaaacatctggaaaataactttgaacttaccattaatgtttctaatagagtctttggaataatctcaaaggtaagtcctcaaattttgagtataaatttatattatgtgaggaaaccaaaggctgttagaatcaagtcattttggcataagaaataaatccaattagaaaataacagttcagtgtaaatatatacaaccattagaattatttcccaaactatctatatagccaatattacaggatagttctgagaaaggcaatactgaaacaaaacctagtgattttgaaagaaatatatcatctaatgtgtgtcttcaaaatgaagttttactttgaagctctaaattgtcttctacatactaatgctagtgtccatggagctatcaataaagatctttcgtcatcaccaagaggcagtatagagggttgcgacttagctaggacttaaatggcaaaaagattggaagaattgttataaacagaagaggagcataaaagcctagccagagaggcaacattgaattatcatgcttatgggactgagaagagatggactgaattattacagaaaataagaaacagagctggacaagtaaagcttgttcaggctactgagctgaaagtcattattaccctcctaataaattaaaaattcattcattcatttataaaatttttggatagcctttttgcctggcctagatcctcttgtatttcctcttttatcaataattaccttgtctttgatatcagttttagataaatccctggtcacactgatatttccagaacaattttgcttttagaaaatcacaaaattgttatattacctcagtacactaattctatctcaacgctacagaatattacccagtaactcatctaacaatagtgaacatatgtattacagcactttccaatctatcattaattttattttgctttgtcaggttcatgatattatgcttttgttgaatattcatttagattaaaagtaactagcatactctcttcattagatttcttgagaaaaagcctcaaaaataaaaccctgatctctggctctctctccttcacctaatttggtcttgcttgggaaactgaaacaggtgaggaacatgggtttatcaatagccctgattattttctttcataatttttctttgtttggaaaatacaaattataaggggtatattaattagatttggaattaggtaaaaggcagttacttaacacaatctaacactaacatctgtctttggtttttagtatatattttataccgcttaacagaaatatcatgtcattagttgaaggtacaacaaatgtgcatctacatggtggagatttaacagcaaaagtgacattcaatgcaatatattctccagttaattttcaaggaagtatactttgaaatatactcacattactaaaagactttaatagcgctttgagatgaaactaaaggacagcttatattacaaataaaatgttatagtttatcaaattaaaattgtagcatataattttataagtgtaagtatacttatataatacagatataaaaacaatactttcttttaggaagacaataagcatatcctgtatcctgttttgtttttgtttttctttttttttgagatgagtattgctctgtcactcatgcttgagtgcagtggcaaaatctcgggtcactgcaacctctacctcctgggttcaagcaattctcctgactcagccttccgagtagctgggactacaggtgcacaccaccacagccagctaatttttgtatttttaatagagttggggtttcaccatgttggccagaatggtctcaatctcttgacctcgtgatccacccacctcagcctcccagagcgctgggattacaggtgtgagccaccccccgcccacatatcctggtttcttatttaacatatatatttggaaatccaatggaacttttatataattaatattcaaacaatcaggtactttgtttagaaagttgttttagttgttcaggcgcagtgactcacacctgtcaaatcccagcactttgggaggctgaggttggtggatcacctgaggtcaggagttcgagactagcctgaccaaaatggagaaaccccatctctactaaaaatacaaaattagctgggcatggtggcacatgcctgtaatcccagctacttgggaggctgaagtaagagaattgcttgaaccagggaggcggaagttgtggtgagctgggatcacgccactgcaccccagcctgggcaacaagaatgaaactccatctcagaaaaaaaaagagaaaaaagaaagttgtttcagttttgttcagtaagctctatacatactatgatttttaaatactatgaataaattaatatatgtaatatctttattttcaattatgctattctaatgctgcttcaaataaaaatgagccaaatattcaaaaaaattgtattatcattccaaaaaatgggaataaattaaacaatggacaaaattttttaatgttattaaaacattacattgtactttgcagttttacccagaaaaaccttttaagtttaattttaaaatacttttgtttcaaaacacttatattttcaacttcatactctggtccataatctgtgtggtaactggcaattgtagaagttaaaagtcataaagaaaaagccttttgttttctaaaaattagcaatgtgaacaagaattaatcaaactatttcattgtagtgactatgttactcttaacaggatatagaatggtctaaaatatctctaggcttctgtccctcattatgtacaaattttaacaagaggcattaattagtgagagtaagtaattcaaaaagtttgtataaacattataattttgtaagttatattgcttccttttaaacataacattagctaagaataaacctcatttggatatttagaactataagtggatggttccattatttacattatttagaaatatatatatatatatatacacacacacacacactatttccttttagggatggacgccctacactcattgatgtcctacatacaattcattctgtgctcctttagtttttttgagtggttattgtttaattggacgcaagtaaaactaagcaagtaaaaatatcttgaaaatactggattttttctatcttatttattattgccacctcttttacattcttttatgtcttaaaagatgaaattatacataaatatgtgtgtgcttgcgtgtaaaataggcagttccagaatttgtcaatgtaataaacatcttatggaagaaatctgtatgcagcaaatcctcagctatccctgatacttaagtaataaaaaaacagctgatatggtttggatctgtgtccctgcccaaatgtcatattgaaatgtaatcctcagtgttggaagtgatgcctggtggtaggtgattggatcttggtgtgggatttctcatgaatgggttaagcaccattcccccttggcactgccattgcgataggatagtgtgagttctcatgagacgtattcatttaaaaatgtgtagcacctcccaggttgccctcttgcccctgctctggccatgtgatgtgcaagctcccacttcaccttctgccatgattgtaagcttccagaagcctctccagaagcagatatcagcatcatgcttcctatacagcctgcaaaactgtaagccaattaaacttcttttctttataaattacccagtctcaggtatttctttatagcagtgcaacaatagactaacaaaccaggcatgcatttttttgtgtgtttacacaacaaatttactgaacagctatcatgtaaaatatattatgctgggaatacaaaatatataaagcatagcttgttatctgcaatgatggacttaattgctaaggatgatacaaaatatatatagagaggtatacatatgtatatccacatatgaatgatataacttagtttttaatagtccatattaatatttcttacatgtagcacaggtatccaagttaagcaaaaaataaattattttcaaattaaaaaaaaatcaggatgaacatggtggctcgtacctgtagtctcaacagtttgggaggccgaggcaggaagattgcttgaagtcaggtgtttgggacaagcctgagcaacatagcatgacccggtctctacacaaaattaaaaaattagccaggtatggaggtgcacacttgtagtcccagctactcaggaagctgaggtggaagcattggttgagcccgattttactgaacaaagctgcagtaagctatgatcgtgccactgtagttcagcccgggcaacagagtgaaaccctgtctcttaaaaaaatcactataaaagttagactgtttttcaatttaaaaacattatctgaattcctgtactattagttttgcaagaataagccttagataggcatgtaggcaagatctgctggcagagattacatgcctggaaaatgaacctttgatgtactcaggaatattctggagttgttaccagttatttgtacctgaaaaatagtgacatataaccaagttcttcagaagatttggaaatatatggaagggaggtccttgaaagccatgataacatgatcctcacctagagctggcaagactgcctgcatccagttgccttcctgggcaggccagggaagttttcctctgagaggaaatgcagttggattataacccctgctctgggaagtcaccttgggatgcagacaaattgtatcatttttacctacattaaaataactaaactttgcctgtgtctatcggtattttttactcaattatgttcatccctgtcacactagagacaactgtgccactgtttattgtcattcctattatagagttgaattttaaaatcttatgctgaatttattttctagcggactaattaagaagcaggagaaaggaaaaaataggaaatttagttaatcaatagaattctggagttaagaatattctatggagaacagagattctgatttcttgaaactttaatttgaagttcgctaaagccatttgggttctgtaggttttactagtatcagcttctgcagaaaggagtgagcagagtgaaaactgattgcactaatagctgcaggaacactgaagctttgtgcataactcgaagcagctcagaattctgtgtttaccaacaagattgaagtgttccaaattacatcaaattcctttgtggtcacttaagggtatctcattttttagaaaatgggaagcagtttcactctctttcttttctttttttctgaaacctgttttcacatgatcctcatacccatgaacagactgtcatgagtatagaggccagtgagaaaaaggcaatattaaactgctgaatgaaacctgacatctaaaacctgccttatttggagaaaaaactcataatcgattagaaatcagccaggttatttggcatttgtttgcaaatatcagtttgcgtgtttataagacaaatagcatatctggaatctgaggttctatagaagaggggcagggaatggttaagcagcacccagaaccttgtctctcaccccacactcacatatctcatgcataaatacatttgtctcatactttaattattctctcaaatatgaaatagttcattcattctgccaacaactttaagtctaatataaaaatagacattcttggactaaattctattttcaatttcctgagttacaaaagagtcagacaaaaatgacatcgtttattgaagtgcatggtttcacctaattcatctgtttaatgaaaacttgatattgtatatttaacaaatagtatgtcaattaaaatttgcagtagcactatcagaggttgagtagattgtgtttagttttcttctttttcagcagtgtctttaccattgggcagcccagttaccagggcattctgtaaaaaccaaacaatagtaacactggtacattttattgaccattaagtgtgtggatttaggtatttttaatgataaaatcaaatgtaaagtccataatatctacatttttaattagaactataaccgtgatttcagtaaaaatataaaaatagtttaaaatgtatcttattcaattctcagagtaaaacaattacccgctaagattaaatcaggcaaaaattcagcacctaagactttcctgaattatcactatattactagataattacgtaattcactgttacaacttcaggtatgcaaatataacatttcaatgattagatctccataatttaagcaaagagatgcttgaaataggtagataatttgggaaaaggacatgcaattgcctgaagtaaaaacatggactgtgaaaacaaacatgtattacaacctgaattagcaattacttccagtctccactttgcttattgcacatggacagtttctcaccatcaaccagataacaccatcataattatcatacacacacacacacacacacacacacacacacacacacactaaaacaactctttctattagtgtgtataagctcatgcaaaaagcacatttagggtagattatagtttaaattgtgtatcattaatgtagaatgtagaaatagttcattcaatccaatgtagaaatgtagaaatagttcattcaatctagttacaaaaatcacctcatattaatagtagaataatggtaacacttcttcccttgtccccatatggaaatgcataaaagggaatttacttacactgaacgatgagctgcaccaaggcttcccttggtttcacgttaaatccattgtattggctggtctgacatctgtacattcctgacatttccctagatacattcacaatcctcagtgttccatcataactctccatttgcattgatccatcaggcattgcaacttctttatccgctctagaccaaaggatgattggtttaggtttgccagttacttgacattgcagttctattgtgtctccttctctggtgaccaatggtgatttttcctgtggaacagtcagattgggtggaacttgaaatgggaaaaagaaaatttttcaaggttagtataaactggtaaagcatattcagatacagaaaatcataaggaaacaatttctgctggctgaagaaatgtgacaattcggatgatcaaaaaccttgggaataaatggaatatactctcactgaaaatcattcttaattgttttcactgtatattttaaaatgaggacttcaaacattagcaaaataaataaggcattcaattgaaaaatggttaatataagaataatcttctcaatgacctgtaataattagccattaactggggctttaacatttgcatttcatagaagagtagcattcagctgtgtagactcagtagtcacaataagtgcaagtagtcagaaagggaaaaagagaaacctctgatctaaaatcaaaagttttgactagtttaaaacttgccaaattgctaagatttaggatttgttttttgcctagtgggagtgaaatcaagcaatttgaaaatccattctattctccatttttggacttttaattttttgtgatatttgaatttattattatttcacttcataatattttgatgtcattgtaaatagtttgccataatattgccaatatttctacaaaattaattttaattaaatcttcaaaatatatttcaacgaatataaaaattataattttggtcttgcgcggtggctcacgcctgtaatcccagcactttgggataatgaggcaggaggatcacgaggtcaggagatcgagaccatcctggctaacacggtgaaaccccgtctctactaaaaatacaaaaaaattagcccagcatggtggagggcgcctgtagtcccagctgctggggtggctgaggcaggagaatggtgtgaacccgggaggcggagcttgcagtgagttgagattgcaccactgcactccagcctgggcgacagagccagactctgtctccaaaaaaaaaaaaaaaaaaaaaaagaattataatttttctcgagtaaagttaatttctgatttacagagaatatttatgagaagttagattgattttactgtaacttactttattgtgctgaaatatatttatgttagaatttagtgaaaaccattaagtgatatgagggaaatactatacaacgatctttcttacaaacatcactagttccactggaagattcttatttcctacacaattgtatatgaattcaaatgcatttgtgcagtagaacatctatcaaaaaagcacaagctaaatagaatgctataaatacgaataaccagaaacatgaataattctatccttccgataaatgttatatgttccctttggaagtagtactgcacatgaatgaaaagtgaaaggttttactcttccttctagtttgattatggcccactgcccaggtacaaaaccaaacataattatgtttaaaattatttttcaactaattttgaaatgttgttttcctcattatagagacaaataaattcaagttcaaagtgatatgacaattatcttcctattcaaatatcttcaattcactttttcatttaattccttcacttattgtttaaaacactaattacataatgcataacgtcttagaatttaaacaatatgaactattcaccaccaccattttgaagtagatatatacatcctagaaattgacattaacaaaatatatgtttaaaacggctccattttataaacccaaatgggtaatttgttctggtatacataaacaattaaataattttggcaaagtatttgttctttttgaagtgaatgatgtaattaaaatctaagcagcatgctcagacaatgggattggaatggaactgtgacacttattcaccctccatgggaaagggtgcagaataacctcagcatttaacatttattatccccctactatgtgacaggcacaattaaggattttatgctttcatttaaacccccttgataatcttaaggaccaaatatttaatattaaaataaacaattaagaacattgagaataacagataataaatacttcaatttgaacagaatacaaacaaaaactaacttatagcaggtagctaatgtaaagatatgaatactgaagcaggttcaataaacaatggtatctggaattaataacttttgagcgttagcaatagactcctctcttcctgctcatgacaaattggacaaaatccctgcctgtcacttggtcactgtttcaaatatgaaagagtagagatgaatgtgagggagtatacagtaagtattttgcaaattatcttttctttcttttatcctcttattgatttctttagtcatttattattgctatcacagtggataaggccaacatctatatttcttaaataaatacctcaatcatctatatctgaatatgtttcacatgtcaaaactgcttataagatataccaacctcaaaataaatatccaaatttagataaatctgtgtaaaataaataaaaaatgtataactttaaagactaatggagggttattacttgaaatatacaatccatatctgttccaaaaacaagctacctgaccttggccaaccaaaacaccgtctgtattaattttaccttttgttgatgttgttgttttgagatggagtctcgctctgttgcccaggctggggtgcagtggtgcaatctctgctcagtgcaacctctgcctcccgggttcaagtgattgttctgcctcagcctcctgagtagctgggattacaggtgtgcaccaccacacccagctaattttttcatatttttagtagagtcagggtttcaccatgttgaccaggctggtctcaaactcccgatcttaggtgatctaccctcctcggcctcccaaagtgctgagattacaagcgtgagccaccgtgctcagccttaccatttttgaaactaagaatttgtactttattagcctcaacgttattgatgttctgattacaagaatgaatagtaaaaagttaaaaagagaagtggtgtcaaaagatagtatttatttcctaacttaataaaatggatatttaaacaacttattacattagaccgttcaaatcacaatagattattgactataatttttttaaatgttatcatgctaaatatttcaaatatcccttttaaaatttgtttatgtttttcatgtatttagataaactttcctccctgctgaattaaagttacagaaatataaacctcaattttaatctcaataacataaaaattgatttttagataaattagcccaggttttacaaaatagcaaaatctagctaaaagattatttaatatctgtctcttcctaggctagatgcggtggctcatgcctataattccagtactttgggcggccgaggagggcagatcacaaagtcaggagatcaagaccatcctggtcaacacggtaaaccccatctctactaaaaatacaaaaaaaaaaaattagtcgggcgtggcagtgggcgcctggagtcctagctactctggaggcttaggggctcaggcaggagaattgtttgaactcaggaggtggaggctgcagtgagccaagatcataccactgcactccagcctgggcaacggagtgagactccatctcaaaaaaaaaaaaaaatagattttaaatctagaagtcagggttaacctttccctacaactctcctggccaaaaagactgtataatttctcaaacctgttatatgtttttctatctttctgtccccactaaattttctatctctaagaattactcaactctcttaattgttcttataattttttctgttgagagatctcatttgttctcatagacttctgttttacgtgttgataataacaaattataactttattccaatggctcataattgcagcctatctttatattccaaaagtctttcaagcctaagcaccattttatttcttgacttggttaatagttaatttcaacagattccatctattaattgaaaaccatacagtattatttgtttcaccatttcctcttgtccaccacttcaaaacagccatcaaatcttgttatttctttatttaaaactatgtctcatatctgcctgtttcttttcatggccataggcagttttctcagtagaagtcatcattttatcttcttgtgacagcatcctaagtggtctctctgtcactagcctcattcttccaggcttcctgctgccctaagctttatcatcataaacagttttgttcatgtcagtatgaagactacaaacctcaatgagagtgcttgtcacaacactggtttaatttaaaaaacaacaacctgaaaacagcttaatggagttgttaaataaatcataaaacagttgaacaatagaatatgacacagtctttttaaatgatgatgtaatagacctatatttattgataagacatttatattaagtgggaaaagcatgttagcaagtagtataaatagctataatgactattattcagtgtgtaaaacatgttactgttcagtataaacagttgtatctaatttttatatattaaataactacatattagctctcttggctctctctcacacacacacacacaagtaactatgcaagataaggaatatgttaacttgcttcactatagcaaccatcttactatccatatgtatcccataatatcatgttgtaatcctcaaatatatacaataaaatttattttaaaaaaattttcaatgaatgttaacagggagcttcttgaagggtaggctatacatgctctgtctttacattgttaccatctagcataccatctctcacatagagaaacacagtacaaaattttacacctaatatatacattaaatagcaaggtaattgggcactaattcagggaagaggagacttacatggggaaaagtctagaggaaaagaaatcctagaaagaactataccagaacactaacagcggttctctctagagtgtgggattactgataaattttattttctttatttccctcttttttttactgattaaacaatatatatagtgcataataacatattacagggcccaagaagcccagaaatttttaaaatgttaattcaatctatttcccaaaactcattcaatgaaaacttcacattttataacacaaatgtatcactctggaaatgatgttctgaaaacatagactgagaaatgctcttccaaaatcactaactcctgttaacactcctttactgaagtttcaccaactagttaacctctgagcccttgaatgagcagttcttttccatggtcagagtgtctggctcttgctgtcttctagcaccctctgtctgccccatgtgttgaaactcagttcaaatgttattccctttgtaaatccaggctgacctggttacttactcttcctgactacacactacgttgtatgttttacccatttaacctgtccttgtgactttgtcctgtattttcttctatgtttatatccctgaccaggcagctccttaagggcacagagccttaatctgtctctaaagtctagtgtcttgctttcctgtttggcacagataagaaagttgtgaaacaattgagaaagaaagaaaggcagagcagaagaagatggtaggaacataggaaaataaaaagctatcaaaataatagataatagagataaacataatcaatatgaatcatgtatattttggaacaaatgtgataaataataatgaaatatagtaattctacaattagtagctcctacaagtagcataatcttatgcaaaatatattgttagaatatacttctgatgcagatcttgagatgtgtgggtgtgtgaaaaagttaaggaagtcaagaaaagactcttccagttctcttttttctttcatttaaatatttgaatagataagttatgaattattttttaaaaaaacagaggaaagaggcaatttgaagacatgaaatttaattttatcatttggtttttaggtcttaaatcaaattatttaaaaaaattgtctcataatgaaaacgtatcaaatttagcataaatatttgaaatgtctataccatgtaagatccccatttatgcaatgtacttgctagaaaaagtcactcctaataaaaatgcagatacattctctaacatatagtatatatgttacagtatatatgtgtatatagtctatacacagcccttgatatttttttgcctgaaatactactgcaggagatgttataatcagagaaactggaaaaacatgatatgacaccaaagtttctcattccaaacgtaaataaatagacaaatgatttgaacacattgcttttctgtcaacttttccactgatcacagactgtaaaatgaagcaaatatagaaaaagaaaatattttcatttcttcattgggaaggcagctgagaaaattttatctttattctttacttagaaaatggcttaaaagaatgcagaagtttagttcatttgaactatgtggaaaaatatcatgctgtctgaaacaaagacatctgaatgtgcttttaatggaattattggtttaaaaatatgactgtagtgcactttaatagtagatattgaaacaaaagctatatttctttcaatataagaatcataagaagctcagtaataaataatataattttcttccaaaagacaatcagactcatatttccaagaatcttaaaataagcatggcactaattcaattacacctgaattttggagggaagtactttataaaagatatgtatgttctcgagtagaatgtatagtctatatttaacatataaataaataaaacttcagagatactatgtttatgaaagttacccttagagaacagaattcaataattctcatcctgaccagatataaacaaatgtaaaaaagtaggactaaagtaagtagtaaatttgtagatgcaaataatccaaatgaaccaaatctatgttttttttttttttttgtgtgtgtgtgtgtgtgtatgcacacgcatgcaggtgcgtgtcttcaaaacaagagatgggttaaaaaaattgctgtagatttgatgagtttcatctttggtgatctgattgagactccaaggtaagcaacatcttcatttcagagcacagttttaaaggaaagatattctatcacacttgagtgctgtttcagtgtttgtgtcagcagtcctccatctcttctttgctagcacatttacagattggcttcataagcatgagacatgcacatggatatactcggattttgaagttttgagaagtcacaaagtagttttacatagaagcaaagaactaaataatttgcgtttgcaacaactgtcaatggcacatcactaatgatagctcacaacaggataagtaagataagcctctggttaagtgaaattgtcagtatgcttgttgtaactccactcatttctctttcattcaagaaagtacattcagtgtaagtgagaataatgtcatgactctaatctgtattttaaaacctccatacattaatatttgaaatattataattatcatatacctcacagatgatgtgaacacaccactaagatttagaagaattgccttaaaatacaaaatttataagaacaccaattgtcagtggccactggaaaatattcatataatgatacaaggcaaatttgagaatttcattctattcaaaaataattccattccaagtctgaataataccttttaaactaatatgcttgacccatttccagtatgattataaccgcgtgtcaatttttaaaatacagtaatgtgtgcttgagagatgttcaggatgacaaaaaaaatccaacatgctagacattcctcatttattaatggacctgctgatatttgcttccttttagagatcatgataggcaacacacggtttgatggaaggtggctaaactacagctcatttcttattaaaggaataaaggttgctattggatacttactagaaacaattcttagtatataaaaatatgaagttaacatgttgagttatataatatgcagcacctaaatttttttgtgtgtggtggtggtttgaaaatatgcagaacttccctgagccataggttgatataataatattatattgttacatgtccttctgggttgtccttccccttttaaatgaattactaagatctgattgactaatgtctcttcttcatctaaaaaatattatttaccatttctcaattactatttcttaaaaatcatgtcactatattatttcaatatctacagtagtttcccatttaccagaacagaaggtctaaatcccactgcttgttttccatcttatttgtcaaaccttaataagccacagtgtttctgtggaaagctctctattcaattgaggctggtcttttcaactgcttaacatacttgacttattcccattgcctcaccttccttcctttcttctcttcaggaatgagtttgacctcccaaccaatgattgttacattctttaaggtccaatttaagtttcttgttctatttactcttttctgatttctgcatcttttattcatcttccatgtctctgaattagagcatgcccaatttattctgtacatgtcatgacgaaatgtgcacttacatatgtaacgaaaatgtcctgatgtaagcatcagggtttttctatttcttcagtagctcccacatcatgtaacattttaaaggtttttttttttcaaggtgcttaataagttcttgattgattgatagagcacaaatcaaggttactaagcaaccaaagtaagaaaaccattgattaataatcagctcttgattatccaaggcttaattataaagcatataaatttcaagatcatttttcatatatgaactcttttattttttaattttaaacatccaccaaaaaacaatagatttttataatgttagtacatctactagactttgatttggatacagtaatgatgcaaggaggtagaaataatacactaaaatattggaagcacttggtaatattgagtaatttgtccactccatgactttcctcaatcagcagtaaaggaaaggctagttggccctatgatagaatgtccatgtggatctatattctaagacttgtattacttgcagtcctgtgtgtaaatgtttcctatgtgaaacaagcatttataaatatgtcttcacaccagatagtatgcctaccgtttttgtccataatatgaataagcataatacatctcttatcacactctgtaaataaaaactgccttttttcacactgacacacacttttaagtacctcacacatagtaaatcagaaaatgctaactaaacaggattgacaatgtttacaaatctagcaattgaacaggaagaaagcccacattaaaaacaaacatgaggttaaaataccacagcatgtgcatttggaagttctaaggggaaatgtccacgcatacacacacatacataatgactatttttgaaagaaatggggaaatcttattagaacggcattgttcattacttgaaacatatggggagaaataggttcctggagggtagcaactctaaaaggtttggtattggagatggggagcatgcagtgccattcaatcaggaaaacaggtttggcaggcaacagttgtggctgttccaacttccctcacccagcaggtgttgctatggcataagaatagtctctgagggattcaatagaatacaaagtgtaagatgaaagaacaaaatagaaaatcattctctgcatggcattcatattttccctgctactcaagctacaagaccagttgcaaataaacacaggttctattcttgctgcctcatgaacagataagtgaatgggacttcagctaaggttgctaaggtacgatttggctaagatttcaagtatcttgaattgttatgattttcatataatttggttttctaacttgagcatataataaaatattttttagaataattaaaataaatctcttaagagaatgtcctaaactctttggaaaaaaaataaaagcaaatagttctttctttttttaacctccatgacttgtatgtttctcacatactaaaatacataaataaataataaacactaattaagtatataaagtctcacatgtggaaaactttttttttctgaaacaactaagtaaacaggagcaagatatttcagcttgttaaagaattatgtcaaaattgtagtaagcaacaaatatgtattagattgagaatgttggagggaatagggactctacaaaagaaacactggatttgctataacaagaaagggggggcaggcgcagtgattcacgcctgtaattccagcactttggaaggccaaggtgggtggatcacctgaggtcaggagtttgagaccagcctggccaacatgcagtaaccttgtctctactaaaaatacaaaaattagccgggcgtggtggcgggcgcctgtaatcacagctacttgggaggctgaggcaggagaatcatttgaacctgggaggcagatgttgcaatgagccgagattgtgccactgcactccagcctgggcaacagggtgagactcggtctcaaaaaaaaagggggaacatcacacaccggggactgttgtggggtgtggggaggggggagggatagcattaggtgatatacctaatgctaaatgacgagttaatgggtgcagcacaccaacatggcacatgtatacatatgtaacaaacctgcacattgtgcacatgtaccctaaaacttaaagtatgataataataataataaagtaaataaaagaaagggggtatgataagatgcaaaacatcaagtaaagggctgagatattcatttactaagaaatggctaggtcattcgatgaagaactagtcaacctataaccatttctgagaactagaaaccaattcctcaaattaactttcttaatcaagttttagttcatgtttgttattttttaaaataatgcagagttgttctcactcataggtgggaattaaacaatgacaatacttggacacaggtaggggaacatcacataccagggcctgtcatggggttgggggagaggggagggaaaacatcagggatatacctaatgtaaatgatgagttaatgggtgcagcacaccaacatggcacatgtgtacatatgtaacaaacctgcatgttgtgcacatgtaccctagaacttaaagtataataaaaataaataaataaataaataaatataaataaaataatgcagagtaaatctggaaaactgtatttatgtataagcagttgataaagaattttaaccttaaaagttgaatactgcactccaaacagtttattatacaaactactaataataggcaggaggatcctatagctaaaaagccaactacgattcccaaattcctacagttcttatattccataatatatttgcatccttgcctacttgctcttagaaatggtgccatgatttatccaaatacacttatatacatttacacaaatgcgttatcctttaaattaatagcaactactctgggagtaacaaaagcagagccacatatgttacaatttgtacccaatgttagagataataccaatttattttaatatacatttttgattcccttcaatagacaaatatgcctaggactaggggcaagactgataaatttggctattcattatcttcaagaattacactatatattgtgaaaacatatatttatatttcacaagacctacacttcacaagaagtaaggcttcttgtagctgatggttgctaattattatttccaaattaaaggatttttttaataaccatggagagtttggaagacttgtaaatttacaagattagaaatttgacctgggctcaggttgtaatccacatactagctgtgtaaccttggcaaagggatttcttaattttagttttcttatctgcaaattaagctgatgaaaataagaatttaatgagtaatgaaaaaatggcacaatgctcatgaaagtgtcctctaaacactttgaattttgtaatatatttgtaaagagcaaggcttatgtctggctgcctagattcagttcctagctctatcacctactagctgggtatacttgggaaagtaggcaagtctgcacctttcagtttacgtaaagtgagcataatcgtacctacttcacattttttaacactcataacctcttaagccaaggtatggcatatagtaaacactccatatattaatatgttagttattactatgttttcttatcactgtacgttgtgtatcaataaccatactttattattatgcatacatttctatatagattttgttttattcatacttatgatgtctcgagtactgaggataggtacttacacggtcaaacaaaggtttatataattcaaatatataaatatatttatacctatataaataaattttattgctgttgtctgttgtccaggagacacatatgcattttacatgaggatactatttgaagaaaatgacattttagaaaagacaggaataaaccttttctaatctgaatagtcagaggcattcccccaaagccatccaaggaaagaagattgcatttgtctcccattagacataataatttgatctatatgtttggttactataacaaaatggcacataatacagatatctcagctctcattctatttctatgaaataacgagttttggacatccctatatacatctactcctcccttacaaggataacaaaatgtcagtgctgtccatttttacaaaggtcagggtgttgccatgaaaaccagggactagtaagttataaggaactgtctgatcatgttaattatgttattgctttctggtggataaaggaattctaaattaaaaggaagataagccataaattatacatcaaaggcattttataaaagcattgaaaaagaaagatgctttaaagtaattcacaatttattttaccttctggagcaactgttgctcacagtggtaaaatcctcaacgcagaatggccagaaaaaatcaaaattttattacttctgcaataaaaaggccatttgtctccttgtagaacccatgtgacattgttagctctcttataaatgatcaccctggacaatgcctgttttacaaattccctaattacaccactgattgtataccactgaatatgccttatcctgtagaaatagacactactgccaccttaataaacattttgacataaaacgaagctggctctctcatcttttgtcaagagcaaaatgaaacaaccagtgaacacaatgttccatcaacagatcagggtcacatgttctttagagcaaatgaggtttaattaacagatccgttaatagataactaattaaaaaaggagtgtcttcttatagctgcatgaaggccttattaacaaatattctactgaagcatgattgcattctacaaaccattctgctagtctgtagaagtatacagaagtttacaataaacatatggacctaattttaaaaccacataaaaacttatataatgtgattgattggaatgatagataactcattctggactaatacgtgtgaagagtttaatacaattttttaaatatggttttacattgcattttattcccaagaaaggacatttctgtttaaatgtcaactatatctattttgtttacaagtattatttagaaagccatggtaaaagtggactacttacgtttcatttacagtggactgtcattcatgccaaatgcattttagacatcgacatttaaactgcttgtcattttattatttctacttcacatacttaaattaccagcatacagatacaattcttccttgatattcacaggacatggagatggaggtgggggaaggtattggttccagaccacatcagataccaaaatctgtaggttttcaagtcccttatataaaatggcatagtatttgcatataacctatctcatcttcccacacatgttaaaaaatctctagattagttataatatctaatacaatgtaaatgctatttaatagtagtactatattagtttttatttgtataatttttattgttgtatttttaattgttttttcttctgaatatttttttataatttcgacttttattttagactcaaggggtacatatgcagttttgttacatgagtatattccatgatgctgatctctggggtaggaatgatcctgtcacacagtgagcacagttcaagattgattgaattcatggatgtagaaaccctatatatagagggctgactgtatttcctttcatattctgcatagaatgttttcaaaagtgcagtggcagtcttctcttttcacatatttttggtctagtcattattgctgacagaacacctataaaatttgggaaattctgatttctttacccatcatatacttggagaggattccactgttctcaactctttccctcccctgcaaatcattgctctgcaaccttttctaaagcttttggccctgatcctcagcatcctcttgggctaaatttcacccaacaggacttgccaggctccaattccttagtcaaataggtcagaaggcagatacaatgtgatttgaggtttctaaaatggattccctcatcaaaaatacatttctcagagtgtatctctggagcctaaaatctcattacttgagcccattccactgaaagactgtgtgttctgtgtaaagaaccaaggttcttcagccagaattcacctatgttcaacactgtatgtcactacttagtaactgtggtgtcaataaaagtcaggcctacgctttctacagcttaagcttctcatacgtaaaatgaatataatcacaaaatctgcttaaatggtgtcctgaggcgtcagtgaaataccaactgtaaagtgtttaacctagcaatgagaatgtaagaagcattccaaacaccttagattttctgtctacttgtaacttactttgaaatacttcagcatatggcaacactttgtatcttaaatttggtgttgacatgggtgttcacaaaactgcatgcttacaatttatgcatttttctgtgtttctgttatacactgaaataagagttgaaaaaataattcaccataaacaatgtgaccttcatttgtgtgctgtaaattttattgtatatactagtgatgctgttaatataatgctactcatgtgtatccactccagttgcagttagatagcaatttagaaacccaaaccatgggtccactgttttcaggcagctaggagaaggcaagtatcatcttgatctgaactaaagaaattttaatgtagcatgatgttgaatatggtcttccatggtgaaataaatactattaaagatacttgcattggtgagaataagtaagatctctcccaacttttgggagcgggatatgggactggcaaggagactctaacatcctaacactttttggagtggcatccttggaatatggctctgataatcttgtgccccatgatcaacagaataagtcatcacatgatccaactagaatgttacctgaatcacttctagaatattgcaacacctgtcaacaatgaccatttcttgcaaggcctttgtcaaagggatatgactgaatatttgaaatgcctgagataataaagggaaatattcatttaatctaagattttaaggcatgctgcaagctttcatactggatttgaaatctgagatttcaaggtcaagtcaggtggaagtgaacacagtatatatgcttctggggtctatttccttctctataaaatgaaaggcattaggtcatcaataagccctcagtattttaaatccgtgctaataattaagacatgtaggttatcttttaaaattgttttatgaaacaaatatgtggagacctgtcccagtaatcttttattttctttttaaattaagaatagatatttagaacacaccacatgttccataaaggcaccatcaaaacccaaattcaagtttttctaaatttttctcatcccttttccaaacctcactgatatctaacaatgttgaatgaaaaataatcaaaagattatgaaaattaggttcttttaaaactgaaaagatatttattggcaagcagatttgaggggagaagttctttgcactaatcatagttctagctatttggaacccttgaaagaaagagctttaagacattccaactgtaaaatgaaacttaaacacaccacatacaaattaaatcactttaataactgttctctctgttgctaagaggtctagagttctagagctttcactaccacatagaagaaaatggtgatgaaactgttagcctgtggatccaatcatcataaatactgctatttaattttctttttgccaattgtgaatggtaggttagtagtgtcatctgtgaccataaaaatctgaagtgtgatcataactacattagtagtgaacataccatttcctatacctctatcttctcctctaataaaaaacttcaggattggtcttggtattatagccttaaaataatatgctgtaatgtacattccattgttaactataaatctggtggaagcatttattctttatcagcgaatggagatatctgtcacaagtgtttctttaactctaatacatcattactcactgttatcattttaaatgcaaattttgaagctaaaaattattttcagccctcattggattggagaattttatatccagtcgtttaaaattcaaatagtttctatgttcccattgcttgcattagaaaagaaagaagggcacaggaagtatatattgggtatactctctcatttctctttgatctgctcttgctttcctatcacctgagaatttgaaaaagtatttaatattatcaaatgaagaaagtcccaaacacatgggacagtaattagacaaaagctaattaagcactgttaaataataagttgtaaagtcaaacctttgttctgatatttggggaaaatattggagtattttcagttgataattggagggaaattataaatccaatgttctttccatagtaatacagattcaattttatgtgaaaaattctaatagaaaaacatgtttaatgtttactgaacaattacaggaaataatagaatactctccatttttatatttatgtccctcaaaatataactagtaaaatattgatataacttatgcttctcaaaacaacttgcaactaacgatgttttaaataatccctttcactcctttaaatggtcttcttgaaaagaggattcatataattgtcaccttctatgagtgtctataatgctacctgtggcttgtttaagaagatgccgcataatctgaggatggatgttcttcataccaaaatactctatttaaactctgatgacctcttatcttgaccttcccattttcccctctcctttcctctcttcctcttaatcctctgtctcattctgtcggtctctgtcacactccctcactctttccatattcaatcctttcacttaaatgaaaataagagctcacttccattatcaaaatttatgcatcaatattatggtttctgggacaaatacaatcattcacatttattttcatgccggtgaagaagtactgaaggctgtgaagatgctctaaatacaaaaagctttccactgcatggatattctttttttctactcaaattagagagcttattttccttgatttccattgatcagtcattctcatttgcttcacagtttcttctttttttatcatctccttggacagtaatagctttgcttcttattctcttcttgggtgagcccatctgtttcaaattaatacaattacttgtgaagtctatgttttagttctgaccttttcctgatcatcagaactgattttctaattgctcaccagaaacatgaggatgtttcaccatcccttcagctacaactaatctcaaaccattttgttctctcaaaccttctcacaaacatacatcctttatgtgacattactgtattctaaatgaccgaggcataacagtttgggatcatagaagcaaaacaacatacttaaaaggaatggaagaactcatctaagccaacagctttcaactatgagtagcaaatactcctagtgtgtatgtgtatatatatatatatatatatatatatatatatatatatatatatatatatatacacacacacacacacatatatatatacacacacacatatatgtctgagaatcagaatcctttgtccaaatataatcttacacagaagtcctatgtatacaagagaaacatattttactctgattgaagttgaaaagggaagaaatgagtaaaattctctgctggttatttcgcttctctctgcagttcagtagcacttgcaaatattccaaattgccattaaaacactatttggaaatcagttctccagctgatcccataattctatagatgaaaagttttgaggcccagtcagaccaaggtcataaagctactaggaggtaaatttgggcctggactctgcactacattagtctgcctgatatcaatcaggctttttcttaaattgacttaagaacattggtcattgacttaactgcccttttatgagagagattgtgagtactacccagcaccttatctgattcctatctatctgtccaactgaataaatggtacccttcacacacaatctgcagaatgttttcttacgctccctttcattcattctatttcctcaaactttgccttgtaaatattccaaacctgtggtggagagataagaaatctaacatgcaaagaggttaactgacttctcagatgttgttcctgagtgagtctcaaagctcttattattattattattatactttaagttttagggtacatgtgcacaatgtgcaggtttgttacatatgtacatgtgccatgttggtgtgctgcacccattaactcatcatttagcattaggtatatctcctaatgctatccctccccccaccccacaacagtccccggtgtgtgatgtttcccttcctgtgtccatgtgttctcattgttcaattcccacctatgagtgagaacatgaggtgtttggttttttgtccttgcgatagtttgctgagaatgatgtacaaggctacagtaaccaaaacagcatggtactggtaccaaaacagagatatagaccaatggaacagaacagagccctcagaaataatgccacatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagagctaaaaccataaaaaccctagaagaaaaactaggctaagctttctgtatcttttttttcttatctagccactattcataaaatattgcttgtccccgttgtccaatttttttttcttttctttttttttttttttttccaacagatctcactctgtcacccaggcaatttttatcttaatgaaagtgttttgcctctctctgttacattatctccaaatgattcactgactattctgtcacaatgcaaaggtagtctcactgtttgggaaacaggaaaagctgtcattgtcagattgattgttaagccttaagaatgtcttttgaaattctcttttatttctccaccatcatttctctaattgtctcttttctgaactctgcagattcaccaactgaattggctcccaaagcacaaatcagatcatattgcctccctgataaatactttggtcattcttgattgtgtgaatgtgagctaataagatctaatgagattcatttcctcctaagatctagtgccttattcttaatccagctcagatgctacctgctgctctatggaactcttgctgactagattcaataacattattctgtgtgctcccctataacttctatagtttattaaagcaaatgctagattatatctgttaataagattttacctcaatcttataaaatgtattaatgtttgtatagacaagtaacggttacatgtgagtttaatttgctagtaagcccatgaggtttagctttgtaattattttatttctgaattaataggatatcaaaagtgtaggtttgaggtcaatgcattacagcctgtgggcaaaatatggctaccacctgtttttgtaaataaagtattattggaacacagctgtgcccatttatttattgcctatggcagcttgcccattatcatagcagagtggaatagttgtgatggaaaccatatggcctgaaaagctgaaaatatttactatccagccctttacgaaatgtttgccagtctctgatgtccatcattaattcagaggtcatggattttacttcacaattttggattcaaggaaagaaattaatatttctctgttcagtacctcagatgctaattacataacttttgattgcagggtagcttcctctgatcaaagctctgtcagggtattttatgtgatagtcttatgacttctacttacataaaataacctattccttactatagccattctataaaacttcagttttaatcagcagaatttcatgagtttctattcctccttaattggagaaaggacaaggaagcaaatctaattaattggacttagtcattttttctgttgccctcctgtttgttaactattcttctttcttgtgtactgtagtcctgtgttatcaacaactttcattttgcagatgtgaatacttgtacagacactggttaactaaaataattatagtaactagatgggtggcagcaaactaaaattttgaacagattttctcaattggtcaccactaggcacctatgcctatgcttcagcttcttgtttaaacttcaaaatttggatccactttctgcctataaaatgtccatgtactctaacaaggtagaaaaaagatcatcaaaatctgtattgagtcttctgctatatttgtccaccagatgtctcatcatgggaattccacagatcagcagtttcactgtttaggttttcgaggcatgatgcagatgcttctgagtttactataaacctacaagtttgtcaagtcatgcaaagaaataagtgcaagctaatgagcatccaaggactctaccatggaataatactggaagaagcaatgagatattttgcaacaatgcctttgaaaattaagtctactgctgtataacgattatatttttgcaaatgagtgacaatcaagtgacaataattaagaatttaactttcatcaaaattttaggctaaaattcacatgcatttttcagcaagtatgtgaagtttttttattttgtaaaattgaattatagcgtatagtatatttaattatagcatatagtatatttaattttttaattgaaacatttataacaattttaacttacctgcagtctagccagataaaatatagcttcagtaataaaaaactataaagttgtaataaaccaatataatttgcttatattcatatcaatgaatatcagccctacagtaaaaacaataattatcactttaatattcttgagactttcttcatcctctatactctgccaaatatatcctccttccactgtcactagcgcaatgctacttttgtcaagttttaactcaaatgtcatttctctgtaaaagtttcttatacccacatgaacaaaaaattcacaatttctacagaagtccgatcaagctttaagcacagtatgcaaccactatatattgcctagtttctacgtaatctgtcttgatgatttagattgtaagctccttaagggcaaggcctatttgtactatcaccatataacacagagtgtatatgtagcaataacacaggaaagaaatctaaaggaaacactaattttaaattaaaaaaaaaatactcccaatgaaacaatttgcatgtttaaagatgaaagtaagacaacctataatcacatatatcatagtttttatcaatcaaattcaaactccaaaacacatgaggcctctcttttcttctttccttttctttccctcctctcccctcccctcccctcctttcccctcccctcccctcctttcccctcccttcttctctcctctccaatctgccttgccttgccttaccttgccctgccctaccttgccctgccctgccctgccttgccttgccttgccttgcttttttgagacagagtcttggtctgtcaaccaggttgaagtgaagtggtaccatgatagctcactgcagcctcaaacttctggcctaaagggatcctcctgagtcagcctcccagattgctgggattacagtgtgagccaccatgcctggccctaaactgtcttctaaaatcagatcattgtcttttgagaatatgaataattctgtaaattaggatttacttccctgaaatattttgtatttcaattttaaaagtcatcaaaaacatatgttgaaatgtggctctgtcatttaagaaaaatgattttctgtctcaggtaaaaatgccttgtggtatctcagcctctacttaaaaaatatcattatatgactcttaaaacacagtaacactcaaattgaatgatgaagaattaaagagagaggaaaaagaaacaacagagtaacaattgagattcgatgtaagattttatatgaaaaacaaaaagctcagaaattttcaaaatgttttaaaatgtcaccctaaaatgccttatatttaacataaagaaatgcttagcccacaagtcagctactgaccatttggtcaatgctcaatttcttataatagaaatactagcaaaaccaagaatctaacacatcaccacatatatatttatgtcttacattgttgcttccttttctttgactcactcatcccatttgtgtgaatttcctcagtatcctccagggttcataaaattgatataatccaagatttccttgtatgctatagcttattcattttcactgttcaaactatatcctagaatacacctattttcatattaaagcactttagtcttcaatagtattgggataaatatcattttaatgatgtcagttgaatcatacaatctcagatttatagaactttatactgcattctagtattccactctattgtaagcaaattggaacatcaaaggtcagttttggcttgaagacagaatatgtaatcatcttcagtaactcattctttaggttaggcatcatcttctgtaggccttctatcacaataaaatctcctaggccatctagcctcaagagcctgccatccgtgtagccacacttagaacagccccaaatttgctttaatgctttgatgttgccatagtgagtttattaatttttgaacaaggggcatgcatttttattttcactggacaccacaaattgaggagctgctcctgtctttgggagtgataaaacattaagtcactataaatttgtctatcaaataactttaagtcagtagggaattacaataagggcagtaagaggcacagcaaatgtctatattatagagacaatgggaggggagaaaacctaaaatgaaaggtgtatgcataaattagtcattttgttagttaataattatctgtttagtaccttctatgtgccatgtattgtttcggctattgagattatagcaatgagtgatgcagacaaagtctcagactttgtagagcttccattctatggagaaaccacatctatctgtagttaagtgggtactttccaggggtagtgttttggaagaagtcaatatatttcttttatctccaatagtgttaccttgggtagccaggcaaattaatgatagttaggaaaatttaatgattacaaccaatctcttattactaatcttgaattttctttaaaggattggtggaaatttcacaaatcaatgttggtcatctttactattttgtcatatataacacatagtttcaaacaggcaatataactagtatgtttaaaaataaatgttagggctcgttttgtgagccctgtatataatgctgctttcttgtctccattctgtgctccatcttttgtctaagtttaatggtatataaactgtgctcccatcaaaggagttcttttagataaaagcattgattctttggatctgagctttgtgtcactggttctgtaaaggaaacaaacaaaaaaaacccagccaaaccaaaccaaacaaagaaatggttttgattaagtctagaacatttatgggaaactatccctcagaaaatgaggacaaattatcctggatctacaaaatttgctcttactctcttacaggaaatattatattggaatgtcatacagtacagtgtacagtgtcacctagcacactgaggtgaagaatcaatggatatttgttgattgaatgaatacataaacaagtgataactgactgtgtgtatcaacagttttccctcagatatcctaaaataatccatctcttagcgctagcaccaacgtttaaatatgttagaatttttttaaaaatgtttttattgtctctagcttttttttaagctagaaaagaaataatgtccaaacacaagtacttttcatcaccctaatttccttttgttttagtgatagatgataaaaattgaatatcttctaggaacaaagcacaattgtgcaaagttagcacatttttgttagcctgaatcataaacttctattcttaaggagtaaaatcaatccagtgttcactgcaatttggaaccatgagaaggcacaaaattataggtgaatacttcaaagtacaagatacaaaacgctgcctgatcatgtgtctactacatttgtctctatgttttcaacacatattatttatctttcatgatgtaagaatcttccattaaaattcaatttggtaacaagctggcaaaacaaatacagctactttgaaactctggatgtgtgctgattgtgcctcatagaatcacagggctttaaagcatctgaatgaaccctcctccaccaaatccctgtaattttccttgtcaacagatgtacatttaatcaagaaaaaactaataacatgttttcgtttttaactttaaaagaaagaatttcactccaatatattttcgtacttaactattttcattatgaacagattttaccatatgattctgcaaaaaaatcacatctgactacaactttaacatatcaatttttgttagtgtagggtacatttcttacatattttgcatttgaacactcttaaattatctctcagtattttcttcttagcactatatagttatgctttgtttaaaatttctgaaaattgtcttaactctagacatttgttgtttaattttattaatataattttagactcttcagagtattttgatgaaatactagtattatttaacttataagcctatatctatcttagtcaatgctattaattttatttggataatttctgtaaaatcttatgtaaatctaaatcaaaactgataaaacagtgtttcagaacctagtattcattgagcattcagaacattataattttgtttttaggaaacttaaaagggaaaaaatatttttaactaaaacctacttgatctgttaaacttcaatcattctaaatgtgaacatcttttacatcataaatatatgcctcttacctgtgctgctggatatattaacatcgatactgatatcagatattcctcctcccttcagagatgctacacatgtgtacgtcccaaaatccgtgaattttaaatcaatgatgtccaagtttgttgttcccggagagacatcaggatcagtctgtgtaatgaccatccgctcagaacttcttaatggacgaccatttttaaaccaactaaatgttagctcctcagaaggaacagcttctacttggcaagatattttcacctcacggccaatctggatgttgtcatctttgtgataaggatctggtgtgatccaaaatcgtcctttttttaatgctacaacataaaaattccataaggagttagtgttactttcataactttaaggattcattaactgtagataatcatctctgagctgaaataaagtaaaaccaaataaagtgtacatatatttcttttttatatccaagttgtgtgtacatcaaaaaacctcatgcaggtacccagaaataatctaaaaaaatctaagtcaattaaagactgtgaacactgatttttataaatttggtaagattttccagtgatatcaaaagtaatgccttaagtctatgtgcaattatacttaaatattgacattgaattttgaacaaatgacagattctatgtagtcatagcatattaaaattaaaagtaagaatatggatctcatttaacctaatactttccctatgtcactacttagttattgtataattttccaaacaactcaaatattacacaaaggacataagaacattctcctaaggttgtatctatatgttgatcaacactagttcggtaatatttgagtccattcacattcatgaaacattttcatatattgaaataatctgaactgaaaaagaaaacctggggcaaaaagcatgttcaaaacatttactatgaacttttctattctaccatacatagatgtttccagttaaaactgtttgttggctctctaatgcggatgaccaaaagaacctctccacagacagcttagaaaacaggtttgtatgctaacagaaatgttttccaggtctaaaggcagtgctgttttcacaagaggtcagtagtaatgactaccaaaaggctgccaagggagcatctatagactttctactaagggcctgaactttgaatgataccacaatactcaatatggaaaagctttctctcttttgtgacagtgattctcttatacacagatttttcttttttttttttttcatcatcttccccatttccctctcctttaaaatgactatccctacatgacaaaatgtggcatacacagtgaaacacaattatcaggataaaatattggtcatccacttttaacattaagcctaaatatgtaatgatattgtcaaaaatgccatgaatttagaggacctacagacactagaaggctgctaacagcattctggatagcccctccttagtttaaccatatttttgtcagttagtccaataaaaaccagtaagcactataaaaatctatagaatcatgcagaatgaactagagataaatatacttttaagtcttaaaaacttttctaagttttaaaactctttagcctcaaatattttcatctgctttcttgttggcatctcaataggaagatatacatagatatcaaaaacaatgtttgtgtctttctttttcatttaagatatatttgaagggctcctcctcaagactagccactaggctgggttctgactacaggacatgaacaaaatagacataaccatggccctcatgtactgcagcctgcatattcatagattagaggccaacttattcacacaacatttatgatacttatgtctagaaaaaccacagacatatatagcgatgaaatattttatatgcctgaagaagtttcaatctcagaggacagcctccctgaattactgtttagaaaatgcactaagttttaatcttaatgaaaacatgagaagacaaatacttaaatcacattctcatactgtcatttgttacatttttccataataaaatgcaacttatgaatcttatttacccctaaccatatctttatcagtaagttactctagggtgaaattaggatacattttggtattctgttacctagaatcatatattcatattttcacaggcactgacctatgactttacattgtatttgggaagggaaatgtgatgaaatgtccatatctggctgccatatttggtatataataattgtgctcatacaatgccaatgtaattgaagttttacagtacaaagcaaatcatatgagtataaaatatattttctgttaaaaacagatgtaaaatttaatgtcaagagcatttacttttattagcaccataacagttaaatgagagtttcccttcatttgctaagaattttctttatcctgtttttaaagagaaattttaagattacaattttgaaagttttattattgcatataataatttattaataaccatatgactaatatcagggttcatatgggatatcttttagaatagttttcattacaaagatatatgttggttgcatatgtaaacacacacaaaactgagatgtttaagtggttgtcatttatttaccatgcagctattgttttccacttctgtgctctgcatagtgacatattaaagtgatattgagagaactgcaatcttaccagccaaattagatttaaaatactaaacaactcaaaaaatactgataaaaatatgaaatcagtatctgtattatgttatagaatatttattcataaaaacaactttaaaacccaaagaaaaaatattagagattataaacccataatcaattaatacataagattatatgtaatatacaattagacaaattaataaaaagcaatataatcaagcatgcttttaagagtgaactcatagcgaaaaacattggtgaatcttagttatcagataattctatgatttggcctaagtcaattgtactagtcttctgaatgacacagaatctaaagggaaaaagagaaacaagtctgctaagtgagctcaagttaaggaacatcagaataagtaacagattatttaatagagagtcatttctgtttatgttgtccctctaacaaaataacataactggttttgcatacaaaaaagaaatgttcagataaaaggtgtgtgtgcgtgtactcatatatagtaacagaggacagagaaattttgttttcttacttagctcagaaaactaagagcatagctctgtaaactaggtctgggtacattgagaatttgcaacctaattccagtttttcatgtctacgtggtccaagatgggcaatctaatttttatggatcaagtgcatcatttatgaaaatagaaggtgatagagttaggctcccttagagacacattgtgagaaatagcttattaacaattgtgcctgagttttgaaaatataaagtgtttgatgtagttaatcaactgggcagcaggttccttcgtttataattaaacgctctctttttccgtgaacaatttatagtagctcatgtaatgttaatttaaagtcatttcctgctaccagttaagattttaaactcttaaaatcaatctgtaattagtactggagtataacagaggtccaatagacttattgagactctatagaactaaacaaattctatggaaaaaggatagcagaaatccctttccccaaatgcaatttctcagtctgaatattgaaaatcccctaacaccagcctgagagaacattagatttggcttaatgtatcataaatcgtgatagatgaaccttaaaaggtacttgtttagtctggcagtgcatgtaaaagattggcatcaagctgaacctctgttctggataatcagtttggaaacattgcaatgtaactatagcctcccttttttaatattgtgaattgaatacaggcttggcctatattcactttttaacagtatacttgcaaggacattctaattgcacttactgaaatccctcttcttcaggctacacagatgtgctgtgtaaatggagtgaaacccaagtattgaaacagaggctactcactgcaaaaatttgggtagggtttgttgctcaccttccctagaaataagagtccatgcctgtgaatgtgaatgtcaatggttcaatggaagactcctgttatgtaaaactagattacatcttgagcataggcttgaaagagggaacattgccttcagagaagtctaggcttgtggtttccacaaagaggaggctgtgagattgtatcttgattgtagttttagatttaaaattataacgtacattgttttgttggtcaaatgttccatgaagtatgcaatacatagtaattcaataataaactaaaatttattgacagaacaaaaaaagacaacagtcttatactttaatgtgaaaagcatctctttggagataataaatatgaggtgtcagctttttagcttctgttaagtatctatttcagaagaatgtaagatacagagtgaccactgatcaccatttcaggttgataaattgctgaaaagactctctaaatcgattatgttttataatcaggttgtaggattctggacaacctaaaggactgacaaaaccttgttgagatctggatatagaaaccattaatagtgcaatcagataaataaaaatcaatttcctatttattctttgctgaagagaataaaaatatctatgtgtgaaagatgaagtattttcctgacccactgaatgccaattaaataagcagttggaaataggttacatcagcaaagcaacttaaaagatagtaaacgatagtatgtataatctgtcctactataactaggaacctatctttctcctcaatagggctgtgaacacctggggttggagtgggtacaccttactcttcttcattgcccccaaatcctgaatatggtgcattgttaaagttggtacttaatactctttattgaatttaattataattgacatttcaaagcattaactttacaaatgccaattgtttccattcagtatggtaagttcctgttaattttgattttgtgttgcagtcttgtgttctgagatgcatctggggaaatagaataggaaaaagaacagatttgatgtcctcaaggattcagtgattttgttgtgggaacagaataacacttgatgaacaaacagcatcaacatgggaatatatgtgaggaagagaattctgtacacaacacaagaaacctcattctagcacatccactgactagttagctatgtgtatgggacatcggctatcagacaactctctttgtaaaggaggatttcatccaaaagggcttgtttatatgcttcagataataatcatttctgagcaaatatggataattactcaactgataatcagttgataatctgaagatggaagaaggaaaaaaaaaactgacatctacgcacatttacattgtctgaaatagtatttgctaaaacctgtttcagaaaatggttaatgaggttacattaaaacaaagtgtaggccaggtgtagtggctcatgcctgcactttgggaggctgagacgggcagagaacctgaggtcaggatttcaaaaccagtctgtccaacacagtgaaaccccatctctactaaaaatacaaaaaattagctaggcgtggtggcaggcgcctgtaatcccagctacttgggaggcttaggcaggagaaactcttgaacccgggaaccggaggttgcagtgagccaagatcaggccactgcactccagcctggacaacaagagcaaaactccaccacaaacaaagaaacaaacaaccaaccaaagtgtaacaaataaagtttgaaaattgactatatgaaaaaaagttcgtatttctcccaaacttttcagagctttgaacatgctaacatgcaaattgtcacattactggagaggctgattgcatctaccaagggggaacatctctgaggactagcatcccagagaataaagtttgggaaacaatgacctaagaaaatctgccagtcgaagagaatcattgaaaagactgtaaaattagattccattcttaatattgtaggcatttcccttatgagcatcacgaaataatcagcaaggtgtgactctctagtgaaaataatatttattatttaaaaagctaaagggcttgggaatgatcttaattttttaagttaataagtaatggtacattgaagttataaaaatatatttcagattcatctaataaactcacctacactaagagccgcgtgcctctttctttccaaccaacaatttagaaaacaaaattaacttaccagtttgttcctgtctctgaaatgtacattttgcaatatgcaaacagcattaaagaggagttaaatgcatcagcttttgtacaactctaagcactgatatgaacaagacttaatctttctcatttgcttgaagaaataataatttgagttaatttatttatatcttatgttattataaaaagtatatgcagtgttagtcttaaaagtattaaagattctggaaaatggatatgagcagggaggtcttttaaatttttttctctgatatgctattaagtattcttatactcacttctctgtatctaacaactccatttgccaatctagtctgaatggaagttcattaataatgcaagaacaaaaatacgttacacccttcctgaaagtggtttaacatagcacccctgataatctaaatgtagagtcagacgatgaaatgaagttggggttctatttaattgtaaagtatcaaggctctatttattttgtgaatttactcaaagctaattagtacagttaatcatttgaattgtttaagcatagtatggttgaattataaatgtctcttgaatatcctttctcaatagaacatcagcaggtaagcattttgggtaagaattagagaaagaaaggacgttttaggcaggcacaatgtactctttttggggtaaattcttcttaagaagggggaaaaagtgaactaaaataataacataattattatcattattattttgccattcctaccattttaatcctattttaagtaagaaaaaaaaaatatatatatatatattgctgataaattaccaaaatgtctttatcggtgtcataaatgaaaacatttacatgtggctaccatgtaaatggtatctgaattagcatgataccttagcaccagttatttgaatagaagattattactttgctggccctataatgttaaaaattagtgggtattttgagctcaccttttctatcaaatttaataatactttttcactatgagaaatgagaatgtgttcaggtatattatactttttattagttgctaaagacctaggactagaaacagctatcagatgagtggcagtttagaaagattggtacaaaatataattcatttgaaatccttttgaaaatagtacatccttaatatttatgaaattgatcatgtagttgtgaaaattagatgagataatgagactaacttaatctaaaatctttcgttacctttcttgagcttttttgttttctgtctcgtaagcggtgccctttccctttccaaagtgattctgccccttctgccaacctctctcacagtatcctgaggtcctacatccagttggccacttcttttgaaatatcagtatttcctcttccatactgtattctctcagactgaaacttgtttaggtcacttctaaacttaaaacacttctcttaaccccaataatccctcaaaccatttgtggcatattgcttgataaaatggtgaaataccagttgcactcactcactaggatactttatgtgctgggtttcactgatgctactctggcagtgagggctcaaagattagtaatgatctcctaatcaattaatccaatattttctagttcccattcatgtttgtattatttacactttccacttcgtgtcactttacattattggctcttctttcttgaacatctcttttatactggcctctataactggtaggatataacgtttaagaaaataaattcatggactgttctcattcacatcacaattgtcatgacagtctccctggttcatttgagttctatcatttgaacagttcatttgagttctatctatcacttgaacagttctaacattcgaaaataaattagtggactgttctcattcacatcacaattgtcatgacattgtcccagttctatcattcaaacagcagttgtaaagtcaggtttgttgagaaaggtaggatttttctaaatcattttgccgtaattagaagccatggagttttcccttgatgttctctttccttttgctgcccatgttagaacatgagatagttgtctgtttgttttgtttcttgagatgtagaatattgcaaccagatccatgcatatttcaatttaaaagaaaaatgtgttaaaatcatttaaatatatgttttcattttaacactacagaccaaataaaataacttagatatactgaatgactaaatgagaaatatctttaattactaacaatttatgtaaattatcttaattgccttatctggtaagaagatgaagagtgaatactattgacctggcgcatctaaccattccccctattttaactaaactttagatagatttatttctttttctttttttgggtggggtggggttatccatcccttcaagcatttatcctttgtgttacaatccaattatatgctttgttatttttaaatgtacaattaaataatcataattgactatagtcaccctgttgtgctatcaaatactaggtcatattcgtcctttataactattttttataccaactaaccatgcccaccttcctcccccaatcccacccctgttccggtaatcatccttctattctgttacatagatttattttttactataggcccctggtcctcattttcatacagcatttacacgacaaaacttgaaaatttagagaaattgtaaattcttcctctgctccatcgagttgtaaataatctgaaactcaaaaatgtctttctcaagtatgtgggagccatccctttgaaatataatagtcatctttgaagttcctgagacattgcccctatctcccattctctgtagagggtaagagcctagagcctaactctgaaatgtgaaaagagacaaacagcaaagacagatgttttaatcacattgaccaacctctcccataaagtcttccagtactttttttttattattttatttatttatttatttttacatagtctcgttctgtcacccaggctggagtgcagtggtgtgatcttggctcactgcaacctctgcctcctgggttcaagcaattctcccacctcagcttcccaagtagctgagactacaggcatgtgccatcaagcctagctaatttttgtatttttttggtagagactgggtttcaccatgttggccaggctggtctcaaactcctgacctcaggtgatccgcctgcctcggccttccgaagtgctgggattacaggtgtgaaccaccgcacccagcctattccagtacttcctattagttcacccagcatttaaaaatcctcctgcttttattacatctgagttgagttaaatctctctccccacatgggaatggttttaaatattccttgccatttttaacaagcatccaatgtaatttttctttcacaacattaaatttagtcatgtgcattattaaaatagatgaaaataggatcagtctagggaattcgttgctacaaaatttcaaatgtcaaagaaatacttatggttacaacacacacacaccccagtatgttgctcaaagatggaatgtcatgtaagtacgagagtatttgagagttaaagaggttaatttaatccctttataaagctatcttctccaatgtggtaagctctgtttaatctttaatgccctgcaggtatagagtttctgataataaaccacaaaacaaagatccggatgtgttggttaattaaaagatggcagggtgctgaggtgtgaagagactcaaaactaaataaatttaatatgctataatatgttatatgtattataaatagaaatgtataatctttcctttttgaaaaagtataccctacctttccttaggtgtgtttaaagtatatttttaaaatacatactatagtgtctgtgggttttttttttctctttttaatgagaaaattctatcaaacaagcaaataagtcaaaatgctggtggtatagacatacttttccatcctgtacaattgtttgttgagccatttaattggctttactctttacaggaagaaaggcaaagagggaaatactaatttcacaattcacagtatctgggacgtaaaaatactccaattcctcaaataaacaacaaacaaaaattactattcctgtttcagagatctgaatcaaatgtattttctgcacctgcataaaggagacatgaaacaagcagcatttttacccacttctttatagtgatcataacaataaaattcacaatcctagttgtcaatctatacctcaaggtgagctaactactgtaactttatacaggaaccaaaggagtctgtcaccatcgtatagttgttcaggctcaatttaaggaaaaattcaaagacattgtctgggtaaatattaaacaagagtgaatacaagtttatattctacgaaaatgacccaggaagtttgttggttgttgttgtttgggggggggggggtttgcaggtattatatgttgcaggtacatgaaaatgtattcattaatagttaactgataagaaataagagtcacacgttctaagaaaggagaaaagccaaactaggacctagactctgtagtgaggtagatagaagaatacatgtggatagagacattatagaaagcttatattgtacctatacacagtgaaaatacaattttttaagtgcaaaatctgtgagcacctcaagaaaatattttgcgttcaattgtttgcatttcttagagacttgttggatataagtcagtctaatgttaagacacatctaagagaaacaatgactattatgttggaggagttgatctaaattcattcttaaggaaaatgagttgatgataagaccagtaattcactgaagttatttctactttttgaaagtgaaactatgatagtgatagtttaaagtattggttctccaagtatgaaccctagtccaatatcagcagcatcacctgagaatttgttagaaaggcaagttattggatgacaccccaggcccaatcctcaggttttggtatagagtccagccatctgcattttaacaacccctctgagtgattctgatatactctcgggtttgagagcctctgttattgaaaaagtttatgctgccatcctttagaaatacagggctcgaacagagaaggcaggtcatcagctcacccagaaggattattgagatattaaggcacaaactaaaaagtgccatagcatatctttttactttgcaggatcttcaaaagcctgttaatcctaattataacatttgaaatgttatttaaacgtaactcccataagtatcaataacaaaagagtctaacctgatctcacatagattaacatggaactacttcctttccacatggccaaagcttgagaaaagtttcacaaaaacacttattatttccagatctcttcagaagatgataaaaatgttgagggctcaatattaagcaccttaaagtcaaccttctttacctacgaatttctaacactgagtattaagaatgtaaccaactatcatgagggaatatctaaatacctgatatggtcataatttaagggtaagcgattaatagcctattaagtttttggtgagtggcaatggtttctgggagagtcaatatagaaaacagtgaagagcaagtattctgaggtcagactgcctggttctaatatgatttcatcatttattggcagtgtaatgttgtacggttagctctatagagcctcaatctcccaaatctgtaaaatggtagtaattatgaagcatacaattgatccatgaaactctgagtatgctagttccaacacagaatatccaaacactagatgtgagctgctttttattccgtatttctgagcactcacagcatgtctatcactattctttctgccaaaggtgcacagatgaagagcctagtgatggggaaaagtatagaaaccaaaaatttgataaagacaaagactgacagtattttattataagacaactcattattgtgaaagggtaagagaagacttcatgtatttggtggtgcctgagaattcggggataaaaggaaggcagacagttaaagatgctgaaaggtcattccagagagtggcagcttcatgggtactggaataggaattcgtactgtgccaacttttggttttagcttagctttcaatcactctagacaatcctctcacgttccttcaaaatgtgtttctctataatttcaaacattcgctttcatttcccacctgtctctgaggatgccgggttgatctttctaaagctgacctcttaaattgtgctcctgaactcagctccagctttgcattgaatatcactcacacatcatcaattttctcttaaaatttttcctcacagtaaagtctttcccatgtatttatgaacatgatcataattaaattagcatgatcataattaaataattaatgattaattaatttaattaatcattaattaaaacaaagcaacaacaactaatataatacagaaagtctttcctcaacttctttatcttctgaagctatttcttatttactctctttttatttctcactctcaagatagtaatatataaatcactcacttttaacctctcaatagttttgattctcaccagtaacagaacttttttttttttttgaacgtggagtctcgctctgtcacccaggctggagtgcagtgcggtggcgcgatctcggctcactgcaagctccgacttcacgccattctcctgcctcagcctcccgagtagctgggactatacaggcacccgccaccacgcccggctaattttttctatttttagttgagacggggtttcaccgtgttagccaggatggtctcgatctcctgacctcgtgatccgcccgcttcgccctcccagagtgctgggattacaggcgtgagccaccgcgcccagcccagaacttttaacaattgccagggagaatatgttctgaggagcagcagctcagtccaaactcctgctgcatttgctgtatacaacctattctgaccttttgtttatagctcccagaccaattatacttccatttcctttgtcctgaatctgggcacctcttgtctcctctccgtctacactatcacttcttcacagcttgcttttacatccatagtctgtatctcagcacaggtcccactttagtaaaaccctctgttctcaactctctgagatacagttgcttatttcccattgtccgctcgatttttatgtgatgcagcacttcaatcaatgttcctcaattaaatttcttatatcactactttaaggtatgtctgatcttttttttccttctcactctttcatttatgacacattctccacataatcaaacctttccccgcatttcctttactcttttcagtctcccagaatgtgcccttactgttggatttgccttgtatgacatcttgtccatgctctctgtccacattggattcagtcactgaagcccagatctaatgtcatcttttttgtaatgctttccccaattcatgtaatgagtctgaagaattgccactattctttgtctataagaaaactctcttccagatattttgtattctctggactctcaagcttcctgaaaacagaggtacttcatattgctgtcttcctgagcaccctcacttccacaaagtaagttgtcacagcacttaggttggtgacatggaagatacaacacctgtaaagcttttcatccagaggggacatatctgaagctattaccaagtagtcatcagattgattgttgtcacctaatcattaacctgaacaaatttgttccattttgtcaattatcagacaactgacaaaatttgaataatgggctatcaatgaaatcgtattttgtcaagataaaatttccatattttaataactatactgtggttatacaggaaatgctcactgaagtgttttgtgtaaagaggcactatatcaccaagctactctcaaaggactcataaaacatttatacacatttatataaagaatgataaagtaaatagaaaaactcaactaatagcaaagctgggtaaaggctatatatgagagttctttgtactattcttgatatttaaaaaattttttcttaagaagttgagaaattaatattaaaaaatcagctggtttattgttatttatatccacagacacaaaatctgtaccctccagtgataacagtggactatgcatttttacatttctagattatcctcctcctattaaactattctcctcgaattaagctaaacatttatgaccctttgaaaactatcaccaatataaaaattagtatcgaatactcacaaaaaaacccaaagaataactaacaaataaaactagtgaagaaaactgacttttactcaataaaatatttgtcaaggaaataaattaatccttcttatacaaatgggtacgattagtgatggtgcctgataaatactatatgctttttgtaaactactactcaaaatctcatagaaacttgtacaatattttttaagtttaattataacagatgaactgtctttccaaaaaacatgcagaggaaaaaaaacttaatactctttaacattaactttctagatattttgaaaaaaacaaaaatataaaatgtggagccatccaatatataccatatgtaatatttttcattaatattcataatttcttgcggttaaaaatcaaaatgacacatttttcttaacatatgactctctgaaagctcagttaggccaaatgaagatgtataaatggggctgctgaaagtacaatgccatgttccatcacattttatcaggttacgatgtatttcaatatatgtgtatgagtgtgtgttatgtatgagtgtgtgttatgtgtgtgtgtgtgtgtgtgtgtgtgtattacccaaccaataagcattattttttaaaaacatctttaattactctgactctcctttttcacttcctattttatctacatatttgaaatcgtactatatgaaccatgcacctttatttggaagtccacatgaaacttgggaacaaaccaatgagaatcttataaagctattattcagaagattatatcagaattaattttcttgaatccacccccttgacttaggcaatggtgcaatacattagcttcatatgttttatttcatcattattattcatggaaacaaaatagagtcataattgaaatttatgtgacctggaaaatatttccttatgtgaaaatcctgcacatttctactcacccattttttaataagataatcatttctcatttaatagggctttgcagcaaagttaaaacttgtctggctggcaactcatcatgaacttaaaacaagttttttttttagtatcattgaaaacagcactctaagaccacaactttaaacattaagcattttcaggcaccagcatcatgaatttacactactgaacagcacagttaggcgctggattccttttgattataacagaaacactatcttttcccctttcactaaatggctacaggcaggcatgcattttttactttgtgtcagttgcttttcgttttggtcattttctttgcttgtaactatcagctcttattccttacaatcatcatagggttagtgtgaaagctttattcctttcctaatttgctacgctgcctcttttgtgaaagatgtacatgaactttatcatatgcagttgttctctcccttttcatagctgtattactgttattttttgttttcttttgttgttttcctgttcttagttgtgttcttctgggctcagcatgatcgctgtatatgtgtgatgttattttgcattttctacataatgggacttaacccaagttagaagctgaaactaatttacttatacctagccatgttctaagaacattttaccaggtgttcatatttattgttaacacagtgcatctgcagaaaaaaaaaagaagcaatgataatatccagttaggaaaataagacaaagccagaactgacattgatgaaaaaaaaagtgcaataaattctatatattttacaatggtaagtcatatattacacagtaaacattacggcaaccaaaatgataaggaaaacatggtcaattataaaacggacagttcttgcagattaaaaaaaagttgtacaagagaagtacaacttctcttttatggttctcagaaaaatggtataagatagagtgatgaataatatctttgaaaactctcttacaacaaacaagaaacaattttgggggactatttatttaaaaactgcttagtgtaggcttaaaacatcaggccaagagaaatcagcaaaaggaattctaatacgtgagggatgaggaaatatgatataatatgataggatatgtcaattcagggacagattttactgtattgaagccagttcttaacaaaaggtaaacatcagaccacaatgtctgaattacatcccttagtgattccaggtatgatattttagagtagagactggggatctagatttttaaggtctactaaagattctgattcatccttcagaatgagatctactgacctagaatagttgaaaatatagtacatgctctcctccatatatatcaatatcctgaattaaggctttgaaagatatttgtagcaataactgagtttatactccctgacaagtaactccgaaagacagttaagtacagaaccatatgcttcaacagtcaagccgagacagcctcccataaaaaacatggagctagaatctctcacaaactcattagaatgtcaacatatcaaagaaaatatccatatcaaatttttgaaatataaatccaatttagacattaggacagcacaactcaccaacctatgtacctgttttttccttctcaaatttgggggaaaattattaagaaaaaactgagataacttcattcacacatttttcactagagaaataaaataatctttcaaaaataaacttttggaaagaaaatgttgactactaagcacagcaaatatataacatctccatttctactttctctacctataactattactgaaaaatgatcctaacagtccttcctatccaggcttgataacacctataatttattcaggacatagttctctaggaagctactaatatttgaccagcacttgccatgctgaagagacctctctgggcttattcctcctatctaactgaaattttgtatcctttgaccaacatctccccagtactccccatgcccccagtctctcgtaaccaccattctactttctacttttatcaatacaactttttttagattccacatgtaagtgagatgaaaaaaaaaaaaggaaacaaggatggaaggaagaaaggaagagagggccaaagtgaggaaaactctctgaacatcaacagttacttactcttcacttgacataaaaattccttaataaaataccctttgtaatttacagattacttgggtgatatttttagtcatccaaagaaggcataaattagggcaatttattatgtggataatttctcattaatagattgagagatccacaactactcactgctcaaaacaatggagccatacatttaattttgtccttgattctaacatttttgttgcaaaattgagcaaaacccaagcattgatgaaatgtcattacttcaaccttttagatatcagaaaaattcagcatggaattatatttttgttaagtattcccttgttcttaacactatttggggtacaagctagaatgaaataatattgggatgcaggcaaatcaaatatgaaaaatacagataatttctgatagcattatttaaaatttggcaaaaattttagtgataagaatagccaaattatccctttgcactcagttttactttagaaagacatttattgcatccaaatgtcagtagttatgtggtaataagtagttttaggctgtgttgacaaaatatgaatgttgtcaaatatactgtgttatttgtttcagccgattttctactaattttttttttttttttttttttgagacagagtctcgctctgtcgcccaggctggagtgcagtggcgcaatctcggctccctgcaagctccgccttccaggttcacgccattctcctgcctcagcctcccgagtagctgggactacaggcgcccgccaccacgcccggctaattttttgtgtatttagtagagacggggtttcaccgtgttagtcaggatggtctcgatctcctgacctcgtgatccgcccgcctcggcctcccaaagtgctgggattacaggcgtgagccaccgtgcccggccttttctcctaatttctatttgcagtccacctgaaattcagtaaaatagaatgaggaaagtataggcaggtgaaagttaacatttgtctaattcaatttaacagatactgaatgccaattacataattcaggcattagtgggatatagtcctgtcattacagacagggtagaagaaatgattctaaaatcaattcagacatgctagagactaagagtagtaaaaataagtttatatttcacttacatttaattcaattatttctggaggaaatttataacaatttataacgcaagatcaagctaattttcttccatggagactttggaaaggttttacttcagtgagaaaatataattttgtcaattaaaaatatttttctagaaaacaaatcttgagatatatatgagttagttttaaattattttgttattaataaatattaagaacatggccacttaatatgcaacaatctctctgttgctcagtgatgctttgtgcatcctccctcacattctcttatcttttcttcaagaatctgttcttactatcctcaaaaccatacctgagcctactggtcacagtcagcaaaagctatggccttttacttcactaaaacagcattaagtataaatgcccaaagtgaattccataccacgtcaaagcgcatttatagttccacctctttctagccttttccattgtgtttcataatgatccattctttgtcccattgctattgtacctgggcctgcatctatcatcctccggcactctgctcatttcctttcttcaattttcaatctccatcttgctgctgattacttaactcaagcttttgcaagtgctcaagtctctgttatattaaaaaccattatttcacatatcctacttttacttttattcatggtcaacttcttcaaatcatccaactccagagtctttatttcttaaatactagttacttccacgatctgccaaaatgtgccttcttactcgtgtctctatgttacagtataccagcagcattattttcatgtttcagtcttcatctaccttaactcattctggtattttacattgttgacaacaccttcatttttaaaatttcctttaaaaaatatttaaaatagtattactttctggttctcattttactcataaacaactctttctcaattaaaaaaaaagttgtagctcttaaatgtatacatttttcaaaagttcatttccagatcatttataccatgttatctttagtctacagatgatgaaacggaaacacgaacaacttaatgataagatgtctctaagtatcaaaagtatcaagattataaaaatcaaatattttccaattaagtaatattttaaatataatttcacaaaactatttttgtaaaacaatatactacccacttataatgcaacttctaaacatataacatctgtgcctttagtttttttctccaaggtcaggaaaattaggcagagaatttagacacatgtgcttttagaaaaacaaaacaaaaacactagagtttattcatctagaaaatactattatgagcttacttttggaaatgacatgtttcctaaataaaattgctgtattacatacaaccatatatcatatgttaactggtaagtatgaatggttcctaaattatcaccggaaaaagacatatccattaccatattatttttagtatgcagtgactgcaattcagacatatccaattagggaagaaagaattgtgaatttattgctcaatttaaattttgtcatcattttctgatggaaccatttgccaattattgtttcagtgctgttgatcattacattgtaaaattatgctactgttatcacctttactatgtaaatacatcagattaaagtcttttcatattttgttacattttttgctcctcaaaattaggagatagcaaaagctcctttaactatagatgtttaagggagtatcaaatttatgctggaaaaattaaccaacttaagctactcagttatgttttattttactcacttatgaaatttgagttttctgtgttctatcatcattgttcttcaaatactcatacaaagttagtctgtctcactacaaatatattcagttcaaagtacactgaattgcatttccatttctgacttttctggggtcactggcagctgatcaacactcccatagagaaaaaagaaaaaccaatgagatttttttaagtcctttttgaaagtatcagatatcagttcaggcaacctgaacttgagagatcaaattccagggaaggaaaaaaaaaaaaaaatgagcttcacatactatagctatttttctttcaagtcattgtctatttcaggtatacagctgtaggctgaaaatccaaggaaaaatctgcagtgaatggtccagagtactcgactggaaacactgaaaggttatgtcctaggaatggggcaaatagcagacaaatacagcattaacaagccagtcttcaatatgctcagccactgattggaatgaaacagtaagactgtactttatctattataagataaagtaatataaaaaagaaaagaaaaatatttctgaagcaagataacctaatcctgagccggtttttcatacaaaataaatggcagtcagtaaaaaataagacttgtcaagagagaagacaaagaaaaatatagcaaagccaacagaccacagatgatcaaaacaggtgttctcagataaaaacagtaaaatagctatgatagaaatacttaagaacataggatacaaagctgggaaaagctaaatgaaaagatgaaaaattttgccagataattggaacctataaaactaaatcaaatgtaaagtttacaatgaaaaaaaattaaataagtgaaatgaagaattcaataaatatgtctactagtagattagaaacaacagaatacaagactggtgaacaagaagatggaacaataagcaatttgtagactgaagcacagatggagaagaacaaggaggaaaaattaggacagagcacaaaatacgtaaagctcagtgaaaggtctaacataagaaaaattaaattaatgaaagagacaggaaaaagaatgagaaaaagtaaatatctgcagaaatactggcccaagattttctaaaacttatgtaactgtaatccacatattcaagaagctcataacaatccaagcacaataaacacacaaaaaatccacatctaagcacttactataaaatgtctaaagataacaaagaaactcttagaaatacagctagggcctaggggggtggggtggaaggtggaaagctatataaaaacatacacttaaaaatactataaataaatcaaaatgtaaacctgaaatatgcaattatacttagtgaaaggaatagggaaaagtacactactctatattctaggaagaagaagttcttcatgttaaagtaacccacaagaagtcaagacaaagaaaacagaaataagaaacagagaattggaaacagaaggtaagttgcagaaaagctctaatatttcaataattatattcagtgtaaattatctaaatacaccaattgaaacaaggattggcaaagtggatttaaaaaacaggactcacctatatattatctataagaaattcatttcaaatataatgatataggtaggttaaaagtaaaaggacaaaatatatatatcatgcaaacaaccatcaaaagtaagcagggtggctagataatgtagactttagggcaaagaaaattgccagattcagagagggacatatacaatgacaaaaggtccaaccactaaaaagtcacagcaattgtaaatctgtatatacccttccccctccaaaaaaaagcagaaaatatgtgaagcaaaaacagatagaactgaaaggaaaaatagacaaatccacaattatacttggagactttgatattcccccctttaaatagatggaaaaactacataaccaatcaacaaagatattatagaactcaactaatagtatcaaatcaacatttatcgagcattatcccaacaacagaagaatgcttactcttctcaagttcccatggaacataggatagaccatatgctgcttaaaaacaaacctgaacatattttttaaaccacaattgttctctaactgcaatagaattaaaagagaaataagtgacagagagattataggaaatctccaaattcttggaaactgaacaacactcttctaaataatctatgggtcaaagaagtaccaagggaaattaaaaaacaaacacactgaactgaatgaaaacagaagatatcaaaatttgtaagacagttaaagaagtgctgagagggaaatttgcactgctaaatgcctacagtaaaaaagaagaaaagtctcaagtaaattatctaattcccacttcaagaagctaaaaaacagcaaaaattaaaaaaaaaaaaaaaactgacatgctgagtaataaagtaaaaataaaagtaattcagtgttatggactgaatgcatgtgttttcccaacatttcttttgttgtaaccctacttacccaccctaacccatttgtgatagtatcaggacgtggagcttttcagaaggaattaggattagacaaagttatcagagtggagacctcatgagtgggattacacccatataagagttacagagagagctggctttccctctctgctctattccatgtgaggatatgaaacgtttgcagtgtgcaggccagaagtgtgtcctcactagaatccaaccatgccaacacactgatcttggacttccaggatctagaactgtgagacatcaccatttgttgtttagaaacacccagtctatggtatttttgttacaggaacacgtgctaactaagacattcagaatctaaattctgatcaaaatgaaattaagctacagccaataacaaaaatataattagaaaacccatgtgtttgaaacttcagaaataaagttctaaataatccttgggtcaaagaaaaaaaaatcacagtgaaaataagaaagtatttcaaactgaataataataaacattacatatcaaaagtcttgcgatacagttaatagtatacctaaaggaacatttacagtcttaaaagcctacatgaggaaaaacagaaaataataaaatcagtaatcaaatcactgctttaaaaattagaaaaataattagcatttgaaatataatggtatagaaggaaggaataatcaaggacagaaatcattataatagaaaacacatgtacaacaatcaagaaaacctagaattcaaatgttggctctttaaagtaactaaggaatttgaataacctctagtaaaactaatggagaaaaactgaatgatattgacacagatgatcaatatcacagtctagtctcactatagattacaacagtggttggttggaaccacttcattcttgctcatgacagcagattatatgcatttctttccaactacaaaacttggatattggccatcatctgattatgcatgctatgaaaattggtaaatactataaatcaagtcttttttttttttttccagagagctggtttaccagcacatcctggacccccttcccccaaaattaaaaaagataattacaggaattacaacaactttatattaataaacttgacaactgaactggcatattcagattcctagaaaaacaaaactaagatgtaaaaatgtttattcctaaatatttgactagtcttatatttattataaaaagtaaatctaaaattgccagtcattgcacaaagcaatctgtaagcccagatggcttctcctgagttatttaaaacaattaaagagaaagtaacactgattttacataaactttaagatagcagaaaagaatatatctcaatgcttttaaattaattaccttattttgaatactgaaatataatttacatacattgaaatgttcatgtcttaaatgtatagtttaatcaattttaactaccgtgattatggactttcaatgtgtaaggttttttttttttgttttttgttttttgttttttttttaagcagtcactaattcttggttcatcttaacagattgttttggctaagatggatttgaattactgggttgatgatttccattctcatacagttttcagaaaagtatatttgttgagccaacaaagtaaaaagaagaagagaagattctttgaaaactaaaattaagaaattatcctatagaatctagaaaaggaacaattaaagaattatatttgattacatctatttagaaatcattggaagcatttagaatgagcactgacattggaggaatttgaacagaattcaaagagacagaaaaacacggcaaacagaaaatttgtcaggttgctaattcaattaaaaattgtatgtaaaaccacatgcaattcaaaattgcaaaaataagttttaagcattatttttaaatcatagaatagaatgtacccattacttattttttgaaaaggttctattattaaagatagaagttaaacatagatttttttttactttaaataattatcaatagtttctaatacttcataaataagaaaatgaagtaagttcaaaaaactagttaatatcaccatcctgggcagcaaatgaaagagacattttatttctgaatatgtagatactctcatttttcaaagcccagctaattggcaccatcctctgaggaattttttctatctccctaatcagaattaattgtttcttcatctgagatttgaacaacacattgcctatgcttcagttgtgatgttagtttattcttttgcatgccatatggagagagttgccctgatatctttgtgcataagtgtatgaactctatggcctcagggacttttcccttatagcaactgacacagatatagcatagagcagaaatttttaaaatacctattaaagcatcacttgcatttattttcctggtttaatatcctgatgtaaataaccaatacataattttttagagtagaacttcatcaggaaattagtgttcttcaataattatatgttaatacatgtgaatccataaagacatgtgacctcctgcatttgtaatgggcatggatcacggagcattttgctcttatagaattatagatggttggctgggtgcggtggctcacacctgtaatcccagcactttgggaggcctaggcaggtggatcacctgagatcaggtgttcgagaccagcctggctaacatggtgaaaccccacctctacaaaaaaacacaaaaaattagccaggcatggtggcgggtgcctgtaatcccagctactctgaaggttgaggcatgagaattgcttaaacacaagaggcagactccacatcaaaaaaaaaaaaaaaaaaaaaaagaattatagatggttagatggttagagcaaatctatcttaaagtttatgtactgcagtttcttagtatcacagagaagtaaccaaaggcctatttacatatctatgatgtcagagctagtttaaggcaaaaccagaaccagatcacagatatcttgtcctacaccttcctgcctatagatcatttagtccaaactaaatctggtaagccagtgaatctgggaattaagtacctgccacaacaaaggaaaaaatgctgaattatgcgttttcatattagtattcattgtcttggcactgttttacaactgtagggtatcaaaaaaaaaaaaaaaaaactaccaagagtctcaaagaaactaatgaaagaattttagaaatgttaatatttgaataaaatccctcttttctggacactaaccagtgccgacttttagagcactactatcatttttaaaagaaaattgaaagattttctcttggctagagtaaatatgacgagagactccatttactaagtaggaaaatttaaatgttttaataaaagaaccatgtttaactaagctgcctatcattacataaaattaggagatttttcaatatctagacaaaattttttatttgaaattatatttataattcttcataaattattttaatgaacaaggataagttagttttatttacaaaaggaaactcagctacctaaattcacatgagaactactgaatgataatttttagattttatatggccttgactaatttttaaaagataataatgcatttttgagctacaaagtaatataataacattctctctggtgttttggggaggtgtaattactacagaatattaaattgggaaaagagaaataagcacttaatctgcatgaataattgggacacctgcacacagcagacagttctgcttttggggaatgtgaaggcattggttttctacaattttagccatcatcattatagttttaataatgaaagattatgtaacaaagctattgatgagtaaaaattaaatttgatgaatctaaatgcttgggaagaactacactggcccagtaactggaaattcaccactaatttatattcagaaatgcatatgggctatatttgatcaaatcattctgggaaattgccaattaattctgattggcattctgattaatagcttaagatatatacctttcaacaaaaacagtgagtgcccagttgtaagtatacattgtattttcttgcttatgctgaatgttttagttatggggatattttgtatctttgtctttagtgattcccactgatatcttccagtaactacaaattctttaaaagttttgtacagtcatttgtaagaaagccagtgacagtcagttctatcaagtccttcaaaatataatgatatttagaaaatcataaactgtaaacactatgttagttagaacttgacattaagtaagattatgtccaccattactggaggaaaaatactgattaacaaaaacagaatttccttcaattaaaagaggctgtatatttgggaaagaaaacaatgttactaagaaaaatgtctgaagactgagtattgttgagatttttttttcctgagtataaaaagaagggattccgaatctggaaagaatccctagtacatctttggcaatgcaagaatagaggaaatagaaaaggactattatcagttcaaatatttgggagaaaattaaatatttgtaaaaatttggctaaaatttgaatcgctccttggctaagaaaatggccctggaaacttattgtgtggtctttgaatcccagctctattatttaaataaagcttgcttttgggaagttacttaatgctctctcttctgttttaggtttcttttttgtttgtttgtttgtagatgtagtctcactctgtctcccaggctggagtgcagtagggtgatctcagctcactgcagcctccacctcctgggttcaagcaattctcctgcctcagccccctgagtagttgggattataggtgcgagctgccacaccaggctaatttctgcagtttttagtagagacagggtttccccatgttggccaggatggtcttatgtttttgtattttttttattatactttaagttctaaggtacatgtgcacaacctgcaggtttgttacatatgtatagcacatatataccatggaatactatgcagccataaaaaaggatgagttcatgtcctttgtagggacatggaggaagcaggatggtcttaatctcctgatcttgtgatccacctgcctcagcctcccaaagtgctgggattacaggcatgaagcactgtgcccggccttctgttttacttctgaaaaaaaaagggaataataattttttacctgataactgtattgagatggttaaaaagttaatgcatatagcattactggtagcctggtacacaataagtgctcaatcagtgttagttattactattctctaaacatactggtacactcaaatgttaagaacttttaatcataaaactttggaattataagtctttttgtaataagcataaagataatttagaaatattagcagtgctaatatttggcatgtttcagtcaaataagttcagaacaaattatttaatattaaaattcatatttaaagactacagtcctttcatgttgataaactagaattagttaaatcatcactttttggaagagagttataatgttcctggaggttacagcatatttctgtgcagttatgaaagtgaaattcatgcctcattgaatacatattgacttcttccacaaaggttaactctatttcaatattgacatacttctttacttctttatattaggactcttagatcctatccacaaaaaaaaaatgctgaaataattctaaaattaataaagagcacatttcattgattctaaaatcatttacagtgtcattttgcagaggccatgggttcaaaaatggaaaaagtaaaggcctaaatgggtatcaaggcgtcatgggagcatgatgtgaagaatatagtttatgaggtatactgcatactacagtggctttaaaatgtgtctgttccataacagggtagagatatttgacccttccagggagtgggccagattgtgtcactgcactgaagaatggaatacaataatgatactgtagttcttcagaagctacattagaaaaacccatgcagttcttggaacacttggcctggcagtcttatagaagtctggctaccttgaagctgccatgagaagaaatcatgtaaagagacaagaatgagagagagacaaagagaagagacagacagccctgaggagtccagctgtaggagcttcttagtccaggcactagttatttgaataaagaagcattgaagattactgcagacctagccaccctctagctgcaattatatgggataccctgaattttttagctgagcctctcaactcccagatttgtgaacaaaacaaatgattattattgttataagctactcttttgggatggtttgttacatagcaatgaataatcagaacaatgtgacctttcagacaagttggtcacatcacacaaattatttaatgattgagtatggacatggaattttctaattttgcttaacatcatttaatacttacttaggttatcaaagagtcatatccagaaaagaaatctaatatgagctgatgaacttaaaaaagagattctctcactaaacacatgtttattgagcatctactatatgctgggtaatattctaggctccaagactacatcactaaataagacaataaacagacaaattctttacccctatagtcctattaaaaagcagacaataagtaaggaaatatggataaaataattccaggtagtgatgtgataagaagcaataaatcatggtatggaaattagagatatgctatcttaagataggggaatcagagaaggtgtttactagagggtagtatttgaaaactaacattcaaagcagaaagaccaatgcgtctaaagtagagcaagtaaaaatgggagtcatatgaaatgatgatgaggaattttaattccattttgggtgagatgaaaagccatgggaggaatctgatcaggataatgagatttttttttgttatttctgagtgcacagtaagaattttccagccttcaagccattgggtataggcatgtgtctgagttctagtcaatagactgactggaactaatgtatatctgcccataaaaatctcccatgtatgcccattcaagctccgtcccatttcccgatgacagggatggaggcaacatccatagtaaccttagcagccacaaattgaagatggcagagacatgatcagccctgatacctgaatgaccacatggaacaacctccccaccacacacacacaagtacactcagcagcattatcaactagtaaatactctgtactctttcatgaacaaaatctgaagttcttttgagtaattacatgtatgggtatatttattaacttagcccaggctactttatctaatatagcaggtgaatttctaaaagaggggctacagtggaaagaataacaatagaaagactattttaatcaaccaggagtgatacatcgatgatttggacatgtgtggtagcagtgaacatggaaagataggatctgattaaaagtatattttgaagatagaaccagaaggactggctgataaatcaccttcaagaatgcagtaagaaaatttgaaaattcctctaatccttctacatttttgtaaaactagatgatagaattttcctggctcacttttacctgaaaatagaacacacagaattccatagtaagtgcaaaacagacctctttcttatgcagaatttttggagaaagtggaagaaatctcaagccatgattcttagacttcatagacaattaaaggtaaaagaagagtaagaaaccaaatttaattagaaggatatctttagagaaaactgtgagatgcaacttcttccaaacccaaggtggagaaaggagaacctgtctgtttcatctcaatcatactgaggagctttccatgggacctgtcagctttgaaatattttccctccaatgttgcctgactcatatctgaagaaactaaaacctgtgtggcaagagaacagaggtagtacactgaaatttatgtgctctcatagtctattggtaagcatttccaacagacagatgtgagtctcacagggaagggacatgaccatgtcttgggctctgtttagttggctgcttagaggaaaaagggagaagccgtcagcagaaaaggggtaggggtatagcacaagatgttcaggaaatgtggcatattcatggactcagggaaacgcccatcactggacacctctctttgatctacatagatgtatatatcgtctaggtagagaaactttctaagggtccattaacatgtcaccaaggaattggggaagctttatatagagaagatcttcatagctcactctgagctacggtggtcagaacctatctatcaggctggggttgggttaagtggagaggtaggtggagaggtaacagacaaaaaagccacctgtgctccatctccctttcttacttcagctctccagccaaagtggacccaagctggggaggggagaaatttttgcattaaatcaggtttagagttattactattttggaccatgcatccaaaacactgaactaaatgtgggtttgtgattttgaatatactacagaacattcaaagaggccactatacactaaaatacagtaatgtcttggtattttgaaccatacatgttcaacacagtgatttaattcatgagagaagagagatgtaggcatttctaaatagaacgaatcatgaaaacagagacctttacatggaagtgacatatctaacaggagtttggaaagcattgagctcagggtgtacaacacgtggctaggaaatcaatgtaacattcccttcaggtgtattaggcaactgcttctctcctaacttatgagaaatgtagctcagacactgcaatttcttaaaaaactataagaaaaggcattgatgctacattaataaatgttctcccaaagtagtaaaccatgtgagatttgtattcagttttctacttcttatctacatagagtgttatctccattatttactttacactcttctctatttttaaaaaagtagaataaagaattctgaaatgtttcttgaattttatttctatcagcactctacactcttatgctgtgcatggacattcttaaatgaggatgggaattcgatgcacaaaatatctttatgcttactcagaaacctggtccatggatcctgatttaattacagagaagaatgagaggagataaacctagatttctatatctactgtatccatgacacaattaatctaagactcacagaggtctacacattcagaagccttgaaaataatttctttgatgtaataaagagaaaactgttttccttaactgaatttcttgacttctgtagaccagaaatcagatgcctcatattattgtagtggtttttctccccacagtttaatctaggatcctttaaaaccaaggctacttctaaattcagtaagattatatacaaacttgattttatgaattatgtgaatgccactgctgagaagtctcactggcaatataatatgattatgcaaatgtacacatcagataaattaaaggcataaaaagaaatcataaaattgaagaaataaatttttaaggctttgtttatttcaggtctttcatgtcaaagttggaaactttcttttgtaaggatacaggtgaaaactgttaggtagggtagagaggagaaaatcataccctaggcacatatttgttgttcactgggttagtcccttacaaagggtgcataagcaacacagatattttatattggacattttgccagttgtacatggattcaatatagttgcaaatgatcccattatgaaaattaaattcaatgcatcatttttctctaacaagttactgttcttgataaactaatggaataaaagattctgcattgtattcatggcacttaaggatagatgttgcagtactttaatattacactttaatcattatacttcaatacttcaatgctttaatcatcatacttcaatactttaataattacagcaagatttggtagattattttatgcctacttagaaaagcaagtatttttaaagcaaacaaaaaatagaaatgaaacaaacaccgattacaatacaatttttctatttctcttttaaaaaaatggggtagagagagaacagaatctggttgctcactgacacaaggcttaaaatgagccccatttctcaatactaatattttaaaaataaaagttggatacttccattgtgaattctttgttttctatatatttccatatacgattactttgtatttctgtattccataaagaactgtaactcctttgagggcagacatttagtcactgatctttgcagtcacactcatgcattccttacatttgctgagtccttagcccatggtagttgtgcagtagaagttcattaaacaattgaaataaagagcacatttcattgattctaaaatccatctttatttttacattttaacaattctgagatcagaatgcctcttacattcaatagtctgtcatggttgctattagtaatcatgacctgacttaaaataaaatctcagaggcagtatttctccataatttggaattattaatgctcttaatgacacaagaacaatatcgtatagaaaaccatgatcatcaatgaccctgtaataaaaactaatttagaagtcgagttctgagtgtgaactattataaaaaattaaattattttgcttttattggcctttttatgcaggccaataaatgacatattttaaaaaaaatcaaagtataaacaaatttagaagagctttttcaataatcttctatctcataagacattatggtagtttaactggcagtatgttttattttgttttgatatataaaataatcatacatgttatacatgtacatatgtacatataataaatattgtatggtatacaattttgtggcagatggtacgctattcatagtgttttgatttacactgtaccttgaaatgttttgaatagagtatacttttgtcaaatagcatattcctaataatttgcaaaataacagataactaaaaccaccacaatctacattcacaaaatcacaagtgtttatctctatacatttgattatgttttgcttccatcataagtaattttcatttgcgtgttcaaaaggtcatcttcagcatatggatgtcccttttaacttcagaggcctcagtgtgcaccctccacttccaacccaggaccataccaggtgaagtgagatatgaagaagcatatggtctctttgtacatctgcctcagaacttctttccatcttccaaaatggagagaaaacatgcctaaatggtgccagcatactagctggtaatgaccacattagaacagcattgctactttgacttagtgacttacattttgcttcagttcctcaaataagcattgcgtcttctatctctgacttttctgtcttttctcaatttcaatctgtcaaaacactactcgacctataagacctagtatgaatgttattagatattccctaataacctcagccagaagtggctatacattttttaatttctatatcttttgtttattcttttagaacaccgtatcatatgactattgatatatattattttcactatctgacagtggaatcctgagtacagggtaatgtttgatagatctctatataacctcacaatttaaagccatgattgtaataggggctcaataaaagtttattaaattgataaatttactgaattcctaaactattatacaatcagtgtatattttacacagtgaatgttttatgctgcaagccacattttttctttcaatctttttttagctaacaacatattataaaaagcatttgatggtatcactaagaatatgttatgaaagctattcaacgcatatataaagcactgttattaatctttaacctgtttaagttccacttataattacccaccattattatttatacatgattttatctgtattttacagatacatgcaatatttgaggaggtaattttatatcaaccattatttgctttttgagagcctaacctaggaatctacgttgtaacattctttcagcaaacttacctctcacaatgatgttggtggacttttttgcagggtttcccacattattattggcaatgcagctgtaagtaccagcatcatctgaggtgatggcaggtatggtcaaagttcctccattcaaaacagtcttttcaggcagagtcccaaaggacctgacccaggtgagagaaggtgcaggctctcctcctgttgtaacacatactaatgttatggcctctccaggatttacaactataggatcatccaccaagagtttaattgacggtgatgctaaaagacataaacagaagaacgtgcacctatttagatatgctacaactagaattcaacagcatgcattatattggttcattcaaaaaattaaaatgaaatatagtcctcttttgccaaaatcatactgtattactcaaatttaaacaagatttaatggtttcatattttaattaaatggtataaacatgtagaactgtattaagaatcttacacatagaaaggggaaataaaatttatgtttcctggattattgttctgaaattggaataataagcatgattaaggttttaaaacaaaatatccctttcttttttaatgctgacaatcatcttctgtttttgtcattcccagtacagatactgcagatattcagtccttgtattttcatggtgaagatggttaattatttattttttggatcattctgagatgaaatgataaatttttgcaatctgaatacaaccaagtgacagataaagtcatagatcacccaggcttttaccattcagtgagcctgatttttgttctcgaaagaaaaaaataaaatcatctaattctaatgcagtgtccatacttcatctctaacctcttcacttacaaaggtctaggcagtgagctcctatcaacacagctttaaaacttagaaacaaacattcaagagctcaaacagccaccaaaccatgcttgccactactgtttgggttataaaaatcccttactgaaaacaagtcttttgtaatcttttaggttaaaaaatacaaagataaacattcattcagtagaaaaagctgtgtgcagccttttcatcaaacactccaaatagaaactgtacaaaaactttcttcacatatagcacattttttttctgcttacactgccgtgctagcctaaataatgcatccctaaataaaaacaggagaaatacattataatgacatttcaagtgacacattcagaaatattttgtcaaagttagagctgtattatatgaaatcaatctacatcggaaatatttaaactgttcaattgtactgtgttttttttaatatattaacttcagcttagagttgaggagtgttttactcagaataaaagctagactacttgtgaagttcaaaactgtctgccgtgtttgaaaaaaaaaaaaaaaaaagccagaaaaggcaagaaaataatttcacattacagttctatgggaaagacatgaagtgcctgtatgacctttttaagcatcaatgtttcatgttgagtcttctaacatcactttaaataatatgggaatttttaaaatgtcatactattagcccttctgaggagttaatatgaaattctaaatatttatgattacaaacctgttgggaaatgcacatcatgaaaaaagtatgcaaaagttgccatattttggtgaaaaaaacctcaaagagttatttaatgttaaactgatggaggacagtactaattaaatattctgaaaatagatattatacttaattattaatatatcatcatgaagaggtaaagaaaatctctataccctgacttaaggtaaatagcataatcatacacaagtatttgattaaaatatagagatctcaacatttatatcatattaacagattaatttcttttacatcacattttagtcaaattaaaaggcccaaggcctaaaggccattaacagcatatatttggactatggacatacccaatggtgacattaagtccgggaatatttgcccctgaaattgatttgtataggatgagttgttttctattagatattatttaatgcaaaaaagcttaagataatttcaaagctcaaaaaataatgcatatataacaagatcactgttctaactataatacattttagaactaccttcacaacattgttaaaaatgttttcttccaaatttgacttggaaacacagtattgctcaagttacgtttattgatggtggcacttattttatctgtttatacctgaaactaaaaatagcccagatagaccacaaaacagctaacaatttcaagactttaaaaatatttgtatatattttaataccaaaatttgctagctttaaatttcaaaatagaaaaaaaagttgaaatcattgtcattttgttctagtattttactttttatttcataaatatcagctttttaaaactataaggctttgcttaagaaccagagacattcagatttatcaagcaagcttcagtgtaaatcatgtcgttgagtaaaaactgatataggaaaaacataaaaatatttttgtccattaaaatattttaaggaaaatatttcatattggatgaatcatttgctaatttgggggtatacaaagagtaacataaaacattataggttagtcattctcttcttataggtttccatagctacccctgccagttttttcttcatattaccttgtatattagccaggctaccaatatgactcttcagccagatgaaaagtgtcatgattgcattctctgaagtattatataatgtgatagttaagtggtaagagtacaaattctagagtaaggtacctgggttcaagtcttgactctgccatttaatacctgtgtgaacttgagcaagttctttgttttcagttgagggcctcaatttcccattgttgaaatgggggaaaatacttgtaactatcttgaagtatttagataatttaacatgcgtaatctgaagtccttttgataatagctagtacaaaggatgcacaaagtgttttcttttatcatttatttaccctcacagcctagtccagtgcttggaactcagtgggtgcttaataaatattagtaacacgaggcagtaaatgggaaaatgaataagtgagtaactactataaaatatgtggtcactatagaatacagttattctgattgcatactgcagaaatatctctaccattttgacttttgaaagtcctataccatatatataaaacatatttaaatacatctctacatttcaaataaataattattaattttgttttataatatttttatttggaaattgaaactattgtttttcaagattcaacattttcccaggacctttaaaagctcatgggcaaaaggtactatatctatgttagcacttgtgtaggtaagtgatactttttcacaatgtcctgaaactgcccaaccaccctcattctatccattacaagcttcttcttctgcacttatatgggtatataagacatgaagaaagataaagttcattttactaaatcatgtacatgtttagcatacgtctacagcatgtgttaattgaattatctcattactatataaggttaaacatggaaggtcatagaggtcataaattcccttattaccatgaaaaaagttcactgttctaaaaaacaattacagaatgtaaatgtccattgattcatcgcagcaacatgtgagatagattattagtttattctcattgataagcaataaaaaatcaaacatgaaaactgaaatgggataaggaaacactggatgagacagtatgaaatatttatttgagatcttcatcaaaccaaaatgaaaaatgaaaaaggtgaaatacgtaaagtaaaaaagagggaaactttctgattaagcagagcatttatattctaaattatagattattttaaatgttttataattagtgtcaaattgtggctccaattacattaaaataattccaactacaccaccagctgtaaacattctctctgtaagcagtgcttaaaaatgactatggtgccagtcagaataccaggctggtagtcttccaacatgtaataatggaaggcacaggtcatgatagacattgccacagagatttgagtctcctcataaagatcaggatgccaatgttctagcatgcctgaggtgctctgtagtggggatacttgatgaatggagggacgatagatagatagatagatagatagatagatagatagatagatagatagacagatagatagaaagaaattggtcctggagaggcatagtgatttcgaatgacaagaaaataagagaagagagaaagaaaaggaaagaaaggaagggaaaggggaacaaaaagtctgtggtttctattttccaaaatcatgaactctcaatagaatttcaataactgcaacatagaaagtatattttagaaaatatctttgagaaaaaggaattcttcctatttccccataagcacctcttctcctggcaaacaaagttttcttggactgagcaacagacacttcagtgggtccaagagaggaataactggcctcttgacacccacaccaaatcccaaacatctggatattcaagatcataggagatcagtttgtcccttcctatttgaggtcactgagtgtggctgcctatatagacaaggacatagtcatctcatggaaaatactccatgttccagggagacagctcccagtcccacaatggtggaatggagggagcagagagaccagctagcactgaaaagtgccaaaaacaataggaatgagagaagtctcaggaaatatatgcctgtcaaaggattcagacatcatgctccaggccttggtacaacagcatctcctagaatttaaattaagtgggaattccaaattgataaagttttctgaggttatggcagaataaagagttgaaagaaaaaataatactgaattatgacatagtagagacagatacatatttttcaaacccaagtatgtatactggggttcatgcccactaaaaattatagtgattcagttcctcatgatgtcttcttggtgtgtgacacaaatatttaatttggggttaagtaataatacattatgtagaaagaaaacactattttagcaggtcattgacttcttaggtgctttgtttttgccgctacctaacataataggtaaatatgaagataagcatcctttttaaaatctgaaagcaggatacagtgttaatcatctttacatccttacagactttggctctctgtacatctggagcatttaattatgaaaaaggaacccagctttccatccagactctaagcaacttagtataaagcagttaacaattgtataaacctgccaattgccttgaattagagatattctaatttaagctcaagacttttttttttttgaatggaaataatctgagtattataaagtaacctaattcacagagaagattgtgaggaaggagaaacacacacacacacacacacacacacaaacacacacacacacacacaaactaactaaataaataataaaacagaataaacgccaattttaaaatgctcaggtaggaaatatctgctttagtttgaaagcaggtcctggcacagcagttgatttgggctgggatcacaggaaacatattgaagaagcagaaaagggcaaaacaaggaaggaagaaaagccagtaaagggtcactgatgagcaggttatcactgtgggaaacttggctcccagctgctaggaaccctctgagagaccaagtcaagggcaccgcaaagctctctatctaaagaacaaggagcctggctcaggtgcttatctatcaactcctgtccctcattaattgggaattattctctgggccttaactttcccatctcatgccctggtcgaacacattcctgcattcagtgaaagttctcagatcgaagaataaatatgcaatctgtccaaagaaactgcagcaacctccaggccaggacaggaggaaaggcaagacacccactgtgtctgctatgactttgtttccatgtaaatccagtgatcaacgagtggctacatggagacaatgtgtaaagagtaaagaaagaacaaggaaggggtaggcggtaagtgaaagcacccctatcaatcaagatatgggtgaaaaatgaaataatgagagcacagtatgaatttaagagagacgaggtaaaaatacacaattaagtttccgcttctgttccgtgactctacattatttaaaccatagaacacatacatatgctaaacaaattaaatccagcttgtatgtagagaaacatgcttaaactgtgcttacagattcaaggaatagaaaaatatttctcttggaagaactagtcacttcactgtgatgaagatatcactgtactttcatatatttcattgaaattcattttcaacaggtatttcattgaaatataagtagcagtgaatatttcacaaaataaagatgagataatatattagaagttgatgtgaaaactcaaaataatctacccatttatgtggagttattattcaaatactatccttcacatattgattgactctcatgaagcccaagattggtatcatgctgggaaattctatttaaaatgatgctctaggaaataacaatatttgaaattgtattcataaacagtttttaatgtaggagtaaacttttgctacagatattgaagccaacatgcatttctcattgatattcacaggacagacatttatggaaatgattgcaaaggcagaatactgttcctttttgaaaaattgcataacttttaggaagagatgcgattcatatgaccatggatcctaaatgagagattccctagatgggctttgtttgcctggcacagtatctgttgttgttgttatcaacagtgatgaatgcctttaggcattgcttgttctccctagtgcaataggttccctacccattcattcataagtatttctacagcatctactagatatcaggccctgtgacagtaagctgtgatatatcagcgaacaaaagagtcaaagaatccctgctgtcagaagtttacaacttaacaagaagagaaacagcacactctgcatgactctccttgtcttaactgactttgtatgtttacttcacctgcctgttctctgaagtcatatgcatttaccaggcttgactgggatatttatgtcattagagcacggtgagcaaagaaaactgccaaaagttacattcttcagtaaactaagactttgcaaaatatagtaagtgacacttatgcttctcaggcctctgagcccaagccaagccatcgcatcccctgtgacttgcacgtatatgcccagatggcctgaagtaactgaagaatcacaaaacaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgtgaccccccactcctgcccactgagcaccttgcgacccccactcctacccgccagagaacaaaccccctttgactgtaattttcctttacctacccaaatcctataaaacggccccacccttatctcccttcgctgactctcttttcggactcagcctgcctgcacccaggtgaaataaacagccatgttgctcacacaaagcctgtttggtggtctcttcacacggacgtgcatgaaatttggtgccgtgactcagatcgggggacctcccttgggagatcaatcccctgtcctcctgctctttgctccgtgagaaagatccacctacgacctcaggtcctcagaccgaccagcccaagaaacaaacatctcaccaatttcaaatccggtaagcggcctctttttactctcttctccaacctccctcactatccctcaacctctttctcctttcaatcttggtgccacacttcaatctctcccttctcttaatttcaattcctttcattttctggtggagacaaaagagacatgttttatctgtgaacccaaaactccggcaccggtcacggacttggaaggcagccttcccttggtgtttaatcattgcagggacgcctctctgattatacactcacgtttcaagggtgtcagaccacgcagggacgccgccttggtccttcacccttagcggcaagtcccgctttcctggggcaggggcaagtacccctcagccccttctccttcacccttagtggcaagtcctgctttcctagggggcaagaagcccccaattgcttatttccgcaccccaacctcttatctctgtgccccaatcccttatttctgcaccctgacctcttatctctgtgccccaatcccttatttctgtgccccaaccccttctctgcttttctggagggcaagaaccccccaccccttctccgtgtctctactcttttctctgggcttgcctccttcactatgggtaagcttccaccttccattcctccttcttctcccttagcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaaaatcgaaataattcttgtcgtaaaataggcaaacggtctgaggtgcctgacgtccaggcattcttttacacatcagtcccttcctaatctctgtgaccagtgcaactcgtcccaaatcttccttctttccctcccgcctgtcccctcagtaccaaccccaagcatcgctgagtctttctaatcttccttttctacagacccatctgacctctcccctcctccccaggctgctcctcgccaggctgagctaggtcccaattctttctcagcctctgctcctccaccctataatctttttatcacctcccctcctcacacctggtccggcttacagtttcgttccgtgactagccgactagccctccccctcctgcccagcaatttactcttaaaaaggtggctggagctaaaggaatagtcaaagttaatgctcctttttctttatcccaaatcggatagcgtttaggctttttttcatcaaatataaaaatccagcccagttcatggctcatttggcagcaaccctgagacactttacagccctagaccctaaaaggtcaaaaggccgtcttattctcaaaatacattttattacccaatctgctcccgacattaaataaaactccaaaaattaaatttcggccctcaaaccccacaacaggatttaattaacctcgccttcaaggtgtaccataatagaaaaaagttgcaattccttgcctccattgtgagacaaaccccagccacatctccagcacacaagaacttccaaaggcctgaaccgcagcagccaggcgttcctccagaacctcctcccacaggagcttgctacatgtgccggaaatctggccactgggccaaggaatgcccgcagcctgggattcctcctaagccgcgtcccatctgtgcgggaccccactgaaaatcggactgttcaactcacctggcagccactcccagagcccctggaactttggctcaaggctctctgactgactccttcccagatcttctcggcttagcagctgaagactgacactgcccgatcgcctcggaagccccctagaccatcacagacgccgagcttccggtaactctcacagtggaaggtaagcccgtccccttcttaatcaatacagaggctactcactccacattaccctcttttcaagggcccgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattcctggactacagctatatctcattgccacccttcttcccaagccaaagcctcctttgcgtccacctcttctatccccccaccttaacccacaagtataagacacctctactccctccttggcgaccgatcatgcaccccttaccatctcattaaaacctaatcacccttaccccactcaaggccaatatcccatcccgcagcacactttaaaaagattaaagcctgttatcactcacctgctacagcatggccttttaaagcctataaactctccttacagttcccccattttacctgtcctaaaaccagacaagtcttacaagttagttcaggatctgcaccttatcaaccaaattgttgtgcctataaaccccgtggtgccaaacccatatactctcctatcctcaatacctgcctctacaacccattattctgttctagatctcaaacatgctttctttactattcctttgcacccttaatcccaggctctcttcgctttcccttggactgaccctgacatccatcaagctcagcaaattacctaggctgtactgccgcaaagcttcacagacagcccccattacttcaatcaagcccaaatttcttcctcatctgttacctatctcggcataattctcataaaaacacacgtgctctccctgccgatcgtgtccgactgatctctcaaacccaagcaccttctacaaaacaactcctttccttcctaggcatggttagcgcggtcagaatttttacacaagagccaggaccacaccctgtagcctttctctccaaacaacttgaccttactgttttagcctagccctcatgtctgcgtgcagtggctgccgctgctttaatacttttagaggccctcaaaataagtagaggcctttcctacagggtctgagaaggccaccgcagtcatctcttccgttctgtcagacataattcctcagtttagccttcccacctctatacagtctgataacagaccagcctttattagtcaaatcagccaagcagtttttcaggctcttggtattcagtgaaacctttatatcccttatggtcctccatcttcaagaaaagtagaatggactaaaggtcttttaaaaacacacctcaccaagctcagccaccaacttaaaaaggactggacaatacttttaccacattcccttctcagaattcaggcctgtcctcggaatgctacagggtacagcccatttaaggtccataacaccccccaaaaaattttcgccgccccaacacttcaacactattttgttttatttttcttattaatataagaaggcaggaatatcaggcctctgagcccaagccaagccatcgcatcccctgtgacttgcacgtatacgcccagatggcctgaagtaactgaagaatcacagaagaagtgaatatgccttgccccaccttaactgatgacattccaccacaaaagaagtgtaaatggccggtccttgccttaactgatgacattaccttgtgaaagtccttttcctggctcatcctggctcaaaaagcacccccactgagcaccttgcgacccccactcctacccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagtctgtttggtgctctcttcacacggatgcgcaagaaaatgctgaaatctattcactgaacaatataaatagaaaagctagagaaacagaacttgtgttctaaggtgagcaaaagtcagtgaagcaaaaaagatgatccccgtgtataagctataccaatagttggggtactaatacctagcagcgtgaaaggtctttataaacattgacaaggtatgatgaagaaaaaaattagcactacacatatctccttcccttgatcaacaatcctttactgttctttccaacaggtgaggtcctggcaaacttggtctcattcaagtttacaggaagctgagcattcacttgctgcagaatcccagagggtcagctcccatagagagaaaaatccaagctaagcatttccaactgaagtgtttgttgtccataaaattttcttgttattaatggaaaacaccagaattttaagcacagtactagactgtaaagacactttcaccacaaaatcagcagagcatgaactttctatttcttctacctggaattctcttccagtgcttgtccactcattaaaccagtcatcaggcaatttatcatgctcaaataacaataacaattcttcaccaaaatttccagcttttgtccagaccaactgagttgcttctttctttgtgtgagaatagctctttataataccccctcattaggacatttgcccctatgctttcactgtgagatatttaggagtaggacatcagagtaaaaagggtagtgtttttcatctttgtaccaccagcacccagaagagtatttgacaaagaataggtgctcaataaaattttactgaataaaagaaagttgaatttaaaaattattaaaccaaaactccatctaagctctgagtattcatcaaacttaatttaaaatgatcaaaaggccaggcatgatggctcacacttgtaatcccacaatttgggaggccaaggcaggagtaacacttgaggtcgggagttcaagaccaacctggccaacatggcaaaaatatgcctctaccaaaaatacaaaaattagccaggtgtggtggcacagacctgtagtcccagctacttgggaggctgaggcaagataattgttaggatccgggagatagaggctgcagtgagccgagattgtgccactgcactccagcctagggagacagcgagactttgtttcaaaaactacagaaagtaaaataaaataatcaaaaaaacctacaaacactgtgaaatagtgtgacagatgataagaatttcatgagccatttattgacaaattctagttatgacaacttgcaagttatttcattgttctacccatttaaacttacctatgttttatattactaacaaggagatggcaaagcatttatctatcaaaatgtaatgcaccactcccaaaaaaaaaaaatacagtgtactgtttgcactcctttgtacttatttgttcatttataccattgaacattatttttaataaaccatgtaactcagccgaatgttgactctgaaaccaaaataaaggctacgtggcttttttcacaagagggctagtatgtacatactttaatggggatttagcaaattagtcaagatttaaagctcttttctgagtgtaaaatagcaacagcagaagagataaagacatcacctctaagaccatctggtgttgatttcatagctatagtttttactttttcattttgtaccatatggaaaggtactctcctactgggaaaaatattttgtctgaaaaagattagttttctttttcataatccattctggggacactttatcacagtgtaatattttgaacacctttatgactctgtaactttattttatagaaattttggctaacatttatttatagccaatcttaaaggataatgttgaataaatttaactctgctgggcctctgtttgctcttctaaaaagtgagaaaattctgttacataatttctaaaggattgcttagagcaagtttttatcatgattaggaaaacatctgcacatatagcctcttaatctatgatatatctatgtttggctactcaaatgtctacattggttccatgatatagcaaagattaaaaatcacatcaggggattaattagctaggccaacaattactaccaaataaactcattgtaaatttagagatgtacgtatgttctattttaagaaaaaatcctaattcaacatatatttattaagtaccaattgcataccaggcattggagatgttagaaaaaaaacaggccaaaatcctgcccttgtggagtttgtaattaggagacaattatagcccttaaaatgtcctagacattctccaaaagctttgcatacattaactcatttaattataggaggtaggtactattattactttattttattttttaccaaactgagaaaccatttagaaacacttttgataacccctaagtcacacagctagtgaaaagtgaagctgggattctattctagggaatctggcttaagatgaatgtaaaaggctgtaggtaaactccaatgcaaaataaacaaaattcataatttccaagtttgattgaatattggatgatatttaggccaggagaagaattagtgctgcctctctaacagaaagaaggaatagcattgatgccatctagtatattatgaaaaaattggatagagtaaaaacaaacttgatttgctagtcagaattgcagaaatattcaccatccaaaatagaagttgaaaaggatttgtgaaccacataagtcataattacaaagcctaaatcctgaagtgtccgtggaagaggttcttaagccattgctctggatatgttcacatctcacacatacaaaactttttaattggctcagtgatttaaattctcagaatctaagaggtaacgaggagaaatttaaaatggaaagacttcttgaggcaggaaaatggagagcaacagtagcagttggtaatctgccagcaagaaaagagtgaaagaaacaactatctaatatagaacagtaaatggggtcacaaagtacaatattaacctatcttccatatgtttcaactatcaccccaaaatgccagattaaaaaagataagaggtaatacacttgagcagctagatgttagtaataagatgaagattttgagacacaaaaattacatagttctccaaggaagagcctgacaaggatgtagattgtctgactgcagagctcatgctcttactgtctgcccaggctaactctttatcatgaacctgtaatatgaacaacaaaggggctaagttgaaaggactgagatgaggaacctggaatgcagaacaatggcaaagtttattcaacagtaaaaaaaagcgggagaggaaagaaagataaaagaaatgggaagagaagagaaagagtgaggagaaaaagggagacagaatgagaaaattttttgcttatgcttttttaaaaaatgtgttattttattttaagttctgggatacatgtgcaggacatgcagctttgttacataggtaaacgtgtgccatggtggttttctgcacctataaacccatcacctaggtattaagcctggcattcattagctatttatcgtgatgctctccctccctctacccctcaagacaggctctagtgtgtgttgttctcctccctgtgtccatgggtccttattgttcagctcccacttataagtaagaacatgcagtatttggttttctgttcctcattagtttgctgaataaaatggctttaaactccatccatgtccctgcaaagaacatcgttcctttctctggctgcatagtattccatggtatatatgtaccacatttgctttatccagtctatcactgatgggcatttgggttgattccatgtctttgctattggaaacagtgctgcaatgaacatatgtgtgcatatatctttataatagaatgatttatattcctttaggtatatacccagtaataggattgctgggtcaaatggtatttctggttctacgtctttgaggaatcacaacactgtctttccacaatggttgaactaatttacattcccaccaacagtgtaaaaacattcctatttctccacagcctcaccagcattggttgtttcttggctttttaataatcatcattctgactggcatgaggtggtatctcattgtggttttcatttgcatttctctagtaatcagtgatgttgagctttttctcatatgcttgttgcctgcttaagtatcttcttttgagaggtgtctgttcatgtcctttgctaactttttaacgggaatatttttctcttataaatttgcttaagttcattgtagattctggatatccactgactccacagaaatacaaacaaccatcagagaatactataaacacctccattcaaacaaactagaaaatctagaagaaattaataaattcttagacacatgcaccctcccaagttgaatccctgaatagaccaataacaaggcctgaaattgaggcaataataaatagcctaccaacaacaacaacaacaaaaaaggcccacgaccggatggatttactgaaactattccaaacgatcaaaaaggagggactcctccctaactcactttatgaggccagcatgatcctagtaccaaaacctggcagagatacaataaaaaaaggaaactgcaggccaatatctctgatgaacatccatgcgaatatcctcaataaaatactggcaaactgaatccagcagtacatcaaaaagcttatccaccacgatcaagtcagcttcaacttgcaagactggttcaacatacacaaatcaataaacataattcatcacataagcagaactaaagacaaaaaccacttgattatctcaacagacaccaaaaaggcctttgataaaattcaacatcccttcatgttaaaaactctcaataaactaggtattgatggaacacacctcaaaataataagagccatttatgaaaaactcacagccaatatcatactgaatgggcaaaagctggaagcattccccttgaaaatcagcacaagacaagaatgccatctctcaccaaccctaatcaacatagtactggaagttctggccagggcaatcaggcaagagaaagaaataaagggtattcagatagaaagagaggaagtcaaactgtatctatttgcagatgacacgatcctacatctagaaaaccccatcatctcacccctaatgcttcttaaggtgataagcaacttcagcaaagtctcaggatacaaaatcaatgtgcaaaaatcacaagcattcctatacagaaacagtagacaagcagagagccaaatgatgagtgaactcccattcacaactgctacaaagagaataaaataccaaagaataaaataccaaaggaatacagctaacaagggaagttaacgacctcttcaaggagaactacaaaccactgttcaaggaaatcaaagaggacacaaacaaatggaagaacattccatgttcatggatatgaagaatcaatatggtgaaaatggtcatcctgcccaatataatttatacattcaatgctattctaattaaactaccattgacattcttcccagaattaggaaaaaactactaaatttatatggaacccaaaaagagcccatatagccaagacaatcctaagcaaaaaagaacaaagctggaggcatcacactaccaacttcaaactatactacaaggttacagtaaccaaaacagcagggtagtggtacaaaacagacacatagaccaatggaacagaatagagatctcagaaataaaactgcacatctacaaccatctgatcttcgacaaacctgacaaaaacaagcaatggggaaaagattccctatttaatatatagtgctaggagaatgggctagccatatgcagaaaattgaaactaggccacttccttacaccttatacaaaaattaacttaagacggattaaagacttacatgtaaaaccccaaactataaaaaccctagaagaaaatctaggcaataccttttggaacataggcatgggcaaagatttcatgacaaaaacgtcaaaagcaattgcaacaaaagcaacaattgacaaatgggacccgagtaatccaaagagcttctgcacagccaaaaaaaaaaaaaaaatgcctatcatccgagccaacctacaaaatggaagaaaatttttgcttatgcttttacggtataatgtaaaacataagaagtggacaaaaggacaaaagtgatcaacattctgctgaatacactctagactaaagggcagataaaataaataaaagcattcaaattacatataaattcatacttaacacattcaagcattacaactgtcaattacttttaattccagaagtaattttataaaatacaataagaatataatatcttgattgcttgagttgggtcacaactcagacaagtactgtgtcatatatacttcaaatcttaccaaatactcattactagctcatgtctgggattgctgctctaccctttaatggatatgtgtgcattgaagatgtctggatgaggagactaattctagaaggcagacgtgcctcaataaattaaggccttccctaagaaacccgagaaatatatagattttgtcttaaatgtttgtgtgagatatttgcttttcaggcacagatatatcaagtttttttttatttctatgtttatattgatatgccttccacatggttaattaaataaaaagaggggaaaaggagaaagaaaaagattcagagcatcatttgttaaaaagaaatgtatcattcaacataagaaaatcaattaatgtgatacactacattagtagaataaaggataaaaatcacatgattatcttcatagatgtagaaaaagcattagtcacaattcagcaccctttcatgataacactctcaacaaactaggaatggtaggaaattaccttatattaataaaagcctatatgtaactcccacagataataacatattcagtgtgaaaatcaaaaaggttttcctataaggtctggaatacggaaaggatgcctgctttcaccacttcttttcaacacagtagtgttagtcccagccagagtaattcggcaagaaaaaagaataggaggcattaaaactgaaaaggaacgagtgaaactgtccctgtttgcagaacatatgatcttatttatagtaagccctaaaaactctatgaaaaaatacttcaggaaaattgcaggatacaaaataaatgtacaaaaaccagtcctgtttgtactattaacaacaagttatctaaaaagaaaatttgaaaaacaatcacatttacaataacaccaaaaaaattaaatacctgggaataagcttaactacggaagcaaaaggcttgtatactaaaaactacaaaacattggtgaaggaggtgaaacagggcacaaacaaatgaaaagacatcacattttatggattggaagacttaatattgttaaaatgtccatactgcccaaagtgacctacagattcaatgaaatctcatttaatattctaatggtattttttacagaaatagaaaaaaaattctaaaattcatatggaaccacaaaaaccacaaatagccaaatcaatcttgaggatggagaacaaagcaggagttagcacactagctgatttcaaactgtattgcaaagctatagtaatcaaaacagtagagcactggcataaagacagacaaatagacaaatggaacagaatagagagcccagaaacaaatccacaaatatatgtttgacaagtgggtcaagaaaacacaatgggaaaaagatagtctcctagacaaagacaagagatgttggaaatattggatatccatgtgcaaagaaaaaaattaaatctgatccctaacttacacaatacaccaaaaacaactcaaagtggactaaaggcttaaatataagacacaaaattataaaactactataagaaaacatagaggaaaagattcattccattgatcttgggaatgatttcatagatataacacaaaagcatagaaaacaacaacaaaaataaacaagtgggaccacatcaaaataaaaaaaaaggttctgcacagaaaaaaaaatagagtgaaaagacagcctattaagtgggagaaaacaaaatgcaaaccatatatccaattgagatttcaaaatatttaaggaaatcccaaaactcaatagcaaaaaacaaacaaacaacaaataacctgattcaaaaatgggataaagatttgaacagacattctccaaagaagacacacaaatggataagtatatgaacaaatgctcagtgttacaaatcataaaggaaatgcaaatcaaaatcacaataagataccaactcacacctgtcaggatgactactacttttaaagaaagacgataagtgtcagcaaggatgtgaagaaactggaagcttcgtgcaatgcaaactggtgcagctgcaatggaaaacgatatagaggttcctcaaaatattaaaactgtgtctaccatatgacccagtaatcctacttccaggactgcttatttttccaaaagaaatgaaatcaggatctcaaagatatattaggattcctatattcactgcagctctgttcactacagtcaagaggtgcacgtaacctaaatgtgcatcaactgatgaatgaatatagaaaatgtggtatgtacatataatggaatattatttggcctgaaaaaataagcaaagtctgcaatatgtgacaaaatagatgagccttcagaacattatgctaagtgaaatgagcccgaaagagaaatattgcacaattgcatttatataaggtacctaaagtagtcaaattcatagaatcatagaatcaaagggtggaaatgtggctatcaggggttgagtgaggagggaaatgaagagttactaatcaacaggcataaagtttaagtcaagcaagaagaataagctctagagatctgtggtacaacattgcaattatagtcaacaataatgtactgtgcacttaaaactttagaagcatatatttcatgttgagttcttactgcaattaataaaataaaatttaaaaaccatgttttaaaaaataaatgtgccaaggagagggatttagttccaagttttgcatgcagttagaagccaatttactgaactgaattacaaagccataaaaaagtgttttacctgaataaaatgacaattttaaactacagaccttgtagtaggtgtcattacttattgacttaccataaatacttaatgctgcttagtattgttatcacagatctaatttcaacaagagccaattcaagcctaactattcaaggagctacatttcttatcagggatttcagacattcagagcagattgttgccatgttctaggacaatgctcctacatgataaaggaggtatttattttttgaataagataatactgtaatggaatacatatagaagaactaaataggttactacacaaaattgaatattgcttaaagaaatattaaaaagcaacaaaaccttttaatactatttttaaatgaaacataaaacattggatcacctatgaattcacttcctctctgtcaatattttatttctcgaagctactgaaaatacagctttcaaattctagttctggtattttcaatacagattttggtaccatcacatttctcttttttatctgattaatgagctactgaaatatccttgtagagcaaaaacaaaaaataccatttgttttcaatatagaattattttgttttccaagttcttaatgtatatgtgtattgatttgcctatttaactctccaatgacttgaaagttagacccatattatatacgctttttttataaaaacaacaacatcaacaacaaaaaaaggtctctcactctgtcgttcagtctggagtgcagcggcgtgatcagagctcactgcagcctcaacctggcaggctcaagtgattctcctgcctcagcctcccaagtagctgggattacaggcatgcaccaccatacctggataatattttaaattatttttcatagaaatgaggtctcactatattgcccaggctggtctcaaactcccagccttgagcaatcctcctgcctctgcctcccaaagcagagactgggattacaggtgtgagccaccatgtccagcctacatattctcttttttttttttttttgagacggagtctcgctctgtcgcccaggctggagtgcagtggcgcagtttcggctcaccgcaagctccgcctcctgggttcacgccattctcctgcctcagccccgcccccccccccccaccccgtagctgggactacaggcacccgccaccacacccgggtaattttttgtatttttagtagagacggggtttcaccgtgttagccaggatggtctcaatctcctggcctcgtgctctgcccgcctcggcctcccaaagtgctaggattacaggcgtgagccaccgggcccggccctacatattctttaactgtggatctgtatgcatacaataatgctttattaaacttgtattcatatctaacatttttcttaaacacacaatgtttagtgtgcagaccatgcatattcagtgaatatttcagttccttaaaatgtaatataatgtctttgtacagttcacagtatcataattttatgtggctatcacatcagattgctttttactgatgattccaaaatgaaaaaacaaagccactaacattacggctttcttcacattgaactaagtttaaatttgaaagaaaatatgcagtaatacaggactttataaagtattcctgatcaagggaattagaaagacatattaagaatagaaagaatttagtctcttttcctccttttttccccttcaagacaattgtctttgtatattgaataccagataaataaagaacccatattacctgctttcttttccaatagctttgtttatatctttcctgtggtgcctaatattttctctcttcactttggacataggtattttaatttgcacttaatatgtgacaatcattttgaaggattctcatctactgttacttgttaaatcaagctgtataaaattacctctatttggtcatttcagaactacaaacatttgccagcaaaacaaagaaaattggttttgaagaattttctaaaaagacactacactacccagtgacgcttcaccgggaagactacagatcctaccttttccttggttgagtacaatgtcataatgccaaatcaaagaaaagactttaagagtagcttcttaaagtaaaaacgtaaagagtagctttaattgtcacacctatttgtgcccaaaatccaataccttgtctcttgattatttccatgcttgtgaaaccaaggcaataggtccccagaacatgagggcaaggttccaataaaaaaattcctgtgacacagggtgcctatcaaaaaccaatactgctgactaactgcagatttattggatagaatgtgattgaaaatgcaatccataaatgattaaacagtagaatacagcaactaaagcagaatgactaaaaggaggtagaagaaagaaatacctttgaaatatgaactaaagcatattactaaacaactagacatacctattttcttcaggaacagaagagtagcaagaagagtatgttgttatcaagaaaaaaataaatataaaggtggctcttagaagagactttgcagaagctggaaattgagggaacagctgaaattactgtgatgctttggaaataattgccacaactgcagacaaaaagtacatgctgcatccagatgtacagttaaaggttgatgctaatatatctctgatacttgacctgttcactatttcccagcataccaatcttctctcctgttagtccttataacaatggactggatacactatccctacaatatgaactaccacatagagtcatttttttctgatttaattaaaagctccacgtaaaccaatgtggatgttgtaaatcatgccgagttgtggtacacatgcctctgtaatattaacagtggccccaaggctaaatttagctataccacattattaaatcctatgagtgtagctaacatcagaaaaatgttttgaaagcataaatattttagcatgaagatttaacaaaaatgtatttcatcatatcagaatatcaggggggaaaaactcactcatttataactgagccaaaggagagctgtttgcattttgccttgtctgtaacttggagatgtatcctataagcgttctttggtgagataaaaaccagtttctattttcctactaaaatatttttaaaaattgtatttacctggcactgattagtttgcttggtcttcagacacaataagaacatgtttaggtttcttcattaagaaagtaaatatagaatattccaaaaaggctttagaaaattcagcagaactaatgtaataaacatactcactctaacatgcataatagtaatataatttacattaaatggatatacaatattttatatttacttattttgccaactattgacaaaattttggaatttcgctatgatttaatattacttctgaatatatatattagtagatagattatatcattgatacttttcactaaataagaaagaaaaaggaaaattgatgagctagatgatattttagaaagcctcttttctttcttcacaaaggatattttcagtacacccactaccaccaccataactaagagcctactatttgccagttactataaacatatgatttaattttatcttcacaatatctgtagtgaggtatgaatctggggaaactggtactgtaaatgccttacagcttggagaagaacagtggctaggtatgcatcttctcttaagttaggataaaatcttcctgacagtgactttttctactagaaatattgatagcacaaatatttgcaaagagtcactcaaatatgtgcattaggtccagaaataacttgtcagttaatttttaagaaataatcatgtaagccccatgtataaaaggataatagcacaatcaggtattaatcttctcaaattctgtatgcctaaactttgcttgcatggaccttggggctcaagggcagctgtgtacttatgggctgcatctactcctttgtagcaacctcatttcctctgtgttttattattgttgttattgtcattattttgctaaataaatgtgaaattttattgtgagcattctattcccatcattatgttacctaccctagaacacctcataaacatgatttagcagaaagcaaattcacagagttgaaggaattgatcatactactctactgtagagagaaccagaatccacacccagctcttgttcaataatgcttctttaggtagagttgtttaaggctccatatgcaccaacattaataattgacattaagacttgaatcttacatggaggtaggctggatagtggattttttcattgagtgaccaattgttttgttttggggggactattgggtttcccaggatgtgggacttccagtgagtccaaggcaaattaggatggttgccctgcctaaagatgacattttgacataatctatcctagtattcggagtgaataagtaatatgactggccacatgaacttaagaaaataatattttgtattttattgtatctcctttgttagagccagtaacctataaaagcaaattgtcagtaaatgatcatggagctattctaagccacaagttatatgtgactagctcaaaaatcatcaagaaattgtaaaatgtatttctaccaactgaattattgcctatgataatgcaattcttagtatttcactagaccagtaaaactctgaaaagaaccaagctgtggtctacaaatccataatctagcaagtttgaaaattaaaaattaattgttcttaggagtataaaaaatcctattactttattttagcatatcctcgacccaatctactgaaacaaatacaaaatacatggtctggacttttgcaagattttctaatgaataattattttaaatttttcaattataatctaacagcatattaaaaataatacatatttaaagttagaaaaatataatcaatgaatatcctagatgtttgctaaaacacagattatttgatatggtccaaaatatttgtattgtgagatggcttttagtgttgtctttcatttgactaaggctgtttattgtatctggattatgatatcttctgggagagttactagtttatggggtatatttatgttaagaacccatagtttcaagatacatttgaataaagaaatacaaaaatttcattggtaggacaacaaaatgcaccaatgtagggcgatctcagcaacatgcaaacttccttttatgacagtaatagaattttaaaaaatctgggtcatcttattgctctggatactgccttaggaaaaccaaagttgaaacctcttaatgaccattgcttctgttcaagatttgctgtcttatcatcatctatatttttacatttctgaagttacattagtgaaaataggtcatatatgtgcttgattaccttaggaaatgacagagcactgaaatgaagaatctgttgaatatcaacaaccacaaccttgcaagtttcttctatttcctaataaaccattatcaatttcataaaaaatattttgtatttatgttaaacatttgttctcctaataggttagatataaatatacctagaatatgagtcatttctatagattttagtgggaaatactaatatctaacatatgcagtgacaaaagtcatccataaaatgatcatgaacttatttcaagattaatcatccatgattgaagctataccctgtaggcagaacaatgctgtccccaaaagatgcccatgtgttattatttttgaaaacaaaaatgttttcttcatttttaagaaggtgaaaaataagtttagagaagctaactattagtaacatcataaaagatttcagaaccaaaatttaaaccttatacttttgaatgttaaaacttatgcaaaagagttacagggaacatcttattctctatatctacaatattctaataagatttgttgtgttccattattggctgtagtagtaaacactgttgttcagataacctggattattatctatgataaaaaattattaaagcacccatatttccaatattttagcgcatgaaaggtgaaaagtccaatgttttttcttccatttcacatattagctttgccctcactgaaaaagaaactcagggaaaaaaatccaagaataatgcacaagttcactgacttatcatttatgtccctgctgtaatcttttgacgatgcttttaaaaatccatgatgtataacaggagtgatatctgtctctccctaaaatttcatcttaccttcttcctttagagttgtgttctttgtatttccccaaagctaagaatacaaggccataaatgttctcaatagagtcacttctttaatttgagttctcagtgaggaataggctctttaacatatctgactcattttcttgctttgatttagcatatattataaacttatgtctgaaattttaaggaaaagcaatcctaaatgcaaagtccacattcagtaatttgggagtattatagactgaattgtgtctttccctccaaattcatatcctgaatcctgtctgtgtgactgtatttggagatagggcttttacagagaggtaaccaagggtaaatgaggtcctaaggatgagactctaatcaaatatggctagtgtccatgtttgggacactagaggaagggacactagagctttctctctttccctccatgaatgcacagaggaaaggttatatgaagacacagcaagaaagcagccatccgcaagccaagaaaatagccttcaccagaaaccaaccctgatggcaccttgtaaacttttgacctctagacctatgagaatataaatttctaccgtttcagtcactcagtctgtggtgctctgctatggcagcccaagctgactaacataggacatcatcatacgtataccatctattttcacaaacctaaatagtccttaaaaactgttattgatggttaactagcatatctagattctaataaatgattctcttgattatctagatgctatgaagatcatctaaacacaagaggctagagaaattcatatggctaaggaaaatggctgatgttagtactaaggtgcaagttacggcaaaatctttgctgctacttcctcttgcacttacactggctgtctatgaccataggtgtagcatatcgcaagagaaattgtttttgtattttgtttcatgcccacagctatcaaaatttatataactaagatattttctttttcataaggcttaagtaagttagttaaattcctctaaacatgaagagaactatcatgaatagataacagtataccaaaggttttatactgaaattcacaacaatttctggacatttatatcataactttcctaagagctatataaaataataaaaagagataatagttgcctaacataggaaacaaagacgtttcttgacctctatctttttccatgaaaatttattgagacaaaaagaaaaaaaaagagtagaagagaaaggaaaaaaaattgaagaataagtgagagagggagggaggagaaagataaatattttccctctatttctatagccagtaatacttttatggcttggtttcttgaattaaatcccatttaaagatgatatcttaattagataatgtttataaatgctaaggtagagcagactaaatcaagggacttatataattaggccaaatgagccacacctatcccttttttatacacttcatcataacctctcaagcaggtaaaaaatatgtttttcatcctaatataggtaacctacttaattcttatttgcctttgaagttgtgagacatcaagtcataagtgcttgaaattcattaaaataaataaaacttgttttatcataatttctatgtgtcctagtgttggtaacacacataatataagaaatttaaaataatttatactcagttatcctaattatgataatttcaaaatacacctatattaccatctaaacttataaattttaacaggcttattttaataaactatgagaaatacagctacattaagaatttaccaatcaagggagtatatattcatggcaatttgaatttatgctcccaggttaaagatatatataaattttaaaaataatttaccaatcaagaggtaagcccccttttcatccaaatatgagtagggaaacaaccaaaacaacttctagaccctcctaagcactgtgtcaattggtcagggtgcatgacaataaataaataaataagtcactttatcttttataaaattctatgaactgtcttgataaattttaagacagctagattaggtgtgatacataatgacacttctgtggcaggagacattttcatagcatgccaaacaagaaatgggagtcaacaaattaattaacactttctctggctgatatacaattatgagttccaccacaatgctatttcacagtaggaaagttaagaaaccacatcactggaattctacagatgacattgactttatcatgacacctagacactgcctttcgaagcagttctagataattaatttctattcacaaaatggaatgggctcatggaaacagtaggataacaaggactacatattattatcatccaaagtaattatttaaacttgtttaaagtgtatacattgccaggccatctgccaggaagtctagttcagcaggtatgggatggagccagaaaacttactccatggtgtaactgttctgcagtaagaactttttagacatttttacttctagtatacattgtttccatctttacatcctgtatcatttgggcattgtgcaaatcaggtccatagactgactgcaattaaaaagttgatgtgattgtggagatgttccagtggcattttgtctctaccaaaagtacattgattagccaattatttgacattcattgaaagaataatttctaaagtaaagtaagacttttataaacatattggtttacagagaagattaacgaaacatattacaatatgtataattttcttctttcaataaggtacacattttccttgacattttgcaaaccaacagtttaaaatacagtaattttacgtacatcacttagagattcaaaacagtaagaatcactaggagcaactgactttcacattgattatagcaatggtaacttatgttcctcttccactattaaaagagcaatgaaatatctcgcatgcaattacttgtagtttacagactcatttgcatgaggatgttctaagcttaatttataccctgtgtattttgaaagctacctcatttatttcacctatttgaaattcacaaacccttccaactatgagcaccaccagatggaaaaatttctgaagtgaacccagtttgaatgtgtaaagtatgaagcatatgacatgtctgattacagttactgaagagttgaataggtactagtttatatttttaaactcaattacttaccataattctaatactcattttgcagtgaacatcaatcaaaaactttgtgagataatttataaaggtgaataataggtttttatgtttgcccagtctagatacatattagctgaaaaataaaaaatgcaacataaagctgaaaggttaaataaagtatctctagtacagcactcctgtgacctccatagaacaggtattcaaagactgttttctaagccaaatttttttttttaataatcacagaaataaagtcatccagttactttaaaagatctcaggaattctatcacttttcctggtaatcttccccttttggctttaaggtatgaagtccttatttattcctaacaaaacactctggctgagatttaagttcattttctccatctctgtgaaaactaagaagagctgtcagtctcctatttagaataactcttcaaacactggagtcaatctagtccccattccttatgagctgtgggaccttggaaaatgataaaaatcacatctacaacataaaaatattaaatataattttattggttatctttgtctttaaagaatttttgcataagtcaatttagttcattctcaaaacaatccagtgaggatgctttaattgctgcaggacagttcattatgtgtcagatgatagaaaaatacatgacaagaaaaatctacctgtttatgttcctatagttataaaaataaactgagataaaaacactaaagattttaaaaattaataaggcactgctaaagtgcaaagtggtaacttaattaataatatatactagtgtttttttcttcctcattccatagtaattcttttattcatcccataggccatactttcattttatttttaattttctctgtatctatatatttcaaaaaaattaaagaagctaagaaaaacaaaattagttataaggcacaatacatttcatgccatgaagaataacataattataaccagttcttatatgttaacctgtttattcttgtttctcaatatccaatttccccttttttaagtcagatgagattaacttttataagtgctaagtccactaagattttatatttctatttttttctgcaacataatttccatcacttttttttttttttttgagacagtctctcactgtcacccaggctggagtgcagtggcgctatctcagctcactgcaacctccacctcctgagttcacgccattttcctgcctcagcctcccaagcagctgggactacagtcgcctgccaccatgcccggctaatgttttgtattttgagacgaggtttcactgtgttagccaggatggtctcaatctcctgacctcgtgatctgcccacctcggcctcccaaagtgctgggattacaggagtgagccaccgtgcccagcctccatcaactatttcttatgattattgataaagtttaattttctctcattgttcttgtattttaatgacttttaactatacgaaatagagcattctctagtttttttttttcttttattattatactttaagttttagggtacatgtgcacaatgtgcaggttagttacatatgtatacatgtgccatgctggtgcactgcacccactaactcgtcatctagcattaggtatatctcccaatgctatagctccccccccgaccccacaacagtccccagagtgtgatgttccccttcctgtgtccatgtgatctcattgttcaattcccacctatgagtgagaatatgcggtgtttggttttttgttcttgcgatagtttactgagaatgaagatttccaatttcatccatgtccccacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatcccggaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagataagtaggttgcgaaaattttctcccattttgtaggttgcctgttcactctgatggtagtttcttttgctgtgcagaagctctttagtttaattagatcccatttgtcaattttggcttttgttgccattgcttctggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacttatggctagccaattttcccagcaccatttattaaatagggaatcctttcccccattgcttgtttttcgagcattctctagtttaagacaatttaaatcttagccaaaatcagtgttcctccattgctgaaccataggagggtcccaataagtttctgatgaatagaaaaataaatgtataaaacaatgaacattttgaaatcttggcaactcgatggaacacatgttgatgaaccaatgtcatagttgactttttaaaatatattttacaataaagtcctaggtttaatctttttatcaactgagttagttggatttgctgaccagctctttgttggaagaactaataaagtgtgtttcacatgctttatacgtatccactcattaattctttctacaacttcatgagtttatgaggaaatcaggcaaagaagagtaagatgacttgctcaacaaggtgcaaaagctagtaagtggcacaagcagagtctagacccagacacaaaaaaagcccacacttttagagatttttgtttaatgggaaaagggtctttaaaaatctttagtctaatatagttacttaaaagtaaaaacttatatacctaatgtaaatgacgagttaatgggtgcagcacaccaacatggcccatgtatacatatgtaacaaacctgcacgttgtgcacatgtaccctagaacttaaagtataataatatatatatgtaaaaatttatattgatatgaaaaattggagtttctcaaaaccagttcaaattttaatttattaaagtaattctttatgcacattcatacaaaatatgtttttctcatataccttctctttgctctttcatttatcaatttcttctaaatatgtttaccgttattctggggtctatattattgaacaaaggctaacttaagtttcaatcctattaatgttttcacattttctacaaaaatattgttctaaaaacatctatctgaaattacctattagttttcttgacttgacacaaagtaaaagaaagtttcttttacttaactttgaaagcacaaaactcatttagcaacttcaatcacgaatttttatatgtagaatctagtatttctcaagaatatttttgaacaggatatatgctcgttagtgacattttagaatgcaatactttaaagagctataattttgtatgttatacacgtaaacatattacatggagtatattacaatgacattttactgtgtccatgtatgaagcttttcagatatcccaggattttctgggaataaaggtgcttattcctacatacaccgtagaaatcatttggtctttaaaaaagttaaagagagtttttaaacattagttgtagataagatacatgtaacatacagagataattccatacctgttttattggacagtctaaacgacaccatcttatcaggaatattacatacattcctcactgaagcaatgcagctataattagcatagtcctgaggtcgaagattctttagttttaagatctttgtttcaccctgaaaatgtacacaaaaaataaaagtcattagaaaaagccaacacaaccagaatgaatgaaacatcacatcacattacattgtattaaatcatattattatcagaatatgacagactgtctttttttaagggaaatgtcctatctttcaaataagttataaatgaactaactttaaaataacactgcattttaaaataatactgtaatattaagtatgcctggagataaaaactaacagactacaatgaaaattcataacattttctttgcaaactagcttcctcaggggaaaagtctatttctggtggtagttatgcaaattattatgcaaagatcagagcagtgtacttaataatggagtgcattcaacaaacactgcaatctattcagacatcgatgtgagaagacaaaagaaaagaatctgaagaagcgccaacaaatgaaacacggttgttagaacaaagttaattacgtaaatctaatgatagataattacatttataaacataaatattttgtatatggagcaatgacaggtgacagatctaaaactgaaggaaagaagcattcgtgagtgtttctatattattattgttcttgttatttcatgttcaagagtttaaggggtaactctccaggtaaatctgcacaactgtagatagatgcaaatcaagcaagtggccagaagtatctaacaaactcttgatgaaccaagaaagactttgtaaaaacattggattgaaattgttgaaaggaaaaaaagaacaaacaacaaaacgtagtctcctgcccaattcaaattaggtcccctgggctttctttgccttctaaagtcattaatgcatcatctcaaaatagttcttcttgtaaataacttacttattttaatggcaaaacagtgtctcaatgattttatagtattagggatactataaaaattcaaaatgtttattttttccagataacgtgtgtacggaacaatgtgtttcatcactttacctgggtaacatttgtcgagttctaaaacttgcaatactttcatatgttatagaggaggactggaatacttagtgacttactacataaaaacactgctgttcatttgcaagaaagcttacccagacataggcacacagttttgcaaatctgtcaaatgaatctctattctagtgtgcatggaattgtggccataagtattttcattcactgtccaaattcagtcttaaatcagtcacccctttagcattttcctcagtggtaaaaaaaaaaaaaacaaacaaacaaaaaaaaactacctttcaatttttgtttagaagaaacactgaatttttaacttacaagaaaatataaatgtatccgatacaagtatacacataaatctatatgtttctagagtttatatataaaactattctcttgtgttacagaattcccatacatgatataaaatgcctagaaagtgggcttagctagaaagaacagttgaaagaaaatgatatgctagaattagtcaactcagataatttttaaataaagtgatacatcttacctctcctacctttgtcacacgtattgctcaaatttctttgcttttctttctcctctcaatacgactagtgttattccttggaattctacttgttccatagttaacctcactttataacatttcattaggtggcattatccttgctgatgaatttctactacaagctctattttcttgccccactcccaagtctaagccccatttccagaattctcccttaagtttcagatacacataacaaatgtttgtcaatatgtccattctgatacttcagacacatctgaactcaacatatcctaaattgaacttcaaatatattcctttaaacctactcctccttctgtaataatgggaatttacacccaattataacttcttattcatacattcagtatctctgtctctcagctagatccttttattgatctttactcatgttcaatcccaattattctttgtatctatttttaatcataatgctctaaaccctacaatcaactaaaaaactcatgattgtacttagtatagcttaagaatgcaagcaagccacaatgatttacactttaaccaatatttttttcagctttattgaagtataatggacaaaataattgtatacatttaaggtatacaactgtgctttgatatacattgtaaaataatcatcacaatcgagctaattaacatatacataacctcacataattatttttattcacttgttaaatacatgaaatctaattatgccatctccttgccagacttctccctttgccagtaagtacccagagagtagagattatgtctgtcttgctctcagcattatattctgggcacgtgacacagggcttagcagagaggagacaatttttaagttaatactttttcagttaatagtactgtaactacccaaggtttgctttatatatatttatttctccagaatttactatttgtttggcactggtataaactcaatataattaaatgagtaaaatataatcagagcctaaatacacttaagagaaaaattcccttacattattacagataatcaatagatatttgtgcatattgtaaaaaagaaagtgggtctgttactctagtaatgatttatctagattgtgcttttaggtttggaaggaaatttgaactgaagacaaattatcaggacaaaactcaagacaaaacttgagccatatcaaaagaaataaaacaaatgaaaatcagtagaattacaactgaaaaaacacatggatatagatattgatgatatataggtacagatacatgcagttacatatatatgatgatataatgaaacaatatataatacatgcaattacatatttatgtgtgtatatatacacacacacacactatatatatatatatatatcacacacataattactccaaaaataaccaacctctaatcattctgaaagatttactgcatgtagtcaatattctaaaagcaaccacggagtgataatgattctcagatataaacaaataatgaacattgtcatttagatgtatatttaataataaagtctctttactcacatagagttaattatactctgtcagtccttgtttctgtttccactgacaaattctgtttcaatttgcattttctgaataatacttttccaacattccactgaaatagtacctagtaatttcattaatgatgatgatctcttgttaaaatttaataaacctttcttttgtatgcttccatacttctctgcttatttctaacactttagattacctttactactgtgacagctcctcgtatataggcaattaattacagatataataatttagtcatttcttggttgttttaccattgaatattctagttactgaagtctgcaaccttttactaatatattcctagtgaaatctgatccattatcatggttccaatgagcactaatgtatagataactgacaaatctctagacaaaaagaaaaaaagcaaacttactaaaaatcaccaatagtattataattaataaattctagattatcctaatttttcttgtccttggagttgcaatgtttgctagcatacattataggacatacttaaattttggtctatcccactcaacattttccccaagaagaaatgtagtctcttatccttttggatctcttaagataatctatgctgcatttctaattctcttttctttttttttcagggggtgggcggggtcaaggtttaagggctagaaaaccttgaattgttccccttcactgaaaggtcatttcaaaaaccgttagtttgtcatttgagactctatgcagtctaagcaaaacactttttccttattcctcacataaactcttcattctcatcaaattagttatgtcactatcttgaggtatctctttatgatttcctaatgctccccattccttgctatgagtcatttttttgttcctatctgaactgatgtgtccttcaaaaaatatattgtgactggagtgcagcgcaacaaagagcataaaatgagataagatttcaaagcttggaaaaggtcatattagaggggctatgatcgcagatttatatttattctaaagttacttattctgtgtttaacgctactaatctcctctttctaatttttttcaccaaggcttgctttctcctcttggaagatacgtcaaacttgatttccaccaaccctaattctccatttcaccaaacaactctactctccagtctttttgaattttatctgacagccattatttcaagaaagtgttttctctctttttttttttttttttttgagacatagtttagctctgtcacccaggctggagtgcagtggcgcaacctcggctcgctgaaactctgcctccaggttcaagcgattcccatgcttcagcctcccaagtagctgggattataggtgcatgccatcacactgggataatttttatatttttagtagagacgggatttcaccatattgaccaggctggtctggaactcctggcctcaagtgatctgcctgccttggcctcccaaagtgctgggattacaggcatgagccactgcaccagcctcaatatgaagagatttcaacctaaaagctcttacttctgatccatcctctaaaagtgtattcttcctatacgtattctcctttactttttgagttaatgcttttgtctatttatatcagtcacatttgtgtatatatttatatatgtttttatcatttacattatgtctatgtattgatcctgcctttccatttaatgagatcacttcaaattctcttccctaccatttgggcagtgttttgcatgttgtcaactcagaaaagattgctgactagataggaatagagcacacagtaaggttttagtaagcttcctgaaccatgttgactctaatggtagtaataggaactttaaaaatctttacattagggtagcctgcaagatagatttatgaagctgcatttggggccacccatagcagagctgaacagtcaattatggaaaagagaatgtaaaagaaaggtaagccccaagggaaatatatacaataatcaagtacagagaatcaacatcaatgcagctctggccattaaaatgcagaggtggcttttgtaaaggatgcatccttaaaatattttgtatacctgaatttttttggtcatggacactgctggtatttatgttatctaaaggtaaaaaatatgaatttggtggtaatattgatattacaaaagagaatttgtgctactgtttgagatgatttctattctttaaagacctacaagtgtggccctataaatacaatggtatgcacatccatatcctagttaattcttattcagagcacagcaacaaaattggcataggagaaggtgctatagtttggatgtttgtccctaatcttcatgttgaaatttaatcccaatgttggaggtagggcctaatgaaaggtatctgggtcatgcgggcagacccctcatgaatagatgattaatgtcctgaggggggctgtgagttctaactctgttaatttccttgagagctggttgttaaaaagaaatctgatacctccccctctctctcttgcttcctctctcatcatgtgatctctgcacataccagctcccctttgccttttgccatgagtgaaagcagcatgaagccctcaccagacgcagatgccacatcatgcttcctgtacagtctgcaaaactgagaaccaaataaatctcttttctttatacattacctaatctcaggtgttcctatatggcaacacaaaacacagaacacaataacaaaatggactgtaaagaatagacaaaaaagaaagaaaagcctctagagccatgatttcccaatggttcagctatcatgggattggagagttgttctgggtgagttaaaatgatttcctgcagtcagaaaacaagataccaagatatgtgaacctagagggcccaggtaacatggtctctaagttaatatgtaagattaatgtatataccatgccaatgggagagtgggtaatacagatgaagtctgttaatggaatattgtttaaaataacagaattatggaaaattttgagccttaccttcttaattcatgacagtcagcatataataaaaatattttaaaacaatacagcagaatgtataagaaagcagagaatatgtgcacacatagattaatgttatcaaatggcatatatgtatacctgtgataatgagtataatttaggctttactatttataactactttaacattaattttattttgttgatcatttgaatttgatactttgggtgttgggaggctttttgcaagtgaattttcatgatttgtaaaaaggaattttgagttgattattgtctaattgtataattagtctaattagactaattataactaattaggtaattgatgtaaatatgttcagtcttgtaattagatggtataattacaatacacaagatgatgtcatgaacatctttacaaaagttctagactaatggaaagtgaattttcaatttgtaagatttaagcaattgtttaacatttcttaaacaattacaaaattatctgcaatacatatatttaacttttgacattattttttaacaaaagaaataaaaggaagacatacaatgtatattagttagtggcccttaccaatgctgacattgctgtaatgaagcagcctcaagccgtatttccatattacttataaaataaactagaactttaaaaaaattatattcattcattttgatacttagatatcagtaaaaactaaagtctgtcaatttagattcattttatgaagctctaatgactaatttattacaaatttataaatagaaaatgatatatgctggcctatgtcttttagtagtaagtgagtggaaggacgaaaagtataattattcgtcttagaaatactgcattatgtgcttatgaattcatatcagctttaggaacacagaccaatttttttctggaaacattgtctataaaaaggtataaacaagatttttgtcactcaacagaattcaggaataaatattcaattcaaattgctatagttattaacatataatgaatgggtatacaaaatagatatatctcatcttagaaattctattttattaaaaacaagacattattattaaataacattattattgaaaacatatcttcaaaagaagtttcattttctaacattaaaacttaagtagacatatgatctattatctgaacccttccaccatatatacccagtatgacttcccagcttcacagttccctgttctccacacatactaattattgttctaactaaccagagatacagatactctttggagacattgtctttcttctgcattacttgcatgtgctaatgtctccaccttgagtgctccctccatagcagtgttgtgtagctctatttagacaacgatttttattttatatcataattattgatcaccttaagttttcctttatatatcaacaaacattagaggagaagccttgcctagtgacctctgtgtctctggaaaaggtatgcccatatcttgaatatactagatcttattttaactgaatcttatttacgtcatgaagccacaaaggtcaatgactatcaacctaaggagataaatttaaaaattaaaatattattgaagtgctccaatacaaacaatactaacataaaagtttttttcattatagagtacacatggcagtatgggaaacagtagttcaagaaatcaataacatctaagaagtatatatgtatatgtttatataaggttatatatacatatatacacacaaatatatatgtgtatatatatgtatatatatacacacatatatatacacatatatatatacacacatatatatacacatatatatatatacacacacacacatatatatatatatatatacacatatggagagagggagagagaggcataaaaacactagcacaataagcaaaagataaagtaaacagggaaagagtaacccaatatggaagtataaaaaggaaggaatgagacatcatatcagcttttcatagatggcttctctgagatgatgagtcctcagtgttaagaaggcctctgccatattatcaaactaaagaatacctagaaataaatttaaccaaggaggggaaagatggatacaattcaaaccatcaaacatcgatgagaaaaactgaagaggatacaattaaattggaagatatcacaggttaatggattggaagaattaacattgttaaaatgtctgtgctatccaaagtgatccacagattcaatccaatcttgtcaaaataccaatgaaattcttcacagatattggaaaacacaatccaaaatttctatgaaaccacaaaagatcccaaacagccaaagcaattttgagcaaaaacaacaaagttggcatcatactatctgacttcaaaatattctacaatactatagtaaccaaaacagcatagtactgacataaaaatagacatagagaccaatggaatggaatagacagcacataaccaaatcaacacacttacagccaatgaattttcaacaaaagtgctaaaatctcacattagggaatggacaatgtgtcttcagtagatagtgctgggaagcttgaatattcacatgcagaaaagtaaagctagacttctatctctccgcatataaaaacatcaactcaaaatgaattcaagacttaaatgtaagacctgagataacacaactactagaagaaaacataggggaaatgcttcatgacattggtctggggacaggcaactgaaacagaaatagagaaacagaattatattgaactaaaaagcttgggcataggaatggaaacaatcaacacagtgaagaaacaacttacagaatgggagaaaatatttgcaaactatgcatttgataagaggttaatatctagaaaatacacagaactcaactcaatagcaaaaaaaaatctcattttaaaatgggcaaaagatgtaaatagacattactcaaaagaatacatacaaatgaccaacagttatgtgaaaaaatgctcaacatcactaattattagggacatgcaaaacaaaaccacagtgagctatcacctccctcccattagaatgctattatcaaaaggacaaaaaataacaaattctggtgtggatgcagagaaagaggaacacttatacactgttggcgggaatgcaaattagtacagccattatggaaaacagtatagaggttcctcaaaaaattaaaaatagagctataatatgatccagcaatcctactgttggatagatccaaaagaaattaagacagtatgtcgaggagatacctgcacctccatatttattacaggactattcacaatagacaaaatatggaataaacctaagtgtccatcaacagatgaatggataaagaaaatgtggaatatgtacataatggaatactattcagctatgaaataatgaatgcagctataaaataatgagtgtttattttacctaatataatgttctccagatccacccacattgctgcaaatgatgggtctgtcccagagccagcaacatggatggatctggaggacattatgttaagtaaaataattaaggtacagaaagacaaatactatattatctactcatgtgtggaatctaaagaagttgacctcatagaattagggagcacaataatcattagcagtggttagagagagggaggtagaagggagaatagagagagattggttaataggtgcaaagttacactttggaggaataaattctagtgttctattgcagaataagttgactatttaacaatattgtattgtatgtttcaatacagctagacgagaatgttctgaatgttctcaccatgaagaaatgataaatgtatcaggtaatggatatgctaaataccctgatttgattatgatacaatgtgtagacatgtatcaaaacatcacaccataccagataaatatggacaattacaatgtatcaattttttaaaagtttgattgtgcttgtttaataaatttaaaataaattcctaaatactttgatagtatgaaagattttccaaaatctggccaaggcccctgtgttcatttccaagtgattagacccatttgcaggttagaaatagccatatagccgggcacggtggctcacacctgtaatcccagcacattgggaggccaaggcaggtggattgcttgaggtcaggagcttgagatcagcctagccaacatggtgaaaccccacctctactaaaaatacaaaaattagcccagtgtggtggcaggtgcctgtaatcccagctactcaggaggctgaggcatgagaaacgcttaaaccctgaggcagaagttgcagtgagtggagatcatgccactgcactccagcccaggtgacagagcaaggctccatctcaaaaacaaacaaacaaacaaacaaacaaacaaacaaaaagaaatagccatatagagaaaagatgtttagaatttcctcattatctataaatgttatcatgttttacaagattctagaggaaaacatgttttctaaatcttaatgtccatattttaaaaataaattgacaatagaaaaataaaatatgtaatagatgatcatttatctggataatattttaaactaaaaaaatcattttagtaacaattggagaatgcattaaagtactgcggaatgtatgggggaaaattcagtcctgcctgctggcagagaacacttagtatcatagtggcctaaatcaagagacgatcagattagaacaggcttcgtttcagtactatgttatggtgaactgactagtaatacatgtgcgatgctgatttccagagatttatattttggtaagttaaaactgttctataccttttaaaaaataaagaatacatattttaatttacaatctatttgcaaaacaggaatatatatgatgtgtgcagatgttatcatataatcactgcattattccacagttaatgtctaaatattggcaattatactaatctgaaggatctcaggccttagtttaccatataaggaaatatattcaatggtgaaaaatgggatcctgagtagctgggattacaggcacgtgccaccatgcccagctaatttctgtattttcagtagagatggggtttcaccatgttggccaggatcatctcaatctcttgacctcatctcagcctcagcctcccaaaatgctgagagtacaggcatgagccaccacgcctagccaatttatataatttttaaaattatttttcattatcacaatacttttgaacatttgtccaaatttttttttatttaaaactttttcattgttaatttaggtttatgcttctttcatcaaaaaacctttataataacagcatgcaaatattcccacgaatttcaatatcttcctcaggacttattaattccttactctttgtgtattacacaagaatatttcatattacgctcactttatgtaaaattaattcaacttttattaaatacatttttaatgactcgttaaatattttcatttttagcataattaaagctctatttctaaaccaagtcaaaaacaaacatgactaaaggaaattaaagacatatctttcctaaaactaaagccaaataaatttcaaacaagtttcttcatttttttaatagttattcaccatttgcaaatggggaaatcaaaatctctccttttgagaaatactttccacaaaacccaaatcagctagcaaaatgtataactatgtacattatagtgaaacataggaaaacttatagattaaaaaaaagttaggacatagtaagttaaaaaatgttttcaaaagttaacattttaaatttaactaaccacataaaaataagttgtcctttatatttaagttctctaatctttaagtcaagcacacattggtttttgaaaggccagaatagagaaactatcttttcaaatagctatgaattcatgctgcctgaattaggaaagtatcctagcagagtagggtggaaatactgtaccttaattcatacctgggtaaagaatggttcataaatctcaactcctttatcagatccttgcagcaagacctcctggccacgtctccagctataccgaacaggaggattggaattggcaacacaccggaggaacactgttctctcatagtaaaattgttctttagcttcacctatactttgatgaacagttactactggatcatccaaatctaaaggaaataaaaacaaccaaatggcaatgttatgagatagatgacttttaaagtattgtgcttatataacccaaccaaaaatgcatattcctcattgattgtattacttaccactaggtactctttttttcactcagcttattgaattcatttacaaagacgtttccaatgataagaagtatattagtatctctatttgtggatatagtaaaattaatcttgtatatttctaactctttgtcaatagccacataaaacagagttccatgagagagataaaaatttacaacactcaaattcaagagcttagccaaaacaatgaacctcagtgacaaaaaaaaaattaatatcaggctgcttgacttactctttctcttttttctttttttaaaacagagtcttgctctgtcaaccaggctgaagtccagtggcgcaatcagagcttactgcagcctcaacctcctgaacccaagccatcctcctacctcagtctcctgagtagctgagactacaggcatgtgctaccatgcccggctaatttttttttttttttgtacagacagggactggctatgttgtccaggctggtcttaaactcctggcttcaagcgatcctcccacctcagtctcccaaagtgttagattacaggcgtgaactactatactagacctctttgtcttaatatacttctttttccaattatttataacttatatattaaaaataatttaaaaattacaaatgattagaatatgtatagtaccaaaatatgatcttgcacaggactaaatgttatctcaaattttatattccagattatatttgttaatttgaagagtgctaaaaggcattattaaaaggcactcctgtttctattactggatattggaactaattatgtgtcattttgcatgtatcctaaagaaagactgtacagtagaggctcagcattttctgaaaaaggtcaattcataaataccttgggctttgtgattcaaatgattgtttcaactacccatctctaccattgcagtgtgaaagcagcaaaacacaataggtaaattaataatgaatgttgctgagttccaataaaactttatttataaatacagacactcctcaaccagctttggctaatgggccataatctgccaacccctgatatggcatattccaggttcttttcttaagcgaaagataaattttaaaagtgtacttcccttaaagcagcaagcttttagttccatgtgctagtataaacttagtatatactttaagtatgatgcaaaacctgctgtgttcattaccaccttcacccagctttaccccttttaattataaccaagaaaggttacttaactttggggtcttcaatttccttgtcagcagatcggaatgataatgataccatattatttaggctgttgaaggattaaatgagatagtccataaagccctggacacatagtattaagttggtgcaaaagtaatttcagtttttgacattacttttaatgaatgcttaataaaagttggctattactattattaataatattactatcattattggagtctcatttaaactcctattgattctatgctgttttcttgtttttatttcaccaattcataatacattcaactcttattataaataggtaaaatgccacttgcccattgtccagactatcaaatgcttctacatgacaaaaactttaacaaaggcctggaaataacctacagtatttatatggacataagaatagtgaagtgtgtgagcatatgctaccctgaatatttaaaagacattgttccttagaaaagattctctctgatgtgttaacataataaaatgccaaccaaagtagtgaagtaatagctaccttagagaatcaaagtaaagaacagaatccaaaatttccccattttttaaaaagttttttttcaaatgtgattcacttgacagccctactttgatttctagttttgcaacattctgagggctttttttcttccaacatcagaatattttcacagctacctcaaaggcctctaattttagtagtttaaatttacagaacaactgctgctttttggtaaagcttaaaggaactttccatttaaattcattctattagctgtgcagcgatatatgctgtctggttttattaagttcggatatttagggataccagcatcattatcataaaatgttttgagatttttaaaacctatcaaatattcattaatttggtgattagcctttcatatacatcatatatattgattaattgaatttagccttagtgacttgataaaagatactctgattcaattgtaaacaatttactttttttcttgttcaaaacataatctctttagtcacaggctcatttttagaagttatgagctgtatgtgttgtaaaaattaaattctgaattcagaaagctcaggaacaaaacagaatttgatggtaaacagtgtaacaatgatgacttccaaacagttaataggtttgtactttccaacacccatttcttgatgtatccccagctctttcttgtcaagtggtggtgtcaacagactcagtcaggaataaaccaaacctgttcttccctggtctggatgacttttgggtcattggttttcaagattctaattttgtgacaatggcttatagtattggctaggttatctgttgaattgactcatgtttagaaatttctaagtgttttttgcatttcagatttaaaaacaacatgccaaaacaagatttgtttaagacaagtgaaatgatggcacagctaaaaatatacaattttaagggagattatatatgtatgtttgtgtgtgcccacatgtatgcccatgtgtagatatacatacttatatatataataatatataatgtaagtaatttatacacacatatcacttaaatctattttaatatatattctttatattactaaatatatattgaatatttgtatttgatttaggacaggtttctgagaaaacagattcagagatgtgtgcgcagaaatggttctgggaagtatcttacagatcaacacatatgagagagtgaaagaagtaggactgatcaaggggagggttgaactacaaaaggtctcagtagctttgcagaactctctgagctgtgatatcccctcaaagctgccctgccctgaggcaaaggggctaagcctttatacaccgaccacctcccctatcaacaggtcattcaatttgtgctactcctcgctaggagacataaccttgggagggcctgctctgtttggcttatttctagagagagcaattttacctgatagcaatcatctgttaatactctcagcagcgggaggaatgagtgcttcagttctggggaagggatctaactggtgcactgcagtatccagtcagatctacttgctaggtgtgataaatctatctgtgaaaagctattccaagactctggttagtctctttctgggaaaactttcaaaaggaactatagtaggactatatccatcatctccttctactattgccattctagattcctctcaccctgcgctagtacattttttggtataggtagcttacctagttgcattactagaattttgtcagatttgagcccttgatcataatatcttctcaaaccaaggctgatgtacttgtctgtttatgaccaaaattgaacaagagaataccgagaaatgactcactgcattaactgggtatcaaacatactgtttcctgcctcactatgtaacaacagtcctaccaacagcctcatataggctggtcactcccaccaggatagtgactcctcttgtctgctgcttcctgacacagaagcctaaagttactgagttgatgctatggcttaaagattaatgggactcttgctatgtcacttaatagaagctttttccctttctgggaactgggacctctaaactggcagagcccagagttgcgggaaggaaagcaatcctccagtaggtcactggatgtgatgatagtgaggtcacttcttggttcttggacctggtattctataaggagaaaaagcagcatataataatggtcattgatttagaatttaactgcatcatggagggtagcacccactccttactgaatattttctctgtaagactcaattgccctctctaaaaggccattctatcgctctattaagttggcatttttagttgatgtagtacgtatgaccagataatccatggcaatgtgcccactccagaatactgatatccaggtcaatctggatcctgtgtatgacatttctcaaagtatctcaggagtccattctccctagtgtatgattattcaagtaaatggatgtaggttttttatagaaagaaatgagagaataattaccacatacatttgctatggtgtttcggggttctttctggtgattcagttgaagttttcagtcaacgagctcaaaatctgaaaattgcctcaggtacagaaattggacaaggatcgtggcttttcattagacagccatatgcagactcttactcacccatttttaatttgtgtagattgtgcaatagtttcttggctgtccacttattttcccctagagatgctgtgttctgttaaccatctccatagctctctgtgattctggagtcttagatatatttgaacaagccattcattaagataaatgtgcctggctgggcacagtggatcatgcctgtaatcccagcagtttgggagaccaaggttgggtggatcatttgaggtcaggggttcgagacaagcctggccaacatggtgaaacccatctctaccaaaaatacaaaaattagccaggcatggtggcaggcacctatagtcccagctagtcaggacgctgaggcaggagaattgcttgaacccgggaggtgaaggttgcagtgagccaagatcacaccactgcactccaacctgggggacagagtgagactctgtctcaaaaacaaaaacaaaaaacaaaaaataagtgtgcctccttttcttgtgacaactaagaactacctcctagcctccattattttgaaaacctgtcatccccgctgttacgagagaggccaattctataatagcatctactgctatcaacatttgcctacagaggacagtccagtcaccactgagcttcttaatgatgcttgtgtctcagccatcagcacattcttactgctttagtcaaggaggtattctccaagcctttacaaagaaaaagtgagctgatgatatttctggaacttatatgacatattcactttagcattcccacttctctgagtcatttggtccttttttcattgtctgcacagcagtttgggcatttatactttatttagtggagaccattgctttccccaagcttccaagagccatcctagcagtgtataacactatttcctgctgtccttgtctaagtgttaaatcttgtatcatggtggaatgttcccatatcaataatctgtgtcactatcctcacttgatcctattttccatcctcaattttattcaatctcttattctccatcccatctcatccagcagcctcagcatctagctccatacatacttccctaactcctggctgaggtctatagctaatttaaagcataatctttttcctgtcttagaagcccaacaattccagagccaagtaatgtcatctattgaccctatatggatctggtggccagaatggaagtggggttctatcccgagaagggtgtgagttacctccaagggaagaggtttctgtatcatcttcaagcaagatggaaatgactgcctctaattaggaggaataggcaacttccataggtccagatggtttaggataatttgagacttcaaggttgtggagtccataaactcagatgtaacctcccgtaagattccccttgttcccaaccagggttcagactctggcatagctgaggatgcaggcctcttgaaattctgttatacttttaaataagtcctaagccttattatctgcttttatgacctttgactgcagaagataagaatctctttgtattttgccaaagaggtcttatgctcacataccacggtcaagtgatgattaattacactcagcctttcattttttttctccactgcgtaaaaggaacccagcagaacctgattccattgtccttataattattactttcctctgaattcctcagaagcctgaaatattgaactcacagggcattacctttcctcaatacctatccttatcacaggtgaagattttaacaacttcccactatagcaatcaagagctataagtggttggctgggcgtggtggctcatgcctgtaatcctagcactttggaaggccaaggcaggtggatcacctgaagtaggaaattaaagaccagcctggccaacatggtgaaaccttgtctctactaaaaatataaaaattagctggacatggtggtgcatgcctgtaatcccagttactcagaaggctgaggcatgagaatcgcttgaacccgggaggtagaggttgtagtgagccgagattgtgccactgtactccagcctgggtgacagagcaagactctgtctcaaaaaaaaaaaaaaaaaaaagagctatcagtagctacctgccaacagcaatggggccctcactgcagccagctagttggctgctgagtgatccacctctaaaattccattttaaagttatcttcctcagatcacctagaatgggttctttggaaatctgattctttgacgaagacatgcatttcggaagtttgttggagagtgccctcagaatcaactcatgtagtagtgttttaaaaaaagagggattaggcagtggaatgagttcaactgtgctgcattacttccaaataggtcagatggagctgttcagttgagaaggcctttcagagtggccctgcagagttttcctacaaaggagattgatgcttcactgcattagcatttcccacagtgaggtggctcttgccagctgaggacaactccattagaagggctgactggagagccaacatcttccaacgcttccaggaagaaaaagcacctgctacagagttttatgataaggacttgaagttactattcataattttctctagcttttaaatgtagttcaggaagcataaaatatgtctctatgtttattcaacagtcaattttcatactttatgaccctgataatattacctaaccacactgaactctcttctgttattgttattttatttatatttatctctttaaaataaatttaattttataagctaaatgtgtgaaattcaaatatctagatattaaataattacaaaatattattttaaaagtgtatgatttttattattaaactggggccaaaattcttcacatatatacagtaatgtaaataattatcttatttgatatgtatttattttaaatatatttcaataacaatatggtttcctataaaatatatttctatgtgtataggactcataccttatatttatattcttaaaaaccaatataataggcacactcaataatctaataaattaatataaaggaagattaatctgtcatgaatatagtcaatgtcagttttcagcaaggaaattgatatgtatcataataattaagaaaaatgtgttttttcatttaaatgcagtagctacccctttataactaaactaattttcttgaaactttttttggctgatcaaatgtgccaaacactagtagattaaagtcagtttaagaaaattaatgtaatatatgctgttttcctcaactctagaaataactgtctcccaattgtctcccaaaagaatttgtggtatgaaaaatttgacataggttttgatgtaatggtaagagaaatgttccaagacaatctgaacttttccatggtttttctttgtatacctataagaattatctacttgcccagttttactttgcaatatttttttgagtttctattaatctcaacatgtaggtgttcaggacatggtgtacaaataatcaactaatgaatgctatgcctaatatttattgaatacctattttgggccaggatgtttggaagaaactttacatatgccaactaatttcatttttatagaaacctcgtctcttttaatgtcctgggagtcaagtttcagagaaatgaagtaatttgccagtatatatgtaacacgatgagtattatcaaatatatcttaatctaaaatgtttatgttcattatcttcatgcatattttacatgtctacaatatggtaagcattatgtaaataactcagtttacaagtagcctacagttcatgagtcaaaaaaaggcaaataaatgaataagatgaaaaaaaaacacaacacaattaactaaatgatcctatagagatgtaagccaaatacagacaactatttctttctggaaagaacagtaaaggctacctgaaaagatgatgcctgaaataaatcctaaattatgaagagagtatgccagataatatattaaattaaataattacaaaatgttattttaagtgcatatgacttttattattcaacaggggccaaaattcttcacaagtatagagtaatgtatacatgtgaagagtaggaagtagcacacataaagctctgagatatcagagccaatatcagatatccagcaaagctagaaaagacttctgggtattgaggaatagtaatttggtatgatgtttgagaaacaaaaatggaccaaatcattagtagcaccatctatgctaaagaaaatccattccattacttttttagccaggctttcgctttagaaagatcatcctagctccttctggagaagagatttgggggtggcaaaaagagtggtaaggagatcagtaagaaggttgtggtaacaactgagatgaacaatgacaggggctttgaaataagggtgacaatgggcatggagaggaggcttaactgaactgaactaggtgagtgattagaaaccgggctgggcaaaaggtgggagttaaaaaaggtctctaaggacctggatttggcagttgggtagacagtgcactaactgaaacatgaaacgtaaagagagaacttcacctggctgtgggtggagtgggatgggagttgtaaaaggtaagaaagttgagttctgtttggttgacgcagctcctccagttgcaatgtacacgacctagagccaaaataagtctgggctacagatatggatttgggagtcatcagtatgctgtggaggggaatggaccactcaaggaatatgcagaatggaaaaagggaaggaccagtgagagaggcctgggcagcactaagtacaggcaaaaaaagaaaagaaaagaaataaaaaaaaaaaaaaaacagttgggcgggagggctttgtaaaagactaaggaaaaagtgataaagaagaagagaggtagagtcaaaacaaatcaatagtaaataaaatagcacttccacagccatggagaggttggagagcagaataagtggtgaaaagacaacagaactggaaagtgactttaaatttggcaagtaatagatcactggggacctttgccagagttgtgtcagtggagtgatgggtctagcattttcctgtactttacagagtgaaagtcaagtaaaaacatggagagattaatgggtataatcctttcaagaaacttggctctaacaaaaacataaaaaataaaaaaagtagttaggggagtagaggacaacatgtgatcaagagagtcttgttttgttttgttcctgttttgtttttcattaagcagagagagtttgtttttccttaagctgagtgcatttaaattcctaggataaaataaaacataaggagcattaggaaaatgcccaatgtttgaaatagctattttttagtaaataattattattttagtgttatactttgatggcagcagtggccccatttggagtggctgctgcaaagacgacgaccgcagtgggggagatgcagctaaggctgtgcactccatggaaactgcgggagccgggaacaggcaggattcctgcccccttccaagttggtggggtgggagccctgtgatcccaggcacagctgcagccacccagccgcagcagtggacccggacatccctgtgctcttggcctgtgaagcccccctgcccctgcatgcttggaagtgcctgctcccactgcctggcctctcccggctcccagcactggctccaattttggagcaaagttgtggtccagcccaagcgctgtcaagaccaggcctggtgtgtatgatgctagggtcggtactgacacaccagcctcttactacctcacccacctccggactttaggtagtgacaagtacagcagagaggccaagatggggctgagggccactcggcaccggcctgcaggcactccctagcatgaacagccagggcgccatgaagaggcagataggcggctgggcggaaaggggcaggacccctgtgaaatcccaccttcaaaccatggactctgtagcatggggcctaggctgccagttccccctaccaaagtgagaacttatggtgctttttccagggttgcccatggctgcccatggaccaatcagcaagcacttcctcccctcggaagccgattaaaatcccagactcagccagactgggacagacaacaggataacctccctagggaaaagagctacacactgtgggtctcctctccactgagagctgtacactcatcatgacaacctgagggccgtacagatgctgcgatgacctgcctgcgaaaggaggtacccacttcaggtctcctgagacctgtgctattgctcaataaagctcctcttcgccttgctcacgcctgtagttgtccttgtacctcatgctcactggatgcgggacaagaactcgggaccttctgaatggcaggattgaaagagctataacacaaacaggactgaaacatgcctccctgcttgccacattgcggatgatgagaagaagagaagacagaaacagagaagagccatggtccttcgggaaacccagacctagcagctccccaagccagagctgtgacactctcttcggagctctgcagttcctcgcgtctccaagattctgggtaccaccatgttccccagtgtctgcagtgaaagccgcttgcagtacgcctgctccagctgcggcctagcagggagccaacgcccatgccgggagttgcccaccccgctacagctggcatgtctggctgtacacagtggccagaccctgtggttgctcaaacagccctcaccgttccatggctggctcacccttgacaggtgtgagatccaggccagtagcgcaagctgagcacagcctaacaggccgagagggcaaaacaaacccagtgaaactgagcaaaacttgggcaaaggtgccactggccacagaggtttctggctggcaaagcgacaccccaagggtcttgcgacattttttatatgaatttttttacaattcttttcttttcttcttcttcttctttttttttttttttttttttttttttttttttttttttttttgagacagagtctctgtcacccaggctggagagcagtggcgcgatctcggctcactgcaacctccgcctcccaggttaagcgattctcatgcctcagccgctggcgtagctgggattacaggtgcgtgccactaccccggctaatttttgtatttttagtagaggcggggtttcaccatgctgggccaagctggtcacaaacacctaacctcaagtgatctgcccaccttagcctcccaaagtgtggaattataggcataagccatcacacctggccaagatttattttatcagttgtgtgtccctatttttcagaaggttttcatttaagcttctaggattctaggctagaaaacttaaaattatttttgacccttccttatatttacatcaaggcatacgctttcttaacctcaaaaactccaaagttagttattatacactaaatagcttcgtttgagttcagttcactaaattatggaagcatttgtttagtccactctccactaccactcgagtttctctagtgacataaaccagctaactcacctcccaacatgcactggtgcaattaatccataggcttatgattaatcagttattaactgcgactgaagtcacaggatgtagtcacaagttaaaaaaatcaattaatctaaaaaatattcacagcagaagcatgttttccacaggagtttattccaccatttggtccaatttttctgtctttaatctttgaattaaaccaaattaatctgaaaacccagatggaaagacacactaaaaactatattggatgtcatctttttctctggaaagttccagaaatcttaaaaatcctatacagaagatatataaatgtggttccttaaggaaaataattgctcaatatacttggaggcactaaagctagagaagcatattattttttcactttatgaacaagaatttatattactaatacaactatatatgaatgcactatatgagtgatagctcataacaatagataacgctaattatatgcatatgtctgtcaatgaccacaacctgactgaaatggttactgtgaagctatacaaaagagaaattaaatcattgttagacatcaataattaagaacaaagcatcaatataaatgatttgtaattctgcagatatcaattcaaaagcactgttttctttgataaatcgatgggaaattttgttcaaatattgatgacaggaaatgtttcatatctttcctacatagcaatttttgaataacgggtaatcttatttgatcattcataataaaagacaaaatgaatacttacagccaacttcctcaaatgggacatttctaagaatgtggctatctataaaacttagattcattcattctaatgtgaaattttgcttttactcatttacttacacaaattagaatccattgcatcttcaataagttttttaaaatatatgcaactacatgttttatatatctttgctaatattatcctgatgattttgcatattattctagagaaagagtttttgaaccttgatatgtcctggaaaaactgtcccaggatttttcttttacctcttcctcactcattttctatcaaactcctgaaaaatgaaaataacaaaggatataaatttttaaactatgtacatatatgtgtgtgtgtgtgtgtgtgtgtgtgtgtgtgtgtgtgtgtgtatctgatatggtttggttgtgtccccacccaaatctcatcctgaattgtagttcccataatccccatgtgtggtgggagggacccagtgggaagtaattgaatcatagggacagtgtccaccacgctattctcgtgataataagttctcacaagatcttgtggttttataagggctccccccctcactcagctctcattcttctccctcctgctgccctgtgaagaagtgcctttaaccatgattttaagtttctggaggcctccccagccatgcagaactgtgagtcaattaaatgtcttttttttgtaaattattgtcttgggtatttcttcatagcagtgtggaacagactaatacagtatctatacacacacacacacacacacacacatacattatacatacagtcatgtgctgcataactgtgtttcagtcacaacagaccgcatataaaatggtggttccacaaagtataataccacatttttattgtagtttttctgtttagatacacaaatatatatcactgtgttacgactgcttacagcattcagtatagtaacatgctgtagaggtttgtggtctagggttaataggctataccatatcacctaggtgtgtagtgggctataccatctaggtttgtgtaagtatgctctacaatgttcatacaataatgaaatcatttaagggcacatttctcagaacatatccctggggtgggtgtgtgtgtgtgtgtgtgtgtgtgtgtgtgtgtgttcatgtacgcatataatgtatacagatttttgtctttttgtaaaaattaaatcatataacacttttttgatacttatagcagcctttttttttttttctgagatggagtctaactctgccactcaggctggagtgcagtggcgcgatctcggctcactacaacctctgcctcctgttcaagtgattctcctgcctcaacctcccgaacagctgcctggctaatttttgtatttgtagtagagacggggtttcaccatgttggccaggctggtctcaaactcctcacctcaggtgatcagcgtgcctcggcctcccaaagtgctgggattacaggcgtgagcaacgcccagctagcagctttatttctaattgctaaaacttgtagacaactaagatgtccttcagtgggtaaactgataaataaaaggtagcacatacagacagtggaatattattcagtgctgaaaagaagtgagctctcaagccatgaatacacatggaggaatcttaaatgcatatgagtaggtgaaagaagccaatctgtaaaggcaacatgatatgattccaaatatatgacattctggaaaaggcaagcaatggagacagtaaaaaggccagtggttgccaaacatttgtagggaaggagggataaataggcagagcacagaggatttttagggcagtggaactactctgtgtgatactaaaatggtggatatgtgtcatgatacattgtccaaacctatagaatttacaacattaagagtgaagcctaatgtaaactatggacttgggtgataatgatgtgtcaatgcaggttcatcaattataatcagccactctggtactggaagttggtagtgggaggggttgtgcatgcatggaggaggaagtacatgggaattttaatataacacttaaaaaaaaatcttacttttctcacacaaactacttcatggaaattcctccaaggtagagctctaatcctccccacccttttaaaaatagttgtataatatccctggtcatgaatgttttctaatttagtcaatcattcccattaattgtctctaaactcccattaattgtccttaaattcttgtaaggaacctggtttgtaactagttgtatcgaattttgcctgattgctttccaaaaggaatgtacatttcaccacaagcatatgagtattcttcttcctgaatttcagccgtaacaggcttttttgctcttctaaatttttgtgcactctgattgtgtgaagtgatagctcattgttactttatatttgcacttccctgatgactggtgaacttgattgggctttcacttgatgattttctagatttttgcttccttgaactgtctacttagatcctttgtctatttttatcctgggttagttatctttttctttaaaaatttaaaaaatctttgtatattatggagaatcttttggttatttttctattaattttgttcagcaaatatcatttcatagacatataacttaatttttatatagtaagatatgactgtcttttcttgcatagctttggttggcaaaatataataaagtatggctagttttcccctagattgcagatgaagtctttactccatccagaaccgaattttgaatgttgtgtcacttcgaggtctaattttattttcttttgatggagatatagtagccacaccaccattgaatactcattcttccacaacgagttgaacccaaaatttatcatgtattaaagtttcacatgttaggatctacttctggcttacctactctgttataagaatttatttttcttttcttgtgcaaaaccatattaatgtgacatagaagtttttagcttctgaactctactaataaaacttcaccctgtcccagtcccttgctgctattctatttcgggcttttttggttattctcaggcatctatcttgcagttaatgtccagattattttcttttacaaacaaacaaacaacaacaacaaaaaagcagctgagaagtggctcatgcctataatcccagcactttggctaggatttcaacaccagcctaaggaacatagcgaaaccctgcctctacaaaaactaaaaattagctgggcatggtgcatcctgtaatccttgctactcaggaggctgaagcaagagaatcacttaagcccaggaggttgaggctgcagttgtgagccataattgcatgccactccactccattctggaccacagagcgagacctgtctctaaaataaatgaataaataaataaacacacacacagacaaacataaaactctgctgggattgttcattgagaatcaattaaattcacatataaattttaattttaggtaagtgaaaactcagatatccatctgacctggtgccatcaaccaaatacagatacttaatcacatttctaatactaactttaaaagcaaattttttgattggcactgctctttggacaatatttaacaatttaaattttgctagaaaataatcaatttccttaagaactgcatgaagcatctcttaattttgtgatctctcctttttctaaggttatgtctctttccttattccaaatcaggagtatttttacttcctttcttccctattttattagaattacaagaggtttgtcatttttatttttcttttaaaataaccagatttgcatttttaaaaatttctagctgtatttgcttgctgttatgctattttcagcttttactttactaatgctgtactaatttacttaatttaattacatttttgtgattcattaggatgagaatttctggtgttccattactttttaaaaaaataattacggcattttgagctgattttccattgaatttagcatttgttttgttcatagtttttactatcaattatctgtttaagtgccttctaaatggtatataatttgactactgattttcctttgatacaacgattatccaggtatgtttaaaatgtccaagaagaaataatttaacaatcaccattttattacttatttctattatggttagaacttatgccatacaaatatttacatattagaatgtaaggttatatatatatttcaacttaatgtaattatttttctaaaatatatatatacatatatttagtcaaatacaaaaatttttgagagaatacccaagaagaggtaattttttttcatttccaaggtgattaatttctaccttttcccctcatttcaataaagcaaaaattttagatgcccttcagggcacactctgcccccaccctctgctgcccacatccttgcccctgataaggaaacttagaacactttttatttcttcttttctctcctgccaacctcaactcttatattttgttttcgttgattttagatttcccttaaactcatagctttcagttttaagaatctaattgggttcttattccacacactgcagaatgtttattcatatccattagatttaaacacccccctccccagatcctttttttttttttttttttttttttttttttttttttttgaggagtcttgttctgttatccaggctggagtgcaatggcacaatcccggctcactgcaacctccacctcccggattcaagtgattctcctgacttagcctcccaagtagctgggactacaggtgcttgccaccacgcccagctagttttttgtatttttagtagaagcaggatttcaccgtgttagccaggctggtctggatctcccgacctcgtgttctgcatgcctcggcctcccaaagtgccgggattacaggcataagccaccgagcccggccaacccacattcttgacccatttgaggtcactatttttttccttcaatcttttctacagtatatatcttagactgtataatataaaggaatcctcactggattcctgtacaacaatattttctccttatggtcaatgacatggtcactggctacaggattcctgagttgctgtcttcttctttaataacctatagatattattctgctgccttttatcgtttgaaatcaaatataagaactctgatataaatccttttttaaaatgtgtccttttttgctttgtgatttcctctttctcctcggatttcatatctttttgtattagctcaggtggttatcttttctcctgattcagtatgagttcaggattttcagtaagcacagctacaagttcaggccttttcaacttaatgtaattatttttctaaaatttccggtatttgtatattatttccataggctatatcctccaagtctttctccctctttcccctcctcatgatttatatatcttcatacttcatgctctgtattttgagatatttctagcacttcctgtcctaggccactaatttgatccccatttccaatttttttactgaactatttagttaagaaattatgattttcagtatcaccaaatctagcacgtatatgtgtatgtatgtgcacatgcactcgaatgaatgtacctgacaaataaatctctttaaatattagccttctttttatttattaacacttaagctgttctatgtttcattgggtatatgttccatttaatttttactaacttctgcttctgacacaggacactattgataggttattcttctttgtcacatctttggggctctaatctggttgttgatgaatcctaatggtaggtgatatcaaaagtgtgggaagacaaagtcatccctgctccatggaccagtggtgaagaggcagactagcctcttctgaagaactggagacaatctccctgccttctttgttgctatagtctttcagcctcaggacagagaacactttcccaacctacctctactatgcgcatggcaaggtttggctctgtgtccctacccaaatttcatcatgtagctcacataattcccaatgttaggggagggacctggtgggaatcatgactgaatcatgatggtgggttgtgggggtggggggtctttaccatgctgttctggtgatagtgaatgggtcttgtgagatccggtggttttaaaagtgggagtttcttgagcaggctctctttttgcctgccgccatccatgcaagatatgacatgctcctccttgccttctaccatgatcctgaggccgccccagccacatggaactgtaagtccaataaacctccgtcttttgtaaattgccctgtctctggtatatctttatcagcagcatgaaaacggactaatacagtgcacttttgtgtttcagcacgaggaggaaaacacatttagccaaccttgcactcagacacatctagtcccataattcattggtgaagaactggaaggacccattccagtggcatatggtgacagtagtgacaacaatgttgtttcctgggaagcaggagcaattgtgctaattacagcaccctgaatttaatatgagcacaacagcacacattgagaaattcagcacaccctggctgcaaaagaggcagccatgtcctcactggctcgtggagggattgagggctgtgcttctccatgtcatctagctcacagactgttttccaaatttcattctatgatcgtaaagcaattctataaagttcacttttacttatttatttgtttagttagtaggtgagtcagtaagttagttgattaatttaaatcagccaattttgaaatctgctgcttgtatggaacagtttattaaatgagtattaatcaatagatatagctataaattaactccattccctctcccactggccctgaaagcctatgtgacaggctatttcttatcctgctattggatgaaattttaggcacattccacagctttcccagttccctgagtcaatcacaagaacagtcccatttctggagaaaatttttacaatctcctcatctgacaaagggctaatatccagaatctacaaagaactcaaacaaatttacaagaaaaaaacaaacaaccccatcaacaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgttggagaggatgtggagaaataggacacttttacactgttggtaggactgtaaactagttcaaccattgtggaagacagtgtggcgattcctcagggatctagaactggaaataccatttgacccagccatcccattactgggtatatacccaaaagattataaatcatgctgctatagagacacatgcacatgtatgtttattgcagcactattcacaatagcaaagactgggaaccaacccaaatgtccaacaatgatagactggattgagaaaatgtggcacatagtcaccatggaatactatgcagccataaaaaatgatgagttcctgtcctttgtagggacttggatgaagctggaaaccatcattctcagcaaactattgcaaggacgaaaaaccaaacgccacatgttctcactcataggtgggaattgaacaatgagaacacctggacacaggaaggggaacatcacacaccggggcctgttgtggggtgggggcagggggtagggatagcattaggagatatacctgatgtaaatgacaagttaatgggtgcagcacaccaacatggaacatatatacatatgtaacaaacctgcacattgtgcacatgtaccctagtacttaaagtataataaaaaaatacaaaaaaagaacagtcccatttctgtaattaaaatatccagttcaataactttgtaaaagacctgtgaagtttctgatttaaaatttctctattcttcccagctgtcttctagttcaggcttgatatcccgaaagtttgagggggaaagagtggaagtggtattacttagcctttcttccctctttatctgctttgttctttgacccttccattttcactagccatagggtataactccttcaggactgtagaggtgatgatagaagcaggggaggtaagggataaaggtaccccatcctttgtagaggaaacagtctacagatcttagggtggaactctcgaaggaccctcaattgcttccatttctaggttccactctgagctgcttatataaatcaaagtggaagggtctccaatgctggtatggatggtcttttaaaatgatttcactttttaggcctttgccaaaactgatatacaaagaaactcagttaaaaataatattttcagaacaaattagtagtaataatggaactataagtcctcatacatagatatttttggctcttgtaataaacccttgtcccaaactaatctcttacataccgataggcagaataaaaacacacatttttgttctaccttgatttgcataaataaaaaaagaattagtggctaaatatgagataattccattttttgaaggctcatatacacctatacacccttttctgtgttttgatttatcccattttataagcagcactgtttactttttttttttttttttttttagacagagtctcgctctgttgcccaggctggactgcaatagggtgatcctgactcactgcaacctccatctcctaggttcaaacgattctcctgcctcagcctcccgagtagctgggactacagatgcatgccaccaggcccggctaatttttgtatttttagtagagatagggttttaccgtgttagccaggatggtattgatctctagacctcgtgatctgcctgcctcggcctcccaaagtgctgggattacaggcgtgagccatggcgccccaccactgtttactattttaacctttaattcattcttaaaaactttcaaaagatttaataccaataataacatatatagaatttatttcatcagttcaaaaaatatttatagatatataattttctatattctctgtctactcaaaggaaacataattgcatttctttcttttaacaacattggctctctcatccacaatgcagtcatcagcattatctggtcttaggcaacataactttattagcacctcttctaagaataggtctttagaatagtcctcaaaagagatacaaccaagagagaactttatctccagctctagacttctagtctacaaagcttgaaggaataggaggaatacaacttgaaacaaatgattatcgaaatgaaaaacaaaagccaaaacaaaaatatgaaccgtcacaacaaaaacttcacctgacgtaagagcatattacacacgactccagttgtagcctgatagtactaagagcataaccaactttgtaccttccactgattaccaaatgctcctcattctaattattaattttaaaactgataaacagggcctccaggctgacaagacagtgtgtgtgtcagctagaataatcagacaatacagccaagtatccggcacatagaattctgctctcagttgccatctctggtctgggcttagcactcagaaaattgggaaaaattaacaatactctcaaatgtagactctgaccagtcaccactggtatgtctaacctaggagaatccaccaactctctctatatatacttttaatgctgctctagaattagcttccaaatgcagatgtgaccatccatatttttttttttggtccagactattattgctgaagttgatacatattttttaaagtaactggataaaacaaattctcattaaagttgaataagaattagtttatcatactggttacaaggtaaactaagtaatcaccaagatctttgctcttctcataaaactaataatgcagtttaaggcaagatacttaacctctctgtgtactcatgtcttctccttataaaggctctgctgtgggaagcacctccaagccagttgattgtgaaaaacataaagcatgtgctgactgagtgcatagggagaaaggcaatagaaattttccaggaagaaaaaaatcagtagcagtagtgtttttttcacaagagacaaagttacaaaggccaaaaggagcagaagggaggcaagaatagcaaaagtgaaggacttccaagcatcagggagtgctctgattgacactcctctcaggcatattagattacaagagttaaagcacattccagctacacatggaaaacatctcagggagttatcggaaatattcaggaaggtcaatcctagaaaaatatttcaatttcttatttgacaagtgagtggttatatgaacaaaatgatattttactctaaatacaattatttcatttatagtctcaatcaggtaaaacttgagaatcttggtagaccagccttgcaataatgagtgactgctgcctgtgtaatgtcccaagcatataacttaattgcatttcaaccacagctgcatctcttttattgcatatttccatttgataaaatgtacaactccattgcatttggccatagacacattgtttatggataaatatctctatttccccattttaaactgaccattgtcaacatattagacatctgttacagaaaacctgtgtatctgtatggcctggatgcaatgggagtaggtctacatctctttatttgacaactgccttcccttctctgccatgaaggagtttgcttttcctcttatggagtttctgagaatattttttaaaaagaaaaaaagagcctaaaagcaaccacttgctgcttctctctctctctctttaaccatagtgacagggcggaactccatctcaaaaaaaaaaaaaaaaaaaaaccttaacatcttgaccacaattaaatgtcagtttaattttgttttcaataacatctatattctatataatttttcatcataaatttaccataatttcattaccataatttgagtaaaatgctgctaaattaatacacaactcttcagattcttttaagttgggtattctcaactgatataagctattgtttttcttttgctcgagttcttttcccctaactacctgtctctcattggataattgatgaaaagttattactaaagagagtgttgaaactaataatatattacataattcagaatctagagcagttacatggcacgtactgagttctagaaacaaagataagctgaatgtgctaagttttagattctgatagagctatcaaccaagttcattttaagaaactgcctcaaagtcaaattaattcaccttaaattacatttatatgttaaattaaagaagctgaaatttcacagcaaagtaataaaatgctaataaggctaatggaagaaattctgccttcaagacactaattcaatgatttttcttttgactgggaactaaatcacctaaagtatttcaatctgttaaaccttagcaacatttagatctgatatttctgggtataagtaaaataacatgagactttaaatagtactcttttattgtctcattattgataaaattaagtggctaattcagatatatagatagatagatagaaatttaattaatttatttatttagttggtctttctcaggcattaaggagtttcatatgaacttaccaaaattccccttccaaatgggcatggtaaggtgacaggaaacaaaagccactttgctttatttacatacacccttcaacacaggcatgctgagtatattgaatctcagcttacttatgagttcgatatgaccaaatataacatttgacaactttaacaactaatttcctttcagaatattttctttcatttcttgttgttaaaatattcatagatatttctataattaattaattatacaaggaattgtgagccaatggcttatatgatgttaccttttcatatatatatgtatatatataaatttgaattaagttgtatgcatgaagccaatatgtagtgtgtcagatataattgtaactataacttctcaaaatatatcatgttgccttcatttatctatagatactaacaaaaaaattcatatttattggtaaccagtaattttgctaagaatttccaaaaattgtcaacatggaaataaactactacttacatatgacaaaaagtttaatactaaggcatgaatttatggatctaattagaacaaaagtaagcctagcattagcttaaaaactgagatttttatatttactaataatacataatcagtttttctacttgacagttatgataaaataacaatggcataacagacaaacttttctgtagtttattaaaactgaaaatttctgtagttttgtttctcagcttattaactagatactactgattaaaggtttttaaatgataatttcctctaaaatataagtcaaatatatttaaatgagaaaactcacccagaaattgaaaaaaattacctatattgtcaaagacacactctactctccttccacattcacaacattccagtcaggccaagacaatacgatgaattactaagtaaatacaaaatgttaaatataatattgcaacaatccggagttaatctgcctatactgtcaatcaccagaataactcctggagttcatacatgaacacagagctcttctgactagacaaaataagttcatgccctttaatcccaggggttggcaccttgcctttggcttctagtctcactccaagattttagatacattaataaattgcttcttgatttaattgctcaactctcagttaaccagaggcaaatgagaagaaggaaagtaagaaacagcaataagaaattgtttgaaattttgaaatgcttacttgaaacaactgataatgaggaaataaatcataataacaaataatgctaaattatttgttatgatttgtcagagccaactatgtgtctgaaactgtacaggcatttgacatttcacccaacttttacaagaatgctttgacaaaggtgctatcattgtcattttataggtgagaaactactcacctgctagtttctcagagatgttgagtgacttaagaagtcaagcaaagattcaaggattagtctattgaacctcaaagctctttctgcaagaattaaaaagctgagccactatgaacattttgtttagggggaaacagctctatatatttaattagaactttaatgcattattacaagtttatacaaaacaattagatacagagttatcatattaaaatgacaaaagaataaaacattctaggaagtttcctataaaaacttctgacaagtctacttaagaaacacatttctatagactaatttcaaaaccaattttgattcagctgtattttcattttcctagatgaaagttggctaacctaaagaagaatattttttaagttaacgacgtgaacaaaaggatgtgattttttaattgacataaactttaaatgtttcgctttgtggtttatagagcatcttctcatatacttaaattgaaatatcaaaagatgggatgtctgacacattagatattggcttaataaatataggctaattcaaatatacatttgaaaaagtaaagtcatatactcataagccattggctcacaaccccaaggataattaaggcaattttctaaaaatcataacgttttaaaaaattgcttatttttattagaaatattatgttttttacagtccagaaagccataatctctgaagagattgtgggaaaatactgaaggttctaaatatagaatgtacaatgagagaattctaagtgtacataatacaaactattttttttgctttaataatactaaggcccaaacataatgaatattatataaattcttaactgaatatgccataaaaacaagtaaaaataatacaaaatatcaaacaatttcacactgttaccattgagagaattgagaagttcctttggattaactggaagaaaaactaaccaaggaagaggcaatttatatgaaaaatgtaactacttttctaggattcttctcaattattcattactgacaaatgacacaaatcaatgggggagatttcttattgttcaaagggaagtagtttctttcctgaaaatatacattttgaatgcatgctgctaatcatttcagaagctagtctactttagaaattttatgtcaatttggagagggcagccaagatggccgaataggaacagctccggtctacagctcccagcgtgagcgacacagaagatgggagatttctgcatttccatctgaggtattgtgttcatctcactagggagtgccagacagtgggctcaggacagtgggtgcagcacaccatgcgcgagctgaagcagggcgaggcattgccttactcaggaagcacaaggggtcagggagttccctttcttagtgaaagaaaggggtgacagtaggcacctggaatatcgggtcattcccaccctaatactgcgcttttccgacgggcttaaaaaacggtgcaccaggagattatatcccgcacatggctcacagggtcctatgcccactgagtctcgctgattgctagcacagtggtctgagatcaaactgcaaggtggcagcaaggctgggggaggggcacccaccatagcccaggcttgctcagctaaacaaagcagccaggaagctccgactgggtggagcccaccacagctcaaggaggcctgcctgcctctgtaggccccgcctctgggggcagggcacagacaaataaaaagacagcagtaacctctgcagacttaactgtccctgtccgacagctttgaagagagcagtggttctccaagcacgcagctggagatctcagaaccggcaaactgcctcctcaagtgggtccctgacccctgacccccgagaagcctaactgggaggcacccccaagtaggggcagactgacacctcacacggccgggtactcctctgagacaaaacttccagcggaacgatcagagagcagcattcgcggttcacgaaaatctgctgttctgcagccaccgctgctgatacccaagcaaacagggtttggagtggacctctagcaaactccaacagacctgcagctgagggtcctgtctgttagaaggaaaactaacaaacagaaaggacatccacaccaaaaacccatctgtacatcaccatcatcaaacaccaaaagtagataaaaccacaaagatggggaaaaaacagagcagaaaaactgggaactctaaaaagcagagcgcctctcctcctccaaaggaatgcagttcctcactagcaacggaacaaagctggatggagaatgactttgacaagttgagagaagaaggcttcagacgatcaaactactccgagctacaggaggaaattcaaaccaaaggcaaagaagttaaaaacttcgaaaaaaatttagacgaatggataactagaataaccaatacagagaagtgcttaaaggagctgatggagctgaaagccaaggctcgagaactatgtgaagaatgcagaagccccaggagccgatgcgatcaactggaagaaagggtatcagtgatggaagatgaaatgaatgaaatgaagcgagaagggaagtttagagaaaaaagaataaaaagaaacaaacaaagcctccaagacatatgggactatacgaaaagaccaaatctacgtctgattggtgtacgtgaaagtgacggggagaatggaaccaagttggaaaacactctgcaggatattatccaggagaacttccccaatctagcaaggcaggccaacgttcagattcaggaaatacagagaacgccacaaagatactcctcaagaagagcaactccaagacacataattgtcagattcaccaaagttgaaatgaaggaaaaaatattaagggcagccagagagaaaggttgggttacccacaaagggaagcacatcagactaacagcggatctctcggcagaaattctacaagccagaagagagtggaggccaatattcaacattcttaaagaaaagaattttcaacccagaatttcatatccagccacactaagcttcataagtgaaggagaaataaaatactttacagacaagcaaatgctgacagattttgtcaccaccaggcctgccctaaaagagctcctgaaggaagcactaaacatggaaaggcacaaccggtaccagccactgcaaaatcatgccaaaatgtaaagaccatcaagactaggaagaaactgcatcaactaacgagcaaaataaccagctaacatcataatgacaggatcaaattcacacataacaatattaactttaaatgtaaatggactaaatgctccaattaaaagacacggactggcaaattggatagagtcaagacccatcagtgtgctgtattcaggaaatccagctcatgcgcagagacacacataggctcaaaataaaaggatggaggaagatctaccaagcaaatggaaaacaaaaaaaggcatgggttgcaatactagtctctgataaaacagactttaaaccaacaaagatcaaaagagacaaagaaggccattacataatggtaaagggatcgattcaacaagaagaggtaactatcctaaatatatatgcacccaatacaggagcacccagattcataaagcaagtcctgagtgacctacaaagagacttagactcccacacaataataatgggagactttaacaccccattgtcaacattagacagatcaacgagacagaaagttaacaaggatacccaggaattgaactcagctctgcaccaagcggacctaatagacatctgcagaactctccaccccaaatcaacagaatatacatttttttcagcaccacaccacacctattccaaaattgaccacatagttggaagtaaagatctccccagcaaatctaaaagaacagaaattataacaaactgtctctcagaccacagtgcaatcaaactagaactcaggattaagaaactcactcaaaaccgctcaacaacatggaaactgaacaacctgctcctgaatgactactgggtacataatgaaatgaaggcagaaataaagatgttctttgaaacaaataagaacaaagacacaacataccagaatctctgggacacattcaaagcagtgagtagatggaaatttatagcagtaaacgcccacaagagaaagcaggaaagatacaaaattgacaccctaacatcacaattaaaagagccagaaaagcaagagcaaacacattcaaaagctagcagaaggcaagaaataactaaaatcagaggagaactgaaggaaatagagacacaaaaaacccttcaaaaaattaatgaatccaggagcgggttttttgaaaggatcaacaaaattcatagactgcttgcaagactaataaagaaaaaaagagagaagaatcaaatagatgcaataaaaaatgataaaggggatatcaccaccaatcccacagaaatacaaactaccatcagagaatactacaaacacctctacgcaaataaactagaaaatctagaagaaatggataaattcctcgacacatacacccacccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttgtgaaactattccaatcaatagaaaaggagggaatcctccctaactcattttatgaggccagcatcatcctgataccaaagccgggcagagacacaaccaaaaaagagaattttagaccagtatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaactacccttcatgctaaaaactctcaataaattacatattgatgggacgtatctcaaaataataagagctatctatgacaaacccacagccaatatcatactgaatgggcaaaaactggaagcatttcctttgaaaactggcacaagacagggatgccctctctcaccactcctattcaacatagtgttggaagttctggtcagggcaattaagcaggagaaggaaataaagggtattcaattaggaaaagaggaagtcaaattgtccctgtttgcagacgacatgattgtatatctagaaaaccccatcgcctcagcccaaaatctccttaagctgataagcaacttcagcaaagtctcaggatacaaaatcaatgtgcaaaaatcacaagcattcttatacaccaataacagatgaacagagagccaaatcatgagtgaactcccattcacaattgcttcaaagagaataaaatacccaggaatccaacttataagggatgtgaaggacctcttcaaagagaactacaaaccactgctcaaggaaataaaagaggatacaaacaaatggaagaacattccatgctcatgggtaggaagaatcagtatcgtgaaaatggccatactgcccaaggtaatttatagattcaatgccatccccatcaagctaccaatgcctttcttcacagaaatgaaaaaaactactttaaagttcatatggaaccaaaacagagccggcattgccaagtcaatcctaagccaaaagaacaaagctggaggcatcacgctacctgacctcaaactatactacaaggctacagtaaccaaaacagcatggtactggtaccaaaacagatatatagatcaatggaacagaacagagccctcagaaataacactgcatatctacaactatctgatctttgacaaacctgagaaaaacaagcaatggagaaaggattccctatttaataaatggtgttgggaaaactgactggccatatgtagaaagctgaaactggatcccttccttacaccttatacaaaaattaattcaatatggattaaagacttaaatgttagacctaaaaccataaaaaccctagaagaaaacctaggcattaccattcaggacacaggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacacaatgggagaaaattttcgcaacctactcatctgacaaagggctaatgtccagaatctacaatgaactcaaacaaatttataagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattaaaagtcaggaaacaacaggtgctagagaggatgtggagaaataggaacacttttacactgttggtgggactataaactagttcaaccattgtggaagtcagtgtggcgattcctcagggatctagaactagaaataccatttgacccagccatcccattactgggtatatacccaaaggattataaatcatgctgctataaagacacatgcacacgtatgtttactgcggcactattcacaatagcaaagacttggaaccaacccaaatgtccaacaatgatagactggattaagaaaatgtggcacatagacaccatggaatactatgcagccataaaaaatgatgagttcatgtcctttgtagggacatggatgaaattggaaatcatcattctcagtaaactattgcaaggacaaaaatcaaacaccgcatgttctcactcataggtgggaattgaacaatgagaacacatggacacaggaaggggaacatcacactctggggactgttgtggcatgagggcagtggggagggatagcagtaggagatatacctaatgctaagtgacaagttaatgggtgcagcacaccagcatggcacacgtatacatatgtaactaacttgcacattgtgcacatgtaccctaaaacttaaagtataataaaataaaataaaaattaaaaagaagaaattttatgttaatttattatatgtatgtggtgtgtgtgtatatacataatatattaaacctgctgtactagttttgcatttgtgaattgttgaggaacaaaggttaataaaaatgcttagaggattaactgcaaatatatatagtaatatttcatcataatcaattctgttccatggctaatagtgtcacaaagaagattccccttggagtgcatcccagggatatattacttaatatacacattgagggggttgggtattgtagattcataatccaaaaatatagtcaaggacagctccattttgataaaaaaaaagttaaaggcattaagtaatattaaaattcatttgaaaaggaccatggtgttttaaagtaactgacatggcactgtcattttctggtttaaaacaagaaatgcacatttggcaactcattaaactcccaggacttttctagggccattgtttctttccatatctaaaaagcattcaagagcatctctactcggtcgagggccacaaggctgacatcagtgttttttccctattcataatagatatttaaagctgggactatgcctggtatgcctggaaacctttgactatattgccttttatttgtttctaactttgggctcttggagatacaaaataccttttttccagtctattttctttaagagttttacaaaatgcattgttcagttaattcacttattatataaaaatgtttcatgtttaccatttatgtaccaggcactgacctaggtataagaataaataaataaaagaacatttctactttggaataactcacaattcaatgaggcagaaagaaacagaaatataagccatcatcatcttgtgtcgtggtgctatgggaactatcagaaacaattatgttatagaaatgtgattaactacacaagctattcaaatgtatatagaaactcagtcagaaatagcaacaaattctgcctgaaggaatgtagagaaggatactttacctgagtttagaaagtgagcactgttccaggtagagggaacagtatactgttgtatacagtatacaagtaccttatacttgtaggtataagagaacaaggtatattcaggaaactgcaaagagctatccattagagagacatatgggagtactggtcttaaaagcaatgaagatccaccagggactttggtagataaccggtctatatatcattagaatgttaacttgtttggtaaacaattttagttgacaacctactgtgcctagccttttgttagaagacaaacaactgactgtgaccaaaactcagtgattgtcctcatggggaagacaaatattaaacaaataataataattaaataataattacatgtgtacaatattatatggggagccgaatcaacagcactcataataaagttttcatatgtaataaaaatatttatacttatgttttctacttttgatagaatcattacttgagacttttactatttttcttctatttatatttacactacatagttcgttctactgtagcttaatatttaaggtcaaacatcctcatttttttcataactctttgacttttaaatatttgtattattgcaagtaaactattatatatttgtgaagacctgatatatccatactattcaactcctaaaatcatgttcacaacacatccctgtattaattcgagtctcatttacacataattaaaggtttggggttttctttgtaaaatcatttttttattatatattttaataggctactgtgatattggagatttaattatatacacatcacataaaagtatttaaagcacagaattataaggttctatggttcacagaggtaggtgaagaatgttaaactaacaattataaaaaattaattatcaaattgaaatatttcaaattcaaatatttcttctcaccaaaatattctattggagtagttactcacagattcatgatactgaattattctattttttattctatcttaaccagattatcttttttagaactaaatttggatatttccctaatttgccaatatcttcttagtgactgttttgggattgttagacatacttttattagttatgttaatatatcttaatgtgttctaataaatttgacttatttactcattattttattcttattctattctttaacttttattttaaacttttattttgagttcaggagtaaagatgcaggtttgtcacataggtaaaattgcgtcatgggggtttgttgtacagattattgcatcatccaggtatattgagcctagtacccattagttatttttcttgatcctctccttcctcccaccctctggcctctgttaggccccaatgtatgttgttcccctctaagcatccatgtgttctcatcatttagctcccacttttaagtaaaaggagataggcacaggcaaagatttcatgacagagacaccaaaagcaactgcatcaaaagcaaaaattgacaaatgggatttcattaaactaaggagcttctgcacagcaaaagaaactatcaatagaggaaacagacaacctatgagatgagagaaattttttgcaaactatgcgtctgacaaaggtgtactatctagcatctataaggaacctaaacaaatttgcaaggaaaaaccccataaaaagtggacaaagttttcaaaagaagacatacatgcagccagaaagcacacgaaaaaaagctcaacatcactgatcactagagaaatgcaaatcaaaattacaatgaaataccatctcacagcagtcagaatggctattattaaagtcacgcctataatccagccctttgggaggccagtggatcatgaggtcaagaattcgagaccaccctgggcaacatagtgaaaccccgtctctactaaaaatacaaaaattagccggtcatgatggcacgcgcctgtagtcccagcaactagggaggatgaggtaggagaatcgcttgaacccgggagaaaaaggttgcagtgagctgagatcgtgccactgcactccagcttgggcgacagagcgagacttccactcaaaacaaacaaacaaaaaaataaaacaaacaaaaacaaaaacacagatgctggtgaggttgcagaggaaaacgatcatttatatacttggtagtagtgtaagtaagttcaaccattgtggaagacagtgtagttattcctcttattctatttatttaaaatatttattttactttaaattccaggatatatgtgcagaatgtgcaggtttgttacataggtatacatgagccatcgtggttcgctgcacctagtcatataggttttaagtcctgcatgcattaggtgtttgtcctattgctctccctctccttgtcccccacctcccaatagaccctggtgtgtgatgttcccctccctgtgtccatgtgttctcattgttccactcctatttatgagtgagaacatgtggtgtttggttttctgttgtgttttattgcagcattggaaccaacctaaatgtccatcaatgatagactggataaagaaaatgtggtacatatacaccatggaatactatgcagtcataaaaacaaatgagatcatgtcctttgcagggacatggatgaggctggaagccatcatcgtcagcaaattattctgttattgaatcctttcatttatatcactatgcttttacttaatcacaaatacattaatataaccttagcttgtgattttttagaaacaagggtttactacttctcacttcagattcatagatgaaagttcattttagttgaaatttagttttatcttctcaattattttttttcctactaaataagtgaacatcacatcttttgatcttttttctctcctgatttctattttcatattttgctttgcaagtcacattatactgtttttcctgcaaaccaatatacatcatgagctagtgtgggtgaaataaaaattaaaaaggctatgtcctaaacacaatttttccattaactaacttatgtgacatttgtaaagtatttagactgatctgtaattttattcatatttatattaaaaagttgaaactgaattatttctttgttcctatatataaacttctaattgcctacatttagttgctgatgaactaatcaaatagtaactttttcacttagtgttcattcaaaacttaatagtttaacacgttaatctatgctaggagttgttccaagtatgtgtgggagaaggcacccttaatatttgattcttctatatatctatgatatcaggataattattcttatctctttatatagaatactctaaaggggtagattttttttcttgtaataatcatttcattgaggcagttttaatcctattgcagattagaattttcaactcattttgatattgtaactcttatagactaagttatgtaccccacacccaaattaatatgttgaagccctaacccccaatgtggctttatttggaaatagggtctttaaggatgtaattaaagttaaataaggtcataaaggtggggtcttaatccaataggactgggatcctcataagaagaggaagagacactaggagtgtgtgcacacagtggaaaggccagcagaagaggacacagaaagaagccagccatctgcaaaccaggaagagaggttcactggaaacctacagggcagacactttaaccttgaacttcccatctctagaactgggagatgacacatttctattgtttatacccagtctgcagtattgtatagcagactgagcagactaagacagtaaccaaagatgcatactttaaggtaaaattggtctttgtagttgacattttgaattagttgaaaataacaccaacaattacaagaactataactgatacagttttatattttctgctttcctaatgaaattcatatacaaatctgctctcaaacaaattagactgcttttttgggtttttttgggaaactttttattccatttgatatttaaatatggctgggtgtttctcaggtgtgttctcactctttacagaaactcaattcaatttaattcactacatgattttagctttaatctaaatgttgatgataatgtctaattatttttagctgacatatctcctaaactgaaatccagctcaaaaaactgcttgcttagacacatacatttggttgttttctgaacatttatatgtatacatgttcaaaattagactcattatcttcctctgcatatgggctcatccctgtttttccagggaactgtatcatcatctatctaatttactacatttgagacatctacatcagccttgatgtattctggttcaaccgctggatctaataactaagcccagcacagttgaacctctaagtatctctccaattttatcactctctacttcatctaccacaatttaggcccatcatctcttacattacaagcatttctcctttcggtttcattccacctgcccctacattcattcatcacattatagcgagaaagagctttctatattccaattttgacatttcaatagatccctactgccacaatgttcatatgttttaatgaggttgataagatggttcatgatctgccatagtttaccttttcctcctactttaattcttactactctttcattttagtgtgctcaaattatgttgaaataattatagcatcttaaataagcaacagtaataattatagcaaacactgcaacaataattataatagcatatttattgatcacttactttgggctaggaattgcgcaaaacatacacacaaacacatacatatgcatagcaaatctctaaaacataaattcgagattgttattattgttagagactataccagtatttgaaataaaatgacctccacgaaatagttcagcaccagaattcaaatccaggtcttcctgacatgaaaatcccctgggctctcttgcttctgtgccttatatattatactttcctctacatagaaatctccacctccctttttgcatccataactctgacatagttcttgaggtctcaacttagacatcaattccaggaatatgtcttccatgataattcctcctgttaacaaatactgacttaaatcctcttcccatgcaatttagaggaaagactgtatttcctctattacacattcactatatataataaataaattttaaaatctatgtgtgtgtatgtgtatatgtgtgtatgtatgaatgtggaacaaaaacatttattttcttaagttttataattgtttactgcttaaacttcatgctgttttcatattgtcttattgatttaaactcttttgcttcgatattccttaattaaaatgtattagtggtcaatatttccttgaaagctagtcaagatgtatttattcatgaatgattgctttgtagataatagtagggtaaaacaatcaaccagctgcaaattagaactctattgggatattttagaacatttttttgtccatgtagttaaccggaaatcaacccagataatgacagattttataaattgatactggtataactttgggttatattattaaatacccatgtagcccagattcatttctatgttctttctttctcttcccaagttcttacgctatttcatcacctataagactagcaacatttgcatttttcagaggaagttttgctatttgataccaatatggctatatagaacaaatattctatgacacttctttaaaaataccactaattagatgacacttaaggtgaaataattgttttacaaaagtagagcataatattctgtctttaatttttagtagtaacaataccatattaaaaatttttaattatactaatagacttgtagcacatagaggactgaggtgaataaagatgtttaaaacatatatatcatgaagggaactgagacactgattaatgtttaacatataaggttgaatatgcatgctaaaattttagttgttaaaatataaaaatagaatgtgtgaatttaaaacccattaaaagaataaataaaacgaaaacaaataaatggaatgaaagaaagaaaatgaagcaaataaaccatataaaatagaaataaatgagtaatatgctagaactatgtcaaatatgtttaacttgataataaaagataaacatttgcttttcaaaatgtctaattatcttttacaagagacatacataaaatatgttaaaataattttataaagtttttgaattaaaaagatgaatagaattttaaataaaaaagatgaataggaaaaggaaaatattaaccagaataatattatggaagcactattaatgtagaaaaataaggcaatagttataaagtgtgtcattactttataatacagaataattattctggaaaaaatgaaaaactatatgccaggtggtgttctttaatcacttaacatgtattatcttaattaatcctaaaagcacccctatgctttaggtactattaatattcccattttgtagttaatgaagctaaaggtcagaaagtttaagcaatttgcctattattacacattattatgtgatggcaatatatatactataaacatttgtacacagtatcaaaattgactcgagagggaacagaagacatgaatagaattataactcaataaaattaaatgagagtcaaaactgtaaaaagaaacatgtagacaatttacagagaatgtttaccaaattacctaggaaagaaaaaatctgtttcatgcggctaacataatcttaaccataaaactggttaacaccaaaggagaaaggacttttagctaatctaatttatgagtataaatcttatttataaacatattcaaaaatcttaaatattagcaagcatcattcttaattgtatttatcacagaaatactggtaaaatttgatgtttggaaattgagtactatatttagtcgcattaagataaaagatacaaaaaacccacaaatatagatgacaaatcaatgcagacagaaaataacattcaaacatttcaatacctatttataattaggatggaaggcttgctatatgcaagcttaatacataaaaatcagtaatatgtgtacatatgttcataccatcaatactcatttagataaaaaagaagaagaaaatccattcataaaacaagattccataaaaaattcggggccaaattaaacaaaataaattcaaaactattaagaaaaaatagaattattttattgaagttcttgagaaaaatatctaaataattgaaacaattcatatggtcacagataaaaatattcactattgtaaagcaacaactcccaccccatatcaatttataaatgtaatgcaatgattacataaagattattttatggaatttggcttattaattttaatttattaattttaaaattcatatgaaagaataaattgccaaaataagacaaacttgaaaaaagagtagaagggcttgccctattaaatatcaaatttcttataaacctatagtactaaattattttcaaataatcacaaatgcacacataacatgcttcacttgtaaaatctaacatttatagggtgcttactatagcctaattatttttctacatgctttgtgaaaattaactcaatattcagagaaatcctatgaagcatatgaggattacaagtaaggaaacagaactggagtgtttaggaaattgtcaagattccatagctattaagtaattgagctgattttcaaatccagacagtctagctcatgctattaaccaatgtgccttaaacaccagttgacttttaactgtcattgaaacctctagtaatttaatccttctcaaattactcgacatttgtaaatcaacagatggaatctaatcctctctgaagaaatatatctgctgcatttcttcgattttctaggattattatgtattgttgattatcattattaccaccctcttttgacaatctgttctcttgttttgctatgagtttataatcatttgttttatctcattctgaatgtggctctgtttctacaatgagcctgggccaatattcccatttatttctgctgccaataatgaagagttagaaagatgctatttacacatgttattatttaaaatgtaaatagttagccacagctgctgcaattttcccaattgtaagaaagagaaattaggtggggaaatgggggcacaactacatctatcaattctctaggcattcagaataaaatatgaaagaaaaaaaaacgagaaataataatttgcttccaggacactaaactttgaattgaataaacctatgtaaatcccagcaacacttaatatatacaataagcataatcataagataggcttggaattagtaatttaaaagtttaaacttttataagagttttcagaaatattctgtttaatttccccatataaacaattggcaaaccaaaaaaacaaagtgcaagatataatttcttcagtttcaggaaaggtgacttacatgcatttttagcaagtaactttgaaccacttaaaaattcattgaaatttttaagtattaagtattaaacatattttcttcaatttaatgcttgtgagatgaatccatgttaatatgtgactctagttcattcattttcactgtgcataatattcaactttatgaatacaccaaaatttatatatccattctgctattaatagatatgttgattgtttcctctttaaaagttttggattttttggctgttatgaacaatgcactttccaacaatctttaacatttattcatgggaacacataaagataccattaaagttttaaaacaacaaaataataacacattgttaatagtgcatatatctagcaaaattacaagtaaatatatcggaaggaaaatcaaagtcaggatgtcagtcatccctaggaaaggaagggtacatcggggattttaactacattgttcatgttttattattaaagtaggttgtgtgtgtgtgtgtgtgtgtgtcttattgctctacattttttatgttccaaatactccatcaaattacaaaaagtgtagtaaaaatatgaatgtaaaaatagtctaaaggaaaagatattttcccattagagattttataaaaatgactccggaaactgtctctttttgtttgcttgtttggtaacatcgttggttgcatgtcactatttgtgaaaagtagctcctaaaacaaaaacccaatgattgcctctatctgatagtcatgtctttgtataagcttttccctttgaatgtgggctggacctattgactgacttctaacaaacagaatacagcagaagtgatagaatttcacctcaaaacgtatgttacaaaagcagtgtggcttccttcttgggtgtccactattgctctcttgcttgcttgctctaagagaaggtggttactatgttgtgtgctgccacatggcaaggaactgatatttctggcaaacaggctgtgagggaacagcagttgaagcccaccaacaatcacgtgagtaagcttgaaagtgaatctgccccgagtcaaacttctcctagatgacacactgatgacagccttacgtgagactctaaggaggagacctagctaagccatgaagggagtccggatgcacataagctgtgagataataaatgttggttattttaagccataaaattttggggtaatttattccacagtaataaataagattctcttcttaggaaaatactataaactaggctatgaaatgtaaaaaatgtttgtagcagttaaaattacaaagaacaaaaatgaaacagtcttgacatattcaaaaagatgattggaggagattcatttctagcacgtcagagcaaagagatcaaaaaaatcctcaaatactctccccaaaagaaaaccaacattccaacatgctggagaatgactgtgaacatacaacaaactgttttgtgaacacttattcccaatatttactgaacttcaagtaaaaggatgaaaatgtgtggtgtttatgcttgtggctactcctctaccccaaccaggttctgtctgtataatactctaagcagtccttagaaacaagaagctttgctgttgttgttggtgacagctcacttaatttgaggtatttttcagttaaaaacaagaagacagaagagccaacagctctggtatcctgagattgcaaccttgatctcactctatcctgtggcacacattctctctcttccccttacctctttctcaccctaccatcccctccctcccccatccatatatagaaatacccatacatgctcagccacaaacacacgctaaactatatgaacaattttatcggtgctgctactgcaatcccacatgatacagggacaatttagagccatcatgttgctcttttgtgaaaagattcctcccagagtgacttgacaagaaaccatagagattatttccccacagccacggaatatagtaggtttaagtacctctgcttaagaatcataagataaaggtgaaaaatattatttatggcaaccacagctgctgatatcgagtcaggtgtcatttctattcctccttaaaaaaaaattgaggtattctgaatccatttacttttcctcctccccatcaccttttaaacaaaaatgctgtcattgatttgcagtttcatgatgattgaaagcatgcttttgctgttagacaatcatcatttaaaagtttaatcccataattgtttcctaaatcataaaaacaaatcttaaatttcagtgtatatttaaattattaatgtgacagacagaacttagatacatgatttttgaagagtacagaattaaagaggtatttaatcactttgtcaggtaggagatggacttaatatatctaaaatcatttttggtggtctttctcactgagatggtgacaattaacacctaaaagacaccttcatgtagcaataaaaagaaataatgaggctgtgttacaatgccctagtaaaatgtcactcttttgattacttctccagaatttgtctgccaaatcccatcatttgtctcatttatctgtcattttagctgtagggtagtggtagcatcttacagaagtgctcaggttcctggctatttactaaacagtccacgataaattcaaatctgtcactacacccaaaatgaggctagagttaatttacttgtgcaaattgaaacatgccagatcttccttttgtttccgtatagttcctggacatggccactttgctgatttaagagttggaacctaattaccctttgcaacgctgctgtggtaaaatagcatgaatgtgtaaccagtctcactgacagcaatatacacagcctcccaggacagcaagccagattaaaatcaatgacttgggtcgaagggcctttctgtcctttgggctgaaatattagaaagtcaggacatgctgtattatataaacacattgaccttcaaggtatgtgtcctttggaatttttcttataatctccggaggaaatataaaaacagcaaattcaattaagttacttcacagattgacttgaatgtaaggtcaaagttcccagaaatagaccttaaaacattatctttggctacgtaaaaataacaacaacaacaaaataaaagcaaaagtgcatctctacaaggttgccatacctgtacaacatgtaacatttagtctcataatgttcagaaaatcatgatcccatataaattattcggtatttttctttcctctcttaataaaatgagttttataaacagaaatatttccaggaggggaaaaaagagaaagtagctcactatggaactacctaaatcaattttcatttcatattcatagttgaatacagctataactggctggggtaacatagtggaaaatccaatatggagacttgtatgtgcactggattttcaatcttattacactaccttgtttgaaacaacatagttagaggtcagttagtgcagtttttttctctatataagctcactttttcgggagacattcattcattcaactatttgaaaatatcaagttgagacttgccctatggttcttatattagatttagggaaggatagtttttcaactgaatgttaaatttttttaagttcaaaaagtacttgtagcatctgaatttagccactctaacatatatatacatatctgtgtgtgtgtgtgagtacacaagtatgtgtctattttcccccttaggactacaatctcatgcatattagcacttcaaatatttgaaaacaatatggagaccctagaaacctaccataatgttcttacatattcttcttttatatatctatatttttaaagactcaataaaattaaccagtatcttttctttcattttaagaaagcaaaaatttctttctacaaaatacattagcttctgaatgtatacatttaggaaatatatctcatatatatttacatatatatatatatatatgaaaattctagaaatattatcaccaatttttatagtatccattattagaaaaggccatcttacggttatctttatattctcaaaaagtttcagttgtcacatcagttgttttaacatcttgatttgattaaggtgttgattaactactttttcaaacaaaattgtttagtagaaaaatgaccctatgtccatgaaaacaagattaccaaagtaagaataatataaattttcccactaataatgagttgctacttttctacccattttttcatcggctggccaatctttgcaattaatggacacatcatagttaaataataaatctcctgatgtaccgcagtcagaaaagagtaatattgcatatctactgtttagcttttcttctcagagtcagaacagagtaaaatgaacccacccatgatgagcacatagggagggaataccaaggcagaaaaaactggatgctaatcaagtgcagactactacagctcatgtaaatgagaaaaaccatcccagagaatgagtaactgactgcttgcaccttagtgagcatactggagaaaacaaccaccccagccaagcaattaatgaagcccctgcatttaaaatctaaactgtgctcaagtgcagacaataagaactttctgcaattagtagttgataataaaggcaaggcaacgacaattgcagtggagataagtgtgagatggactaagagaaatttgtgacagacaagaagagaaacaattgcttttctaattctttgaaaagaggtatgggaccgaacgaggtggctcatgcctgtaagcccagaaagtgtgagatggactaagagaaatttgggacagaccagaagaaaaacaattgcttttctaatactttgaaaggaggtatggggccgaacgaggtgactcatgcctgtcagcccagaacttgggaggccgaggtgggtggatcgcttgagctcaggagttggagaccagcctgggcaacatggcaaaaccccatctctacaaaaaatacaaaaattagcctggtgtggtggcacgtagctgtagtcccagctacttgggaggctgaggcatggaaattgcttgaacctgggaggcagagaacctgggaggtgagctgagatcaccccattgcactccagcctgggtgacacagggagaccctgtctcaaaaataaaataaataaataaaaataaataaataaacaagatatggaaaaatagtacatcttcagaatatattgttcagagtttactgtacaaaactctgttgaatttagctataaaaacaagttatacaaaattattactttatagaatgtgttcagtcattctcagttagctcctaaatgtgttagctaaataggccaaccacatatgcttgttaactttagcaagggtgtcttctaaccagtcatgtataaaaacagattgatattcactgctataaaactccttccccaaaactcaccagtggtgcagtcttgtgttcaaaggcaggtgctaacagcacagttttcatgtaaacctcctgttagagctatctgaatctcattgaaagaatatcattgtattttttaaaaatcccaagttcaggaaacctttttattcttaagttatttggtgacattcctaatcatactttaagacttatcttaagtattatctttcttggaaaactttctcagtcctctcgaaaaagtaagatttcagtaatcgaatgcaactttatttatcctccgtaataactagattccaggcaggatctgtcataatagcaacagtaacagcagaaacagcaactaatagtttgccactgaatgtagcatcttaccttattatattgtttaatacttgtcatcacattgtatggtaggtaccataccactattaactactttaatatctggaatcttacctattgtctcatagatagagtagattaggaatcagacccatctgtcccagagtcttggatcttaaccatgtgactatgtaatacttccttattattctgaatttttttgcagtagcctatgaactttctgaagatgtagaatatgccatcctgtttatctttgatctctcaatgtatataagttaagatggggaagtcatggttctcatgatagaaaatgcacaaaaatagaaaaatgcacataaagggcttagcacactagctttctcatattagcagacagaaagctactaattagtgtctgcaaagtcagtgaattatggcattatttgaggtgtcctagcctggattcacagcacacctagagctcagagaatgataaaattgtgctcctttcttcgggtgcttttcagaggcgtccttcagacagctgctgaaaatgccatttgtcacttgtcatttattataaaattacattaaacatgctataacaataaaggacagtaggaaaaagatttcctatagtggtcttcaattactttagtcgtatggtatagttattaaatggtcagacttacctctttagctactaagatcaaaagcagaataaattttctgaagtccctttagcacaagtaactcaaaaatcacttctgcagcactataactcaaagaggtgtttaagaaatgtttccatgtatttcccataattatatttctattttactatactgtatcctaaatagcaaaatcacattctaataatagtgttgaaatttaactgaaagagattttctagacacagcaacaatgctcttaaatactttgagagacaagactgatttaattaaataataacagattcagaaggttcaggcttaagttcatccagaagaatgtgagtcattcatttcccatttttcttctgctgactcaccaataataaaggcttttctcaaaaactattttcaaagtagcttcattctgatgcatatatagcatagacaaatttaatcatcagcacgttttcagtgaagaattgtagtaaattcacccattttgatatatatatatttttttacagtatccacacttcaaagttgttgagccttttaaaaatagggattatccctttgcataagaggaatagtaaataattctcattccactaggttaactggacccttgggccctctctaggaagcacagtttcaagataagcacttggatctgacaaaataaagcaaccagctaataataaaccaggaaccaataataaaactacagtattgaactgaagattcacataaaggaatgtcacagagatatgatgctttaagttatcctagaattacaattaggaagttaggtgaatctcactctctctctctcactctctctttctctctcactctctctttctctctcttcccccatcacaactttgcaagattattactattacactagttttttaaaataggaaatctgagtttaaagacacttcatgcctttcccatagccatttagctataaaatatagagacaggaccaaatgcattgtttgtgttttctgttgcaatgtatcattttcttacttattttatatattctggaatgactgtaatatgaatgtgtttgatttaaacacaagttctcactttttttctctggtgcaataaggtacaattctcatattttggcataaaattcagtgtatctgttaaataatgatagtacatattctatttaaaaccagtggcataaaaatttttcttcattcaacttcaaattatattattttcatgtgcactttacttatatttcaagtttcaatgattgtattttgtttttagtttccatcaaggttagcaatagtttttagatttatttaactagcatgaaaagcatcctctttcaacaaaattattaataatattgctaatctactcgaaaatagagaaaatattctcaaatctccaaggagcacttttaagcccttatttaaaatttgaaaataccttttattaaaatgcaaagacattaaggctcaccagctactacatctcaatgcagggtgtattggatgtgtttgatgaactggttttattgggccatgggaaaatgataaataattaatataggcttatatctacaaagtttaattatcttcatattaaggtttcttttgatattcaaatcaagaaataacctggtgatttgcaaaactgaaaatcatataaaaagagataagttcaagcagttcattgacttttgttgtgtatcttaaatagaaatttaaaatgctattgcaacagagatttaaaacttgcttaagtctgtaactgacaattgaaagaaaggcagctgaggaatttataaatagattacatattcccttcaatctgtggataacatcttaagtgcctgagaagtgcatttatagaaagtcatctgaaaaccatgcctaataaagaaaattaaaagccacgtctgaaataaagttaaaactgacacaaagagaaaatgcagcaaattatgatttttgagcattctagtattagctaattttaatttgatttacattttaaatatatcctattttggcacttagtccaggcatttagtcatatatacatatatatatatcactagttaaatagtaaacttataaggaagagttttcaaaacaaagagacatttatgtaatgactttgtaatctacttaatttctaagaatattgcagtcatttttaaaaagtgttttctgcttttagttacttgttttcagggaaaatggaactagaataccttaaaataagctaaataattttcccttgagtggtaaaatttatgtaaagcaccaaacacattgtgtgaaataattggttcacattaaacatattataggagagtataagtagctgtagtagtaatagtaaagaggttctcagtgacaagaatcctgggatgaagaaatcattatttccatttattatttaagagaaagatgcagaggttttaaatactgtaagattaaacaacttctaagcattggagccagaattttaagtactagctgcttcctaagcgtatactttttgcagtgatttaacaccgcccactaactttatataacatcaggtcttacaagctacattataatataaacagatgaatagtggcataaccctaaaaagctactttataagagcttcacattttaagaagttaaaaattattttcattatttaaaagtatattctcaatttaggattcatgtatcatcatttacaacataggcattattaattttaggttcaaaggaatatgtgtaagtttgttacatgggtaaattatgtgttgctgaggcttggtatacgaataagcctatcaccaaggtagtgagcataatacctaataggtagcctttcaatgcacaccctcttccccactctctaccctcaagcagtccccagtctattgttcccttctttgtgtccatgtgtattcagtggttagctgccacttataagggaaaatatgcagtatttggttttctgttcctgtgttagttcacttcagataatggcctccagctgcattcatgttgatccaaaggacatgatttcattattttgtatgactgcatagtattccatgctgtatatgtaccacattttccttatccagtccaccattgatgggtatctaggttgattccctgtctttgatattgtgaatagttccatgatgaacacaaaagtgcatgtgtctatttttataatacgtaatacatatttataaaggttcattgctgctattgactgaatgtttatgttccctcaaaatttatatgttgaaatctcaaccccgaatgatatggtacctggaggtggagcccttggtcaacaattaggtaatgagggtggaagcctcatgaaggggattagcatccttttaagagatagacccttgctgtcactctctgttctccaccatgtgaagacaaagcaagaagacagccatctgcaaagcagaaagtgctccgtggctcactagataccatatcttccagcaccctgatctggatttcccagactccagaactgcacgaaataaatgtttgatatttacgctgcccagtcatctatggtattgtttggtaacttgattgactaagacaactgccctcaggcatgtttgtcagaaatgttcttgttggtgaatctgaaacaacaagattagaaaaaagtactgtaggctgggcctggtggtttacgcctgtaatctcagcactttgagaggccaaggagggtggatcacgaggtcaggggttcgaaaccagcctgacgaacatggtgaaaccccgtctctactaaaaatacaaaaattagctgggcatggtggtgtgcacctgcaatcccagctactcaggaggctgaggcaggagaatcatgtgaacctgggatgcagaggttgcagtgagccgagattgcaccactgcactcctgcctgggcgacagagctagactctgtctcaaaaacagaaaggaccataacagccaagaaagcttatattattttagcactatggagttatggtaacatattcagtccttgatttcctgcaaaatgataccattcatatgcacttttgcagcaatcctgtttaagtaaaaaatgtattttttttacttaaaaaatattcatagccatgtaattatatctctagctacagatctgtgcatatgagcaataagtgtattgtcttcatacatttgcattgaattacttttgtgtgacctagtcaaaacaaactggtcaaaacagcaatttgtttaaaatagattaaatggttagtctttacttcttaaactttggctagtgatatctactttaacttgtttaaaaaatgattgagggctggacatggtggctcacgcctgtaatcccagcactttgggaggctgaggcgggcagatcacgaggtcaggagatcgagaccatgatggctaatacagtgaaaccccgtctctactaaaaatacaaaaaattaaccgggcttggtggcaggcacctgtagtcccagctactcgggaggctgaggcaggagaatggcgtgaacccgggaggtggagtttgcagtgagcggggattgtgccactgcattccagcctgggcgacagagcgagactccgtctcaaaaaaaaaaattgataaaatgataggatgagtactagctataaatgaatacaattatgatgaaaacattgcaatgatgctatgaatattctgttaaagctttcaaccagactcatttagcaatgttttcagacttttattttataagtcttttattttaaaagagaattgattagacatttggatgaagaataaactctcaaataattgaaagagatgtgatgagtaattttatgtgtcaacttgcctaggttatggtgcccatttgcctagtcaaacattagtacttggaagttattgtttagatgtgactaatatcttaatcaataaacgctgaataaaacatattattctttataatgtgaacaagcttaaagttgaaaactttaagaacagagactgaggtttccagaaaagaaggaattctctccaagattgcaatataaaaactctgcctaagtttccatcctgctgctttgtgaagttaggattcaagactgaaacattaattcttacctaaatttccatcctactgacctgccttacaaatttcagacttgtcagctcccacaattgtgggagccaatttcttaaaataaatctcctcctctgtccctctccctctctctctctatacatatatatgtcatatatataatttgaaatagtattttcacatctgattttttaaataaagacacataaaacttgatgtctaggtaacttcccatcttccaattcaacattccaacaattttgactatttatcctagaaacactttctttaattcaacaaatcattatgacaaagtaagcatctctgaaagaataataaaattagcttttaaaatattcactttctactaattttttggtttcactaatttgttgcttcaaaaccataaacttttatcagaaatgaagattgtagtaaaatgtcagtgctagagtgtacctgagaaaaacatcttccaactcactcatttcaaagtgattgttgctctgaggtcatacaaataacataacaggatgaagtctactaataagatactacattgatatcatactcaaagaaaaacaatcatacattatgtggaataaatattaataataaacagacaggtatttgttacataattgaagaacaggaaaaacaaggacagtttcttcctccactattttttcagcttacagaatagtaattcagatcaatttgcaaagaatataaagatggatttgatagtcagaagttttagaacaacataatgtatgacatttctacttcattgcaagttttggcttaaatggctgaccaatagtaaaaagcatccttaagtaaatttaaaagtataaaaccataatatggatctcagtaacataaaatacagatgacataagaacccagaaataatatgtaaaccaaatgcaatgaataagggtaaatgaaagagaaaattaggagactgaaacaaaaagagagctgttaatagagaaaaaatggaaaaagaaaacagaatacatgctttatatatatttatatatttacttgtatgttgtatatatgtgtttacatatgtatattctatatagtaataaggatgaccaaagaacgaaaaaggaagaagaaagaacctaatagtggagaagccttagcacaaaaaaatcaccaattatcaccaccatatatggcatttttaatttattttttgctgaagtaaaatgtaatcaaatacaatagagctaaaataattagaaatatttattgaagacagaacagaatgaacgaaacaatttaaaagaatatcatatttctaaaactattctttttatagaataaatctgtttcactggaggcaatcaagagtttaatgccataatcaatatatgacattagtttttaattactcatatatgcaaccacttccctttttctatttttcttttcttttttctttttcttttctttttttttttttttgaggagttaacagtctttattgggctcagaccaggagtccgtgagtcttgaagacctctgtatatttgtcaattttcttctccacgttcttctcggcctgtttccgtagcctcaagagctgtttcttcttccagtactggatcttggccttctccttcctcttctcctgcagggtggctgtcactgcctgctacttccagccaacctcgtgagccaggcgccccagttaggcaaactttcttgcaggcttcaaacgcacgaccttcagggcagcaggagccaccatccattttttcttgtcatagggcggtgggatgccgtcaaacaccttaaggcagtccagagcggcctggcctcgcttggtcttgtggggcagcaagcctcgctcggtccgaacttcaacttgtttctgtagaaattgccagaaatgttgatgccttcgcagcatacgaccaccactttcctgcccagcagtacctgtttagccacaatggccgccaggcggcccaggagatggcctcgaccatcaagcaccaagacctgcacctccgccatcttcggcagcagcttgggaaagccctttttctatttttattgcattagctgctagtttacctgctccatcaacttcttgaggaacatttttcacgtggtttataacccctctctcttacatgattcctgctaccaaatgctgtgatttcaatatccgcatcaatccatcctcactaactccatattccctaataccctctactgaaaggacagtcacttccatttcacttcggcaacactctcacaaaagtattatctagaccttaggatcacacaaagacatcctagctctgaaattataaacccagattgttctcccttttaccttggcctcccatctcctgttctttctctgtcttgcctggtgcacctactcatcaacctgactgaaaccttagtgctgtttcacaagcctctctcctccaagtaaatggcatgtcctatgtttcacaatacttgtctcaaatatgtagaattctcttcagacctctaacccaactgttgctcacattctcaccaaaataactttctattttagtgtctcaaaatggacaacacatacgaactctttcaacttcctagccactgccagcctactttatctgtttttctatttccttcttgtctacctttgtattacaaagacagtttttcctaaagttatctgagtttttattccagtccctccagattctcaattccatcaaatatcctctctgctttacatcatttatctttcttcccactcatcatctgtaaaatgggacttgtacctatttaatgtattaggtgaaatcctatatgtaaagcacttgacacatgtacagtacatattaaatgctatgagatgttattttattattgttagtagagtaccagtagtattaatagtgatataattttaatatacatgaagtcttttacacctaaatataaacaaattaaatatgacatatcccactgcctcttcctttcactcttactctttttcttcttagcatcctttattgagttcttaccatgtcattcatcattttaaacctttctatagttgtaaaacttaaaatccttataatgggcttaacacttttgggggcaaatagcaagtacttgattaatgttagtaaaagtagttgtgatgattagataataaaaacaactgtatagatatcatcatgggcctttgataaagagccagggaaattgtccaaggctataaacctagtaaaaggtggagatgcatgcttgcaattagattaactcattaacacatttgcttaacaatacctacccttggaagctttccattaacttcctgatttttttttaaaaagggccctttatcaggcaccaacccatgtgaaggtcacaatggctgtcaaagacaacaatccttcttggagcttttgtctcctataacctagcatgccatttgtcgataggaattaagagctgaccttcctgagctctgactttgtgtcagccattgaaccaataactatacaggccctgactaattttatccttacagcaatcctataagggaggaattgttattattgtctccattttacaaatgagcagcatttaggtgcatgaggttcagacagtgaaaatatctgaattataaaaatttatacaagtgacagtgtaaatccaggatgagaagccagcagcttggctcatgtttgtactcacaatggtgctctaatgaccttaatgcccaagttagtagcacataatactgaatacatacttgtgggacaaatgttaatgctatagaacttatataacacatagctaaatgcaatgttaaggaagatctttgaaatactggaaaataacttttctctccagtttggtgttttaaatacctaaaaagagtttccaattctcatgttcaatttgaagctaaaggatttgtgtttatggtcttaacatatacctagacattaaaaaaggagaagaagagtaaaagcaattacagatcctatcacgaacaccacctgggcactctgcagtaacaggaatccaggtatttcttatttggctataacaaggtagaagcatttcattaatctaatatttggcactagtttccccaaagagatcactctttaaaaatacatttataggtgttcagggtgaaggtaaagctgggagttcaggagggagggcctatcggggcttagagaagggggatgctatttgtcatgacatgggagttgatgacagatggggaaagagatttgttttgtggtcctgaaaggaagaaggaaagagaagcatgcagggatgaatggtgccaggaagacagagaatgtttgaatacactgagggaacacaagaaactaggatcaatgattccatcaggtccaggtagagctttaggtattgctaggagcctcaatcatatctggacaattttcagttaagtcttctgggctcatggaggcttggtggtagtggagttttggtgtgaaaacaaatggcaccatgctttatgattggcccaagcaagattgcacagtgacagagaaagagaagtagaagctcaggaggcagaaggctttgtgaaccagggtaattttcagaaaccctaggggaagacttttgacagagtgttaaaatgacacacctagttttgattcaagagatctgggcttagaccaagagtcttcaaatgttttaaatcacaagagattaggatatataaccagagttaaaacccgcaatatggtttcagagctatgagaaggaaacttatctaaaaatacttcctgaggatacactctaattgcaacagagcagataaatgtctttggggtctttaggcaaggtaaaagaggtggtgagatctgacaggtgtcaataagaaaaatttgagttggcacataataatatttagaaaagtacaaagatgaaaaattcaaacagaattagaaatgagcatatacacagtgaacattttgaaaggactatacaatcttaattgaaaggcttgctaattaattttttatgcatactaagactggagtcattccactttgttttatccagcagttacagtcaatattaccaatattaccattcttgtcttagaacaacactacatgtttaacttacaagagaagatatatggtagacaaagctgaatggaaatggacttaccatggagagaaaattaagcagcaacaatttagtaaaatgattttattataaagttatgcagaaaatgtgttgatttatgcatatatgtctttcaagtaaaataaaacacaaattcaatgggaaaggaaatcctgaaatagaagtgaaaaactaaaatcttctctgtcaaaaggttaatgcacttactgaaaaagtatataataatcagttacttcattttaggtatactttgcattctcttctaagctagagtacagaaactatattcatgggtttttaaaaatacattatctcattcctctaattcccatcggttgcaacaccttcttcattcctagtattattctgttaacagtggaacttcaaaaaggtgtgctcactgaatgaattagcttgttgacaatagtttacaacagttcagactcatagtgaacttgttattcactatgttattaataaaacatgttatttgctaaatgacatgctaaaaaggaaaatgtgctagttttctatttctaatgttgagttcttctactaccaacattatatattctaaaacaattttactatgtaccaattgtgggtacacagttacaagacttaatttctaattcctatttttgccaacaacatgctatgaagatttgaacaatctacttaaattggagtggcctaagtcacaaatgtagacaagagggcttctattgattgctttctctctctcagccccttcatcattcacacatatactagcaaattttttcaaatgacaaatgatatatacagatacataacatacatatatagttcgtttctgtctgtacgtgtatatgtgtgtttgtgtgtatatatatgtgcatatgtgtatatatatgtgcatatgtatgcatatatatgtagccccattctccctgtcagaaaaatatctccctctcacctagacttgctaagtcaactctttcttgacaacttcaacacttcctttgatcatgatggtctttagcgactatttattcccctcagcttctgtaacatctcttccttgtgcttatgatcttatgtctattcttacttctcaaagagtctataatttattattgggtagataatatgctttatacattttaatatctccaagcctaatgggtattcagaaaatgtttattggtacattattaaaattattcagaactgttcttagaaaaagaaagtaaatatatgtttattagaggtctatttttccttctatactacaaaaaacactcaaaaatcttcattctagatgatttctgcttaatgtgaaatatcctttcaatagaaaaaaagttcataaataatctaaaacttttgcagatgattaaggatgtttcatccaattttttcatttagaaaggaaaaaacaagcttagatgtagaaaagtaagtctctttgttaaattcacaattttgcaagtctgagagctaacacaaggagaaatggaaccgtgatcttctaatcttagcttagcatttcagctactacaacaattatcttaactctgctatgctggattctactctccctgatgatataaccatgctgtctctgtttaccactgtgttcccagcactgagtcacacaaaatctgcgacacagaagtcatttgataatggtttgttgaatgaatactgaatgcttcactatatactgtaccatatgaagtagaattttactcccacaaagggcactattcaaaaacattgttttgcagatctcagtctcacattgaaaatactgctgttcatagaaaaaagaaagaagatagctaatttgtaacactgggttttccaaccaaaacatactgacccctcagagaactgccattaagattattagttacttgctctctttttcataatatacatatggacaaatgccatcatgtctttgcctgaatgcttgctttgaggaaatttataagaacacaatgtttaagcagtaagttatcattgagaatgagttatcacagactttaatttaaaacatatagagaggccaggcctggtggctcatgcctgtgatcccagcactttgggaggctgaggcagcagaatctcttgagtccaggagtttgagattagcctggttaacagagtgagacctcgtctgtacagaaagaaaaaaaaatagcctggcatgttggcacctgcctgtagtcccagctactcaagaggctggggtgggaagattgcttgagcccaggagttaaaggttgcagtaagttaggatcactccactgcactctggctctgtctcaaatataaaaataaaataaaataagtatataggtagggctgggtgcggtggctcacacctgtaatcccagcacattaggacgtggaagctggaggattgcttgaggccaggagttcaagaccaaactgggcaacatgcaagactcagtctctacaaaaagctagtaaattagccagccatggcagtgtgcacctggagtcctagctactcaggaggctgaggtgagaggatcacttgagcccagaagttcgaggatgcagtgagagctattattgcaccactgtactccagcctgggcaacagagtgagaccttgtcctaaaaaatggagagatgatagatagatgactgacagaccatttcttagaagtcagagatcatgaaagtccacaagtctaaagaaggatgaagataaaaattcaaatgcacattttaaaagagataacatcactttgattttgtctccagtgcccttgagtaattaagcaacacgtgtttctcataccctaagtttgtcactgagttgttcatttggacatagttacagtaaataatgacataaggtgacctctactctgtaggagtttacaagacctttgggagaacaaaatgtatagctatgaatatgggggtcaagaagcatgatagaggatggggagcagggaggtgaggtcgaaggatgttgctttaggaggatgaggaatttaatttcaacagaataggagaaaaaataagcagaggggcttggatttgtagtaatcaaaaacatagaaagaatgtaaatttttagcggcaagtactgtgataagcattgaatttaaggaagattgatctggcaataatctgcagaatatatttaaggagagaactattattgagggagaggtctgctgggaggccttttgcaggaaccaggtgtgaagtgatgagagactggaataagatagtggaagtgggattaaaaaatggaatttgttcccctttctctattttagctcattctgaaaactggaaaatatttctaaaagctttttttcacatattcccttctacatttagaatacagcgcttagggagggacacctgaaaacgtttgaaacaaaccctttcatttacttcattcacagccatctggatgtcttgattgcatatctgcctcagcattacctcatgaaacagggatttttatattctaagcctggtgacaaactcaagagatcatgaataaaaacactgcagtgccctctagcagggtgcagaaattttcacttcactttcagtttaagagattgaaagtaggctgcttttcagatacttcagtatttcatggatcaatcacaccagtatgtttcagaagctaagacgtattaaatttttccctctatcaagagagaacagctaagtttttgaaaatatcaagtattgaagcaaggtcagatgtactctctgacacccttctcaagaatcatttccttcaattgtcaaagggaaaaaataaaataaactcttgtcttaaagttggaggtagaaatcattttaattttaaagagcttcttattttgtatgaatctcatggcttttttactctctctgagaatccgtccaccttatcctataatgccagtcaacaatggatatttaaagtacttgaccttactcacggtatagaccaaacagcaaaagcaaaggtagccaggtttccttgaaactgttataaatttaaatttgatagtataatgtattctgaatacattcagagaaagtatggcctcaagtgctaaataattaagtaagcaataatttacctttcaaacttttactttaccttctgtgtgactcagaatttgctggactttaaaatacgtgggaaaaaaacacattaaacatcctcccttttttatattcaaaccattttattagctcactttacttgtacaaattatattccttctctaaactctttttttttttttttatgaaatgtctgtgcaatacagagttgacggtagcagactttgccctcagggagaaagctagattcagagggctccatgaaccgcctggaaatcagaaccctggatgccaatgtccattctctggctgactcagcaggagcatctgcctgccacataacctttggctagggaatcccacctagacaatggactgtgttcttaagggccttttattcagtttaaccatagatttacttcttttaaatgaccaaatttataaataatttttagatgaaagagaatctttatgaaatttagatgtgaacattttaaaagatctcttggtaacaataagagcaaaagtataaacacaggcacacattcgaatagccttctatctttatgaaaaacactacaagctttcattacaaatgtattcctgagaatacgtttgctcgggaatggatagtttttataagagtaacaacctagaaattaaatgcacactgatgtaatgattatatcctttttttttaaattccttaacatatttagtgagagggctaatgaatgtcatgcatcacttttcccttagtacttttgatatgtaaacaaattttttagatttactcatctaatttttaaccaaaatacttttaggtctatttttcatgtctccaattataaggttctacagggcaaaagccttgtatttttgttttatctctcaccagtagttcgagtagagtggttttcatattgtaggtcatcagttaacattgcaaactgacagactaattgaagtggccttcccagccctccagctcagaaggcttatagaatgcctgagattttcagaatcaggttgaatgagggacctaaaggcagtaggaacaggtgcagagcaactgagggaaagctgacagttgccattctgatgatgtatttgtgagattctggaagactccagtaggtgctctgtgaatgcatcttaagagggtgcatttgaccagtactgaatggataataattgagataggactaaactgatttaaaagtaattcttctctaatgtcttctgaacacgaatcagtaaacaggtatgtaataggatttttgacaaagctcttttattaggaactctaatactatttggaaattagattggttgtatgtcccacttgtaaataacactgataagcaagtactcttcatcggtataattcagaaaattgcaaaatcctgtctcaaattttattaatagggcaatttgcatgacagcaactcattttaataagcattgtaattgccacatcaaacattattaagaccttccaaacccaaggctgatgttttgggaggatgggtggtgggtgagaaaattttgcttaataggatttacataaaggattgttttctttccagggtttgtcacgtttccagaattcccattagtcattctagcccttttcctaaacttttctgtctaaaaatcaagttgatggttccaataaaaataaactcattgtcaataatattttgctgtttggtttataattctttctaacacaggtaaattgtacttgtaaaataaactgataatatgttatactaatctcccagttgaaaatgtaataaatctatcagacaaggaccaaaaatatcactgcttgttctgaacataatgaaatgcagcaatctacctaagtgacatgaaagtaggggataagcttcagaaataagaatgcttacaacatgtttaatggatattggaaaagatttgtctcatgtgtgaacagtgtctgtacacataaaaacttattaagctaatgcctctcagtctaatttctttttgaattaaaaacaagttttaatcaaaccctaacctttaaagtcatatggcctctattaccctatgaaccacacagtcatggctaagaataagtgaaaaaattagatgaacacactcttagaaaattgtttaaatgtcctcaagaatcttaaggtaacaaatatatttgggaataagcacatcaaaattctatgaaaccgttttttttcctacctaggatatactctttcttcctccaaagatagattttagggttctcaataagtggccattgcttcttaggacaaatgaaacagtatcggtattagaatgctgaccctcatcagtagttctgcagttataaaattacaattgcaggggctgggcacaagtggctcacgcctgtaatcccaacactttgggaggctgaggctagaggactgcttgaggccaggcatttgagaccagcttgagcaacaaagcaagaccccactatgcatgcctgtagtcctagctattcaggagcctgagggggaggatcccttgagcccaggagtccaaggttacagtgagctatgattgtactgctgcactggagcctaggtaacacagcaaaccctgtctctaaaaaaaataaaacataaaaaaagaaagttacaatttatttattttgcatcttacataaatggcagatcatcattcatatggtaaaaacattggcagtaaaagttcaacataattatgacataattaacagtctatctttcaatttaagctctcatttctcccccaaacccaccatcgtaaccactagtccctaaactctgtgggattattctcccttatttcgtgcctttaatcaaatttctcacccattaaaagatacctttggccttccctactactctgttaagaatggtgaggggtctgatattttccctacttgctaatatgttagtctgccacagtttcatggatgctaaccaaaaacacaagactcctgggtctgagagaaaagacctcattactgaagcctcaaaagtatgtgcttcctgtcttcataggttttcccgccttaattttcataggaacaatgtgttgggcagcccaggtgaatgccaggcacaccattggtttttgacacagctaagagaccctgagctcaggaagctccccatcttataaaggtcctgcaagaaagcctgattaatctttgcccctgaggtagatattatctttactatcctggtcaggaaacaaatctgccctcttccctaaaggcagacactatctctattgtccaaggctgtttgttacacaaacactcttgaaaaaaggagttccgaacccaagctgccaaaaaaagtgtagaactgccagggagaattctttcaaaacccatccttaaaattgcaatgtaaatcctacttctttcataagaggccacaataaacttttacttccagcactatattttcagggtcattagcatatcattcactgttgtgtggcataatttatgttattaaccttattacttaacatttgtaaaccatttaaatgaattaaattgtcactttgtcttcttaagtagtttaaacccattgaaggtataaattatttaataagttcctttttagcccacaaaattcagtggagctatattttgaatagacactcaatgaatgacgtaaaagtcaaagttattttttaaaatattttattctaaacaacatgtaagaaaattgtagtggaaattaacctaaagagttttattctaaaaagtttagaagaaaaattagttatcagaatgtagtaccaacattccttatgctatttgcctatcttttatataggagataatatgtttttagtcaactttatttggtgtcgaatataaaggaatgccaattcttatgaataaataaagtgtgagtataaacctagttttaagtttctgaattaataatgatctgctaaaatttggaatgaaattggttttgacttcatggagcttagtaacaagaacctccaaggtaaaaatcttcacatctgtactttattaattttttaaaaatcaaactatgcaagtgcagttttaaaagccaaataatgatacatcaaacaaccctaggtatttccaatacccagaggcaaccttttctaatgcatctcctcttaactatttataaatgcttttgccttcatatttttaagtgttcaacttctgtttatagacttatttttcattttcacattgtcttactgatttcttcttacagaaaggaagcatttaactcttatactaacctcctctcatccactatatatttatagcgtgcttttggttaaatcaagtgttgctattatgactatgcaagcgatctttaccgcggaaccttgtagtgtatttggattacatttcatttcatatagctttttacattcccttaataactcacgtattttgtatactcaattttgtatccacctatcattaccatattattaagatttccatgagaatttgtctctaaaatatcaggtaagcatccattattccagcttcaatctgtcccggttgcttctgaagctcaatgtatgacaagcttctattgtcgtgctgccctgtttccttatcattctgagattaacttcaatatcttcctatacatagcctcttattttggggatgatatttcttccttttttgtttacttcttagttttggaggaaaatagataaaagtagtatcctcagcaagggtgcattagccaaaaaaaactgaaatcttataggtctaaaaatgtctttcttcttctttgatatttgaaaaaatagcctggccatacagaagattctagttgaaataattttccttcagaatttcaaaagctttactcagttgccttctagccccagatttccattgtgcggacctgtgccattttgattcctaattttttacatgtgagcattttggaaaaaataaaaactgtttggacattttaaagagcttcgtttttttcctaatgttttgaagttgcatgctgatatgtgcattgaagatttatttcattgtgttaaggatccagtggtagctttataattaagaacacatgtccaactatgataggaaattcttaatttaaaaaaaacgtcattttgactgtttggaactcttattattcaaatgtttgatctgctagataaatactctaattttcttatcttcttacgtagtatctacttgattgtaaaattttgttttactgttttccagcccttctgctgatttttatgttatcacttttaatatgtaagagctattttatattctctgaaagtcccttgtttgtgttttcctgttcttgtttcatgaatacagtattttccttttttttctgagaatactattagtccattttcataccactataactgcccaagactgggtaattcatgaaagaaagaggtttaattgactcacagttcagcatggttggggcgacctcagtaaacttacaatcacagcggaaggcaaagagaaagcaaggcaccttcttcgcaagtcggccgtgctgagcacagaatggaaagagtacctttttggcgagtagtagccagcttcttcacaaggaaaagtaccgagcgaagaggggggtaaagagtccctcataaaaccatcagatctcataaaaactcactatcacgagaactgcatggaagagaccacctgcatgattcaattacctccacctggtctctcccttgacacgtggagattatggtgattataattcgagatgagatttgtgtgggcatgggggaaactatgttcagccactcagaagacactcagaagcgatttaccccaacaacaacaacaacaaaaattgtaattggttagcttttgatcagaaatatttgcataaataaccaaatcagattcgggaaattcaagtcactgtgtggttataaaatctaccagcctataaacatattttatcaataaattatgtttcctaaaactcttggaatgcttttacaattcttaaatgataaaattataggtcctataaattgaggaacatgattataataatttttcaaactgtattcttgattaacatagtaaaaaaatgcatgtggtagttcctttataaaatctatataccttaatattttctactaaattttagaaaattatgtgggaaaaagtcgccaataaagatacataaactttctcaaagtgatcaaaatgttaatatagatattacaaagatttcaaaatatctaaagaaagtcatctcatcttacattattcaccattgtgtcaaattcctttcgtgaaactacatttcctcatcaaaataatgttagcacataattttattttaggaaggttttagctctaaaggtagaaacttgtagaacgtgggatttgctgagaggtacccattttcactattataaaagctctctaagactactgatgcattacattaatatatacattatgtgttattatacatcaatagattatggggcagattttagagacaatcttttacaagggattcaagaataaattctaacatcattaattattctttttgttaaaccaagtcatagtctgcctcagcttggtgttgtaaaaatagtttttactgctgattttgcatgagtgtattttgtttttatgcatatcctgcttccaagttgtactgatattgatgaaagttccacatgtgaaatcagtttagaaaaagaaacagaaacctacaatgcagtggatgattttaaaggcatgatttcagataaaaacagtcctttttttttagcatttcctaaaatagttaaagcaaaagtacctgaaataaattaactcattcacttgcttatagtttatataaatgaatatctattcaactaagctgtccaacattcaatcaaaattagagcacaaataaatcttaaggattataattcaattttagacaccagcattgccatatttaaacataacatgaatacactagtcatgtctttatcaacaatgataaagcatgttttaaattatagaaactcaggtagagaaaatgtacttgaacctaaaaactctggtcttcaatcaaggttgtatttggagcacatggactccttagataggtctagtggtctctattgttaagtgttcttatcactcaaaggatgtttgaaaatttactatctgaaggaattaatttattcaagccatcaaaaataggaataactactttaaatatatgtttacatccgcatagtagaaagatcattggtgctaaaggtaaggcattctctgggaaatttatattagagagatgtcatgtttatttatagagtatagaacttaacatcatgttattttctcaaatggtataattgtagacagcttgttaataaagcctagccaccaaacaagtactgaaaatagtacttcaacatggtatgcatcacagtgatgtttcattgaaataacatagaacgagatgcttgtcaagtcgaggttgcatgagaaaaccccaaaggaagtcaaagaagagaaaggtaacaaaataaatgtcttcaggcgtggttgaatggaagaggagtcaaactttagaaggctagcagggtttgggaaatctggagataacagtgctattatttccagtaaggtgtgtgatatgaatgagatactcaggcacaacccagtctgcacagcaagagatatgagcaggtagaaaggagaagggatactgcagactagcaatgaaaaaggctttctagtaaaaggaaaagagaaaaatattttttaagtctctaaaaatgtgaatttcccgctttatatttaacttgttaacccagcaataagatttttaaattatcagacctattgttgcagaaatgcaagtcaaaaattccatattcaaaacctttggagtatgtgtttcagaaattttcagattttagaaaggttatatagtatacatgccatctattacataacaaacttagctggatatttggctatattgtataatcaaacacatttcctgggcaaaacgtgattattcaaagtctggtaaataaagagtgtaaagcttttttctatttttctattcaagtcatttcaggtcaaattttgacaccacactagttaacatcaagttttgcttataaaagttacaaacaaaacatacccactgattttcagaagtttttagattttacaattgtgtttaaggtattgaagaggtgtattttaaaatttcatgacctaaactacaataactaaaacagcagaaggatgtactctacactattatattacaaaaagtattcaattcatgtaaattaaacttaacctaatttaaaattgtatatgaacaaaaatactgaaaatatttagtcaggaaaatggaagccaggggctatattattttgggaagtatacaggtgtggtcaacctgtgcacccataataataaggaaagggtggtacaggggatgaatgtttctgaattatgctaagggatgaggggcagggggcctcaggaaatagaagatactggagaggatgaaacaaggatttctcccccatcctttccagaaggaaagcaggtatctgagtgtggaaagcaaattacaagtgctgctttatcacccacttctcagtcatctaaataactaaatgagattcagcagagcatctgacaagtagaccatgtataatttcaagccccttgctaactaggtaacatcctatcctgcaatgaaagaaaagaaaggggaaagaaaggaagataggcagaaaaacaacatctctcagttgttgcttatgtctaaattactttaagaaaagaaaaataattatcttacatcagagacctaaaaattaaaatgcaaattcttgtaaaaacataatgaagtgatagaaaaacctgggcaaaagaccaaattaaatgtaggcccttgctttgtttcggtggggaattaagtaaggagaccaaaaagatttaaaatattatcatcaagagcaaaatgtaggaaaatgagactaagaacaaaaataaatcaacaaacacttttcaggtggcacagcattgtccagggttggtgctgattacttttaacagaattggaccaaaagcagactatacgtagagatttttggtcatttacaggccaattcataatgctctgtttgtatgatgtacatttaaaaataaacaagaatagctgtattcacatgtaggtaaaaaaaataaacataagttaaagaatatacagcatgatcctattttaataaaaatataaaaatgcatgtatatctttatatataaagataaaaaatgtgtgcattaaaaccctagttattagtgggattaccaatggttactgtcttcttgttaatattgttcctaagtgttccataatgaatatgtattatatcatagaagttatgaaagtttctagtgaagattcctttcttcaggaacgttttaagggagctatcattattttacacagttttcattctcagctaaacagaacgctatggtttttcagaaaaccatagacttgtaagacaaaagaaatccataataggcttaattatagttttctggaaaatttacttacagtatacatccactctgattgactttatcgctggagaccccaagccattctctgctttacagtaataccggcctccttggtgtcgctgaatatttgtaatcctcaaagtctcattgaagacacttgagtcttggaatctgtcagaggcacttcctgctgttttggtccacctgatctgagcaagcatcaacaaagattgttactttaggttggttttcccacagagaaatcaaatagcaatcactcatttgaagagtttgcatttagagctgctacattgcctctcccatcaaattattgaagaaaaaattaatgtttacagacacgattgaattaaaaaatttttaatgtaatgtcatcattgtacagtgtgtgtaatttgaattcaattgcatagaattcatcaattgcctagtcagtgtggagggcaatataaactataacataaagggagttaaatatcagtagtacattgaaaatatagattaacttttctttttgttggacatttatatctgtttttcatattttccaaaccttgtgagataattttacttattttgtccaagtaggttctcattttatttttggacatgcctcattcttttatttgaaattttctatttgatttgaatagtttagacataataccataatggcttattgagattatgtataattttaaacacctggttgtttaagagtttgttttcctttgatggctttgcttaataagcccacaaatgatttgtctattttgatcatcagtattcactttacatcaataattattttaaaaaataatgtaaacttttcaaggagaacatttctactaaactgccaaaacattttgaatatctaaaacatttcattataaacaataccattattttaaacacagctgtctacaacagacttcgtttttgctggcaataatgactggtattcaactcaacttttgtgtattttagtgtataaaacctgaataaaagccacatactcatactgtaaagtgatacaaaatagaaagtaaaaataatttgattttatttccctttgtgccctgctatatattttagtttgtttttaaggttgagaaacagctgatagaaatcctctgttcaaacacatatgctgtgacatggaaaatgaaactaaatactgaatcatcaaaacagaaatcctataatattgccattatatatacctattttcatatgaagttaattaaaatgtatgagctaatggcataaaaagtatctttaaaagttatccacataattaaaatatctataaatataaccacgtttgcccttaattgtgaatggaataaaaatgttattaagagatgaattttaaaaatctgtaaatcacaaaaagaaatatcaatatttattccaaatcttctatatatatggaatacacaaagatgcaaatggcataatttctgatttccagtagtttataaatgtattactgacatacccataagaagaaaaggagaaatttgtaaattatgtcaaaaatggaagcatactaacactttcacttagcaattatctggttaaaatttaccttactaacatatttgcaaaataatgcatagaaattagcctactgtatgtataaaactgtaacattggaaatgatataaatgctaaacgataggtggttataaattgactctaaaattgaactgaatacagtcattagaaaaaataaaatacaaaatgtattattaagttaaaaaagacaaaaagcaagaaacaagagaatagtctcgtctgtgtaaaaatagcatatgtgtgtattcatgtgtgtacatattactaaatgtttattaaaattacacaaggaaacatacaaaactctgtaaatgggactgggagtaaaaagaggatagtgaaatatgttattttcttaagttttattttaaattcttatttatacttaatttactttaccagaagcaaatattgtttattgtaaagaagttttaaaaatgaaacaattctcaaatgaaacataggaaatagaaaagtagaaaatagaagtagaaagaaatgcaaataatcacttagaaaatttttcctccctttttattctctacttttaagaaataaatactgaaataaaatatttctgagtggtagaaagacataaatttacacattggaagagtttaccaagtcacatgcctaactgatgagaaaagaaacctccatacatactccgataaaagttgtgacctcaaagtctacaaagaaaattgttcaggcttccaggaaaaagggacaaacttgtaatgtcacagagcccagtcactccctaatgttgtctttccttcttcttaaaccccaaattattaatcgccacatggctgcccaggataaagacatttcccagccatccatttagccacattcttgctgtttcaagcagaaatgtccttacagggaagcagcacttcatgttttgcacagttttggtagcttccatttgaacagtgggccgatttgaaacaaaaatcaagcacagagaagtagtaaaatagaagaaatctgaaatcctgacaccatggagttatacctacctaacctaaactatttatagccctggacttctatatggggaaaaataaaatttttgtttacttgttattcagatttttctgtgactgatagccaaactcaattctaattgattttcctggagtggtatggaggtcagtttgtcttcagcattctcatctccaacacggaaagctcaaaaacagtggaataacatccacatttactgaaaaaggtgagggaaagggctatctcccaatatcccatatccattcaagagctcatttgtgtgaaataaaaatattcagtgatatgcaaacattcattaacctcagggttcaaatagccccccatgatgaaaatatttgaaataatactctaactcccaactaacgaattgtatctgaggtctgggattgtgagaagatatagaaaagcatattgtggtgggcagttaatagatattcatttaatgaataaggaggatttccttgggttagtatacaatttaaatactaaataaagttttttaaaaccaaaaggacatagaataagaagatttgtaataacctagcaaaacctagaagtttgggtgggaatgtaatgcaaagcagaggtaacattgtagggatggaaggaaaggaaaggagagaaaaaagttactctggaatcttaaaccttgggatagttgaaaggggaaaatgtgtccctgtgggtgaaacagatcttgtttatacattttaaaaagcataaatgtcaattaaagtatcacaaaaaaatcagtttcattaatggaaggaaaaatgagataaagagggccgggcacggtggctcacgcctgtaatcccggcactttgggaggccgaggcaggcggatcacgaggtcaggagatcgagaccatcctggctaacatggtgaaaccctgtctctactaaaaatacaaaaaattagccgggagtggtggcaggcgcctatagtcccagctatttgggaggctgagacaggagaatggcgtgaacccaggaggcagagcttgcagtgagcagagtttgcaccactgcactccaggcggggtgacagagcgagactctatctcaaaaaaaaaaaaaaaagagattacgggaagtgagtggaaaaaatagaaacttggtaaaatgatgagaaaaatagggcaaaggtaaaagaaaaatgtataatttaaaataaatatacatttaatttttattttatttttaattggcaaatatatatatgtgtgtatatatatttggggtacgatgtgatgttttaatataagtttacattgtggaatgattaaatcaagcccattgacaatttcatctcctcgaattttttttgtggtgaaacatttaaaacctactcttttattaattttgaaaccagttaacagtacattattattaactagagtcaccattctatgcaatagaccactatacagtaagatacaacacttatatcagtcatagactagatgtgaatagattgaatttatccactaaaagagcctactagactgaatttaaaagttaaaacaagcttgcgtacagttaacatctaataaaaataaatgattggaacaatagaaaattggaagccaagatgggaaaagaaggcatggataaagttgtaatggaattatgtaaactaaaatcaatcaaccaattaggagtgataatatttatatataataagattaaattaataataaatttgcagttaaaaactaacagggagagaaagacatcactttttgtaatattaaaagtcaaaagcataaatatattacttgtgattggtattcagtaaagtacagagccactaaagacaaaaagcaaacaaaattaaaaagggaagaatttgacaaacacgcaattgcagtagaaagttacaatacagctttctgagattcaggcagttcttgatagtgcaactttttaagttaagaggaaatacaggacaaactaaaaaaatacaataaacatataagactaataaatatacagaaagtcatctatccacaaggtaatttttttcttatgtccattaaatatttacaaaaattgatcatgtagttgatagcaaagtaaaccttcactaatcaaaaattagaggtaggacaggcatgctattgaaacttagttcaatacagctataaataaattatcaaaagatgactaatacatggaaacctttattcacattgttattgttcaaagagaaaattaaaaggaaaattgctaagtatccagaagccgatgaatagaaaaccatttcatactaaaatccatgaatacagttgtacgagtctgttttcacgctgcctgtaaagacatacctgagactgggaagaaaaagagttttaattggacttactgttccaaatggctggcaaggcctcagaatcatggcaggaggtaaaaggcacttcttacatggtggtggcaagagaaaatgagaaagaagcaaaagcggaaacacctgataaacccgtcagatcttgtgagacttattcactaccacaagaataacatgggaaagatcggatcccatgtttaaattaccttcccctgggtccctcctagaacatgtgggaattccggtagataaaattcaagttaaggtgggtgggaacacaaccaaaccatatcaacagtgaaaagaatacacacaggaaaatataaaccttaagtaccctctacatattaaggaatgaatgaatgaatgaataaaaaactcatctgaatttattttaacttaattcagtactcatcagcatttattttaatttaatgttggtttgggctgtatcgtaaactactgcttaagattgtttaggagagaggaacaggcaaaaagcagctgctacttgttttttacagaaggttctagaagctgcctcatgacactgcttatatgatatggttattcttccttagttacaagaaaggctaggaaatatactctttactctgaatagcaccttcttcctatcccccagctaaaatttgatagttacttaactctggaaaaacagaagagtggatgtttcggacaacccctggtttcacaatgtgaataaaatacatccagatttcagatatgctattgtattagtccgttctcatgctgctatgaagaaatacccaagactaggtaatttataaaggaaacaggtttaactgactcacagttctacatggctgaggaagcctcaagaaaattacaatcatgggggaaggggaagcaaaaacatcctttttcacatggcggcaggagagagaagtgccaagcaaagctggaaaagccccttaaaaaacaatcagatcttatgaggattcactatcatgagaacagcatgggggtaaccacccccatgattcaattatctctcactggatcccttctaccacacacggggattgtgggagctacaattcaagatgagatttgagtggggacacagacaaaccatatcagctatattattacatttgtgtttaaatcctcttacaatttaacattaaactcatttctgtaaaaataacattaacagaaaaagaatgatactagagtttaggaaatacttttcttggtaactctcttcctaatctgaagaaacaacatggagattctcttatttcaggcctattcaattcccaatagagtctgatatagatatagatatagatatagatatagatatagatatagatatttcctgaaacatcattgcttttacatagccttaaattaaatctgtattgactgagataatcttaggaaaatattaaaaacctgaagcatagatagacttggctgaatccaaaaagtatattgtgtagatgcaacaaactcaataaatactttgacctgagacttctaggttgccccatttaattaatgtctagtgaatgaggatttgtacactgaagctcctttctattgtttgccaaggagttcagccagatgtactcatgtcaatgtgagcattgtcccagcattatttgtactctgaaggaagatcctttagcattaaaagaatccttgagaaaaaaattacataaacatcacctgatctgctataattattgggatgatctgccaccagagccttgggaactaaacctaaaaaggttacagagtgccagcctgcaagaatattaagaactatcaatggtacgtaattattaataggcagagtttattagagttttcaaaataaaaattatccttttgtcctgcactgatatcagggaaaattacagaggaaataggttctctttgaattacttattagaataagtggaattctgaatggcacagaactctagagcatacaggttcaatttttaataaattgtatcagtctacaataattatagcaatatgtcacacttatttctgaatctgtttttataaaaaaagaaccacaattttctaacaaagcaacaaaattttaaccttaacatttctctgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgatcctcagggatctagaactagaaataccatttgacccagccatcccactactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatagacaccacggaatactatgcagccataaaaaaggatgagttcatgtcctttgtagggacatggatgaaattggaaatcatcattctcagtaaactatcgccaaggacaaaaaaccaaacaccgcatgttctcactcataggtgggaattgaacaatgagaacacgtggacacaggaaggggaacatcacactctggggactgttgtggggtggggggagtggggagggatagcattaggagatatacctaatgctaaatgacgagttaatgggtgcagcgcaccagcatggcacatgtatacatatgtaactaaccagcacattgtgcacatgtaccctaaaacttaaagtgtaataataataaataaaaaaaaaccatttctctactcaatgcataagaacccatttttctagtatatccagaatattagggaccatgattactattactattaccaccaccactactactactaagatgcaatttaaaatatttctgcaagatatatgcagataagaagctcatggcagtaatagaaaaagggagcctggccgggagcagtggctcacgcctgttaactccagcccttggggaggccgaggcagaaggatggattgaagccaggagtttgagaccagtctgggcaacatagggagacccctatctctacaaaaaataaaaataaaaaaatttcctagctgcagtgagttatgatggcaccactccagcctgggcaacagagtgagacactgtctcaccataaataaataaataaataaataaataaataaataaataaataaatgggaggagtctgaagaacaagggattcacaaagtaggtctactcactatgcggaaaacagaatgatgaagagggactcatcacggtagacaagtaagaaacaggtaaaatagcggggcgaggacataatatttctgaacactagatgggccttaaagcagatagcaataggttttccgatccttttttccctttgtcttttctttgaatttaacctttgaggaatttattcacctctgtgaataaacaatcggagaaaacagataaacttagtacttctcttaaacagcatcagacttcctatatgcatgtggagcactacgatagggcctgctggcactatttcacactagaggtgacaggagggtacatcttggtgcaaatgcttataaatataaaatgctggaaatgaatgcaatcatcatagagaagtttgattttgtcgcactgccaagacattactcttgggccccaaaaccaccattatcagaattcggtctctttaaaagtttacaaaatgttattgttccatcctctgattttaatgccacaacaagcttagaaggtaagaaaaattttcctccccattttacagctccagtccttccatgaccgtgagactatgtgctattatatactgggatcctttctgacttgaaagttctccctttttccttcatttagtatctagttaacaccctccggtcctccagatatcatttttttagaaagctttccctctctcataaagctctattatgtcctgccccctttgtttccatggcagtctgaaattccctctgtgagagttcttatcacatgctttagaaatcagctgtgtatatgttgtaggagataataggtgttctgtctgattcccttagagccctttacccttcctatatgttacctcactaggactttttgtttctcatgaaataaggtactagggattcagagttacttgcactcagagggaaagcctgggaaatcttgggagtttattccctacccctgtgactcttagccgatgaatgattattgtgggatatgaaagccctgctcccgtgcctctagatgggatagattctgcagcataatttacaccccaatttatttgcagtgtcaggctgacgctaacctcgtgaaaccacatcctggctcagcttcctccctttcctctcctgctttcttgctccattatcagtttcttctaagggcatttccttaataaatcacttgcacatgaatcctcatctcaagctccatttctaaagaatcagtcttaaaatataataattttgccttaaccaatggtaagttcattaaggcaaggactattcgtaaacttggtatctccagcccaaataactgagcctgagacacagtaatgattaaaaaaaaaaatcattgttgcttgaattgtttcctggcaatataattctgctgagaatacaattatgaattagacaaaatctcactccacaatgcacccaaagtagaatgagtttagtctattttggtggtttttacttatctccttgacttctgaacagttgactgccttaaagcctcatcattttctttgtacattcacttcctcagtcacttcatggagtactttaaataccatttatgtaatgatggctcctaaattagtatttgtagttcaggcctttcccttgaatcccagacttttagccaccaagtgcctgctctccatcgccaacataacacatccaaaatgaactcttgatctcccctccaaaccaactctcccagtctttcccatctcgattactggtaactccatccttccagttatttaaaccaaaactttacagtccaccttgatgaaaagagaatgttaataaaaacacaacatactagtatttatcttagttataaaaaaaaatactggatctgtgatagactttaaaacatgtttcataacttgaaaagtagtaaaatagtcatttactaaatttcctgtttgtcagggatccccaagaccccatcaaggttcaatgattcacagaggactttgtggaactcattatacagtctctgactgattgtttcacttacgatttgtttgacttaatgatttttctacttgatttttgactttatgatggtgtgaaaacaatacacattcagtagaaactatacttcaaattttgatcttttcaataaattacagtagatactcaacactttattataaaataggctttgtgttagatgattttgcccagttgtataataatgtaactgttctgagcatctttagctagcacattaaggtaggctaagctaagctacgatgttcagtaggttaggtaaattaatgcatttttttctgcttacaatgggtttattggaatgtaacctcattgtaagtcaagaagcatatgtatagtaatattcatgactatgacatattataatgaaagaaggcaaagcacaatcagtaaaaggaaaaggtgcattgggcaaagtttggtgaaaaaaggatacaagctcctgagtcctctccctatggagtcacacaggatatgtttaatgttgaattatgacaactcttgtgaaatgctgtctagcagggaagttcattagaaactcagtgcccaagatttttgctgggggctggccacttaggcaccctctgcccaatatatcaaaattccagtctcccaaaattaaagcaaatttccagcataaactatattgtttgcaaaaaaagagaaagaaatagacatagtgagccactcttatcagctggagaatggtgggacatttcttgaagtccagattcagagatgccagccaaaggctaacctggcaaacaggtatggtattttcaagcttgctaaattaactattttctttttttacacatatatagtataccgcataagcagaagtgtcatgtgggaattctgaaaaagctccttaaaaggagcttatctttctagcttttcttccttattctctgaaattcaagtgtgatagctgggaatccaggatccaatttaaattgtgggcctacctcaagagagaagtcatgtgctaagaatgggtccctgatgacaccatgaagccactataccatctcaataatctctatcactagactgtttttctgtgagacagaattgatgcttatctttagttattatttctaaattcagaattagcaggcaaacaatttttaataaaaaattacttaataaaaatacacaaatacatttttaaaatgtgaaggccctataaataaaagatctgttaatcaaatgcaaaataataaaagtaatgcccttgaagaaacaactaaaagtaactaaagaaataaagaaaactgcattcattagaaatgctatattttaaaaatctaaaaaaaaatattgagtagcagctcatgagagaaaaaataaactattcattaaaaaaaaaattaaactgggcctttaatggcctaaaacaggaaatcacagctgaatcatcagtatgtcatttttatgtaggtaaagatgctataatgacataccatatattccaagcccttttttgtaatgagagttaataaatacaggaggatattccagttggctgtaatgtttttcccatagcttcaaaaggtttccctgatgtaaatttggcacttttacacttaataatcaatattgatttatcacaaattttacaaatggaagattttttttaagtgttgctgtggaagagcatttccatctttccttaaaagtttcttatgggaatttctttcaccattattctcaatcttgttgaaaatgaagcagaaattcctttaatgattttttataatagaatataatctaaattaacagtattgcaaacactgcagagtattagaaatgtaataaaaataaattgctctgttccagtgtgctctactacagtcatatttacatctattcataaggtaaccaaatgaactcctgctatttaagggattaaacaccaacaaaattatacaacagcacaattatagaaaaatgggatgcttccaaggcatataggtttgacagagatgtttgtaattacagtattcaagtattctagcaggtaaatttagccaaactataccaaatacataatacagtgcaattctaacagtgttttctaataattcatctaaaatcccccccaaaacaagttaaattaaaatggcttaaggaatattatagagtgaaacatctgcccctctgcatttttccaggcatctgaaactggaaagagaaaattaacatctccaattcctatcggtacattttcaatcttatggacaaatttttacctcatattttgccactataatatttgaacgacttttagaaaaataggaacaagaacaacaacacattatatgggtaccttgcaacacttggagatgtaaatgacctttacatctgtcagtttacaatttaaactccattcaacatccaggtgattgaaagctatcaataagatatgcgaaactaaactgaggcataagaaacaatatacattaaagaggaccattttaaatgttcatgtaagtagcccaatttaggaccaatgaatcagagagcattaacagtacactattcctacacacatttgaaatatttcaacccactagattaatgtagggttaaatattgcaaggatttatatttaccttctttggattttgaataaagcttaaaaagataagaaatgtaaactaattttgtgctcgattttctactggggatttttcaataatcgtcttcatgtaaaccccagcagtaaatatattgtagtcttcaatttgcagatgactaaattgagattcaaaaatattaactaactttcctactactgcacaattagtaaatagtgcttccagggttccaacaagcatctgtattgactgtttttctactgaaagtcacacatatttattaaagacttattcggccaaattatttattaatgcatctcatttaaccctcctaagagtcacattaactaagtactagatcctaaatttacagatgaggaatctgatgcatcagaaaggaaaatgattttctcagatcccaaagtagtacatgaacaagctaggatggaagtcctacaccatctgagtccagagcctgtgctcaatctcactttgatgttaagagacattgactccagtagctttaatttaggtagatcaggaaacctttctccaagaacaagtgaaaatggaaggctgctgtaactcttggtaaagtgagcacacattattaaattttactcagccattgtaaagtttcctatacatattatatttctaccagattttttttcctaattgaaatagcaatgaagaataaaacacaaagttatcctataataacactacctgggtttcttggaactgaatgttcctggtacggaaaaaataagaaaaagaaaaaaaaattgaaccttcgtgttggaaaaaaaaaaaagggagaagatggagaattcaaaagttaaaataaaaaaggtctgagaatcttctgaaaacagagtgttcttctccacaaacagcagggaaatgataggatataattgttaacatactggcagcttccagacatatgtcttgagtagcaaattagatattttgacttttgtacaaagatggtaagatcaaatgggttatgggggtagatggataggaaagttctccatatgattgccccatatgaccacaggatacagtttcctggacactcatcatctcattccacttttgactagaaagtcttctttcaattcaggggccagaaagctaaaatctatgtttaccagactcccttgctctaagcttgcagacagagtttgggttatatcatgaagaattcagaaccagattaagtgggaagagatgtgctttgtaaagcatcagtttttgttggtgcaaatcacagtatacatagtcaagaaacagatccaacagttttagggcaggcttcttaatcctttgattataactaaggtacatttttcttggaccttggtagggagagttactttggattctaacagaagaagcagttctcttggtgggcaagtgctgtgatattattctgtatgttattcttgcaggcatagccttaggacatttctctgcagactttatgttttgtaaggaattaattacctagagtaatccacttgtgtttaaacaagctaaatgaattctattgtctgcaattgaaccctgactgataaaccttttctcccttcactctccaccaacctcaatgaggttcaccttgaaagccaggccaaagaaagtgaagtgtaaagtcagtactactatgccacctctacagcccccactctccaaaagtatgctccctccagggaattacctgtggtacctataaaagaaaaccgcagctttattccaaaatgataaatcaacaccatagactctaactgcccagtgaaatttatttgttgacagatactcttagctgcctaagtattatctgtaaacccatgagtttaaatgatggttttcaattctataattttaatgacagaaagaggaatgatggaaaataggagggcattggtaactaaagagagaagtggcaccatcaacagagtgtgaacaatcagaagttacgttctgctaaatgaaaacattacttggtactattttaaacatgcagaagctactctgcgtaattcataaagactttaatgtgccttcaactgaaagtaactgctattataaaagagtttcacactcagtatttaaattatcagtgtacttacactttaataaataactttataaagtttaaaactaaaagtttactgcttgatagtaaactatgtcaccagttcatctatccatgtaaagataaaaccaatatctgcaaaaacccatgaatacttagtttcatcctgacataaatgaagatatatttcacaatatttacaatcattagaccttataactgagagaactgcatataaaacactaaactatatgttaggtaaaatataaataaaattcttattacaaaaccgatatattaaaatctatgtcaaaattacaatgcgtatgataaagatttggtcgtctctccttacgcgcttagttttcaagctagcaattatgtgaacatatattcaacttgcatcagtgtactgtccttgatttcttaaaaatccaaatttgtactttagccttggttgtcattttcttaaggatatctcattgctttgaatactcttcatgtgatatgtagtatgagtaaggtgggtcattaaagcaagatggcagagggagaataaaaatgaggaattactggtcctaaaattcaaagaaaaagatgttactatagaaaattttacgcaaagggcgggaaaacaacattttgttacagtttataaaagaaaccatgctatgtggttaactaaaaggcaaagtattgacctgatagtatattagactgtttcaattcaaacctacatttagacatttctgagaacatttcactcccaccacaaggactggggagagagaactcaaacctttaaaagttatgaattagaacccctactaatggatctctctattagcctcacaacttgcactcaggtcctctaagaaaataggtgacacaattgaaactattcagcctgtttgttgcctcctgaactattgagggtaacccttaaaatgttttcgtctacctggctagttcaaattaaaaacagcaaaatatcttttttaaatatttatttttcttgtcactgaacttactttttacattcagataataagaccgacaatcacatagcaataaaaataaaattaccagacacagtaacttaatattgtcttaataatatatgtgtgtgcatatatgctataaatacttatatcattaaattataaatattaaatgtaaatattcatattatatattatataaatgcatatatgtagatatatgtgaaaccataatcataagtcatctagcataataacaaaccctctagtatacaaaataccataaggtaaattatagacaccgtttatcaattatcaattaaggtttggacatatctgaaattttggtttatcatagcaattttcacatactgtattccttaagtaaaggaaatgataaaaacctaggatctcagtattccgaatgcacatctaccactgcagcttctatacttgattcccaagaagtcctgggatattaaatatgttcaaatatcaatttctctggcaagagtacatgttaaagatacaacaccaagaggaaataaatacatattaaacttatcaggccacaggaaatgacatacattccaagacgctactgtggcacttcatgataaggatttttgcctcacctaatacatttatacattcattattttaggtaacagtctcacagcaactctcattacaaaatgaatacaatacacataagacttccaacaaatagcagatgctagagttcatagaaaggcattgtattataaaaatgtatttttatccttccctaatattctctgatggaagtatttacttaattttgtcacttcagtcaattacggtatatttacaaagctggcttgtcttttattaagaaattagtgttcatatgtgtaacaatttgaacacgtaattatgatatctaattatataattagagtatgttgaaatgatcaaaatcttcattatcttattgattttaaaagagtgtgagatatttcttaagcatctcaagcatcacttacaatattgtcttccaaattgcttactttccaaagttaataagacttgaaagacaaagagaagctaatgacagaagtcacgtatcctactgggtcataaaacaatttttgcatatcacaacctatgacatatcaaaatgcctattagtaatagctcatgattctttggttcaatcattcaatttattaatttataatacatttattacttaaaagttttgactgggaagaaattttcttagtcctggaattatgatacaaaaaagtttcagtgtcttttgaaggaggaggttttattgtttttgcttttttagaaactcatcctcgaaagaataatgtgaacaactaatggcaattcagacagtgtaggcagaggggatcttaaaaacctttctgttcctcacaatctttgctaaatgcgtagattaataacagttatcttagtctgaatcctttaaaaagaccagagcctgaagcaaggattagagtactgacattttctttgagaggtgcaagctcaggaaatgaagatgagagaagaaaaggggatggacaatcttgtggcaaggaaaaatgtgaggaaatgcaaaggatgtgttgttcgtgatatgcctttcttctgcataccagattatctggaaggtttgcaaagggaaaacatacttccattgccattccctgatgggagaaataataataaattatctgtcttatcccttcctgttcctgtttcccatatatctagactcatgccgagaggaactaactttcccacatggctgagcttcattagctgaccccagtggctgctcaggaagccatatctgaaggctaaaattggccttgggaattaaacactttaccaatgccaatgcgtgggtccaagggtcaagaagcagagagtcaaaggtatggttagagaaaatgtgttacaagcaaaaaacactgtggggcctgtaatcccagcactttggaagaccgaggtgggcggatcacgaggtcaggagatcgagaccattttggctaacaaggtgaaaccccgtctctactaaaaatacaaaaattagccgggcatagtggcgggcgcctgtagtcccagctgctcaggaggctgaggcaagagaatggcgtcaacccaggaggcggagcttgcagtgagccgagattgggccactgtacaccagcctgggtgacagagcgagactccgcctcaaaaaaaaaaaaaaaaaaaaaaacaacactgtggggaggcaagagtgttattacaagatacttttccaagaccaaagctgaaggatacacttaagcctagtaggaaatgtgtaggagcagttggtgtttgaggaaagtcatgagaggtaacataaagagactgagattcacatgctatttctgtgataaagaaatgttaagtaggcaggatgctttcttcgaatgaccttttaaaacaaaacaaaaacaaaaacaaaaaacctgattttgctagtgatgtcttctcaaatgcttccctagtttctgggcaaagatagatgaagcaatgatagcatcccataagtgattgctaaataaataaagaaccatttcagtgccttctgagagcagataaaaggatgctgtgtctttatacattagcaaagtattaaaatacccaataatcaactagtttgaaaatgtccaaaataagttaacataaaatatcagcttttagattttggaaaagtttattttcaagaagctttttcctgaactgggccataaactataaagaaaagtctccatgaaaatgcactctaactttgcttgcaaaataagccaagctgttagaaaccttgtaaggcaccaatttaatatctccctctgacccagttcttagaaatgttatcaagttacctattaatataacttactagtgcaaataccctgaatgtggagtacttataatattcaggttcctataaaaatagctattgcctccccaaaagtagagcaagtcttccctatcccacaacctaaatctaatttgacagacattattaattcagattaataatgccagagaatctagtgcattaaaaaagaaagccttgctaaggaaaaaaatcatttattgggcaggaaccaagaaggtaaggtcctaaaatctaaaacaccttagttccctgacttaaaaaaaaaattaaaatcacattaagcaaattggagaactctaacttctaacataatcaaatgatttgcaacacttatgagccgcattttacgcccgggtctcccaggccttgcccttaatgcaaacttacctttatacctctgaattcacctgagacaatgcagtagaaatgattctaaataatgagtaggacttttaaacatagttttacaggtaaaaatgatggcatatttcttctcagtcactgaaatggggcaaaatggaaacaacaatcaagatattctttctggaatggtcacagattgtcacttagctgcacaaaaatattagaaataaaataattgttatacgaatatatctgttcgtagtggatgtcgaagtgtactgtcaaaaagtagcaaattaaaactccatatccatgtatatggcatgcaccattcacccagttcctcatatcgaaattcttgaatcacctccatatgcagtccctcaacaaaattctccactcaaaatacatttgatctactttcttctactactctaaatattcatctgcttgcccaagtcaccatcatctctccctagacacaaggtccaccttccattcttgacccctctaatctatgtcccaaattgcagccagagtgatcctgttaaaacacaagtcacattctaactgcttaaatcctcttttggcttcccattgcccagaaaatggaactcactcctgttcaccaggccctatatccttcctcatatcttgtcactcacccccagtcactgaactcaaggcaaacctaccttcctgaaagacaccaagagtcctcctgcttcagagcctgtactctttgctgtctctcttcttttaacttcatgcaagcctctgcctaaatgtcatttcattggagtaggcttccctgaacactctattaaaaatagcagtttctattattcccaatcaccacatctactccaattttcttcagcacacttaccaatatcagaaatcagaacatatatgaatttgtgtattacctgtttttccctaaaaaatataactttcatgtgggctgagattgtgtagatcttgttgattgctttatcccagcacagtgcctcacacttagtaggtggttaatactcacctcccttctatgacatgctgctgtctttctttagaatattctgggtaagcattgacaagcagaaattatctcggtaatgcccccatgtaattctaagggaaatctgtactctaagaaattcaaggtcttacgtgcttacaaaacaaaacaaaacaaaacccagattacctatttaggaataataaaaacatcaacattattaattaaaatgtttgtgttataaattaccctatggaccgctcaaaaaaaatgtggaaatgccatgttcccagacgggcatttactcagagaataagatttatgaaaagactttaaagcttagcagtgttaggaagaatagaaagtaaaagttcaggaacaaaaaggagatatattcattaatttctccacatataatgatgtaaaaacaaaataaaacaacccaaaatacactgtttttagtaaaactatgactaatgcagaggaccccaaataatacaaaatgatttataataatattttttaaattaatagaaagtaaggatgagctaagaggtagaaagtttaaaatgggaagaaatatctcaattttttgttgtaagtaaattgtgatcggctctgcaagaatctctttattctttaccaaaaactccattactggtgtttatgtagctgggtttagttgttctcagataactatcaaacgtaaattatcttccacaaatttgagtgctactatcgccatcataaagttgtattgagggcctaatatgaacctcatgctagcttgggggaaacaaaacatattatgtgaccctgacgaccgtaacctttacgaaagtcaaaatttattaaaaaaaaaaaagggctctgataagtgctaaattaaattacggacaaattctgtcacattgctttagtttcctggactagtatcactgagttgaaacatatcattattttaatcataaatatttcactataggcttctactttaacatgtctaatataaattactgtacattgtgtaaaataatttataaactttctaagggatgagaaaatcagccttctcaaaaagatgtgtttgcattgcaaaaggcaagtaatatgctttgatcaatttgatgtgaaacataaaaagcttctttcatagaaaacagataccaggcatacaattttaattgaagagaatttttgttacttcttaatatttcaagggaacacataccaaaaggagctgtaagtcagttattttattattacctttggctattttactattacatttcaataagataatgaattttcctttggggaaaaaaaagttttcaatgcttaacaaatgagatcattctaaattaaattatctgcctgaaaagacactattttaataaatatttgattgaataaaagttattttcctccacatacacaaatgttattgcatccttgctttttgaaacaacgggctttatatcaaaattttatatctttttttaggcatacatttttttcccagagtttagtagcaatctttttctctatatatttcagtccttgaaacatattgtgcacattcagtgttataaccttgtcactcaaagagctgatacaacacaaagtgatttcaccaaaaataatggaaggatagacattatttttggttagaaacagtttttgctgtttttttttgagacagtcttgctctgttgcccaggctggagtgcagtggcacgatctcggctccctgcaacttctgcctccctggttcaagcgattctcctgcctcagcctcctcagtagctgggattacaggcgtgcaccaccaatcccagctaatttttgtatttttagtagagatgggggtttcaccatgttggtcaggctggtcttgaactcctgacctcctgatccacccaccttggcctcccaaagtgctgggatcacaggtgtgagccaccacgcccagctagaaacattttttaagaagaagaatattgtgcttgtcatgttcagtttcttgaaccgggttataggagtgtgttaagttatgaacattcaataaaacagcaatcataataataaagagtaactagtttattaaaaagttcaagaagcactgtattttgtcagtgtctggaaaaataacaccaaatgtgcctttctttgtggatactccatttaggaaaaggtacaaattggaaatgaaaaggaacgtggtatgggagtggagagaaaaagaagtatttgaaaagaagtctcagaaatcatggatagaaaataattaatgattattactatgtaagtagtgcatgtcttagaatattgcacacacaactgaggggttttagcaaaaaatacattacccagaaaggaaaatgtaaagcagaagcagtgtgctaaattgctgttgccctctcctgatctcccaattagtgagcacttagccaactctcttgaaagcaaatacctctaaggagggtgtcacttaattattcatattttattaccaattactttaatcagatggtttcttcataacatttggctgaatcagctaaatttggaaatgttatgcataccatccaagagtataaagaggcacatgtgtgattttagaaaatgggttatttgaaggaaacttgctccagatatgtttgttgaaatcattgagggttttcatgttctgcttgaaaacttaacctttaggagtggatgaccaatccaggagatgggctttcagagtcacttgatgttgcaaagttgatcatttaaaaggttactttaatacttccttaaaacaagtgtaactaattcaactctcaggaagcttaagatggcctgggggaagggaaataccttaagtaatcctaacgaaagctaagtctgtgctttatggttggaggcacatgcaggcaaaatggtgaaaccattgctctccttcaggctccatgcacttttagataaacatccaaacatcctcatattgcctcaggctattttcatagggccaactccctgggacttagaaaaatcctatcttttccattaaaatgtcaattccttcacaggatagaagaaatttaaaaattattgtgtttgttttttgtgtgtgtttctttccattgtaaaaatttgttaattttagaaaggttttagttgtttgctttagcaaaggtgttttctttaattaaaggtcactccttgaaccaaaagtttaagtcgccagtgaattatttgtggcccaaattatttatatgaataattatgtgaaaagagtagaaatgttgtcccaaacactttcatctcccaactcttttcctctgactgtcctgcattccataatgtttcattgtatcataaaaccctagcacatattttatgatttttccactgaggtaaaaaaaaatgtttaacattcaattggcaaagtgatgtttacctaccaagaatatttttgcataggggaacaaaacaaaatagctaaattgaaatcccttctttactatgaaatcattttgtgatcctgaagaaggtactcttttttctagaacttcatttccacatcagtaaaatagagacaattatatccaacatagaaggccattgtgaagaaaaaatgagatggtgcatagaaaatgacaataggtgttgtttttattttccttagtatcttttctgcttccctggcacttaataaaacctactaagtgtcttatcctaataacctatgaagattgctactatttcatttagaataattgttcatacagattataacaccttccccacacacacacgcttgcagttctgcttttcaataattacgtagttattcaatggtttgataaaatattgccttgcatagaggatattaaactcatgaaactgagaggtgacagcgtgctggcagtcctcagagccctcgcttgctctcagcacctcccctgcctgggctcccactttgtggcatttgaggagcccttcagccccccactgtactgtgggagcccctttctgggctggccaaggccggagcccactccctcagctttcagggaggtgtggagggagaggcacgagcgggaaccggggctgcgtgtggcgcttgcggggcagctggagttccgggtgggcgtgggcttggtgggccccgcacttggagcagccagccagtcctgctggccccgggcaatgggggacttagcacccgggccagtggctgcggagggtgtactgagtcccccagcagtgctggcccaccagcgctgcgctcgatttctcgctgggccttggctgccttcccgcagggcagtgctcgggacctgcagcccgccatgcctgagcctcccacccactccatgggcccctgtgcggcccgagcctccccgacgagcaccaccccctgctccagggcaccgagtcccatcgaccacccaagggctgaggaatgctagcgcagggcacaggactggcaggcagttccacctgcagccccggtgtgggatccactaggtgaagccagctgggctcctgagtctggtggggacgtggagagtctttatatttagttcagggattgtaaatgcaccaatcagcaccctgtgtttagctcaaggtttgtgagtgcaccagtcgacactctgtatctagctgctctggtgaggacgtgcagaacctttacatctagctcaaggattataaatacaccaatcagcactctgtatctagctcaaggtttgtaaacacaccaatcagcaccctgtgtttagctcagggtttgtaaatgcaccaatcgacactctgtatctagctgctctggtggggccttggagaacctgtgtgtctaaactctatctaactaatctggtggggatgtggagaacctttgtatctagctcagggattgtaaacacaccaatcagcaccctgacaaaacagcacacttggctctaccaatcagcaggatgtgggtggggccagataagagaataaaagcaggctgcccaagccagcattggcaacctgctggggtccccttccacactgtggaagctttgttctttcactctttgcaataaatcttgctactgctcactctttgggtccacgctgcttttatgagctgtaacactcacagcgaagatctgcagcttcactcctgagcccagcgagaccacgagcccaccaggaggaacgagcaactccagacgcgctaccttaagagctgtaacactcaccacgaaggtctgcagcttcactcctgagccagcgagaccacgaacccaccagaaggaagaaactccgaacagatctgaacatcagaagggagagactccagacgcgccaccttaagagctgtaacgctcaccgcgagggtccgaggcttcattcttgaagtcagtgagaccaagaacccaccaattccggacacaaaaccaaacgctccaacaattttaagtggcgactggcaaccaatggtgataggacatacgtgtgattgtttcatttctgcctatagctacaccattattctctctgggtcttagtttatggctttgtaaaaaattagatgaccactgcaattatttctagcttaataattctaaaatttatgatctataaataatctattcctacccctgatgattttcccttttttggcatttagcaggcttgataattgcttctttatttagctctctcttgtgagagattctgcttttaaggggacaaacttacctgttttgttaattattttatctccaacagttagcacagtgcctgacatgtagtagtctcttaaaaactacctgcagaactgtaatgtattggcttaacaaatgaataatacccaatgtattattatagagaagataatagaagtcaattaattttaaagtatttaaataaaattctatttgccctaaagcaatgtattttctgtataagttatgtaccctctggaattaagtgaataagtccctatgtatccaatattacactcttgccatttttatttatatatctgtcttttctactagaacttcttagctattggaaggcctatctctggcctttggtatctaacatatttttttggccacgtatactagaatactctacaattttccattgaaagaatctcaattatatacttataaatataattgtcttaattcttcaaaattaattttgcttatatccttttcatttgactcttggatctatgtcaatactgatttctaaaggtttcataaaatagagtcagcctttatggcaaacatattgttgtctaggttatagtacacagaccagctggtatttttcaatgacatgacatcttgattaaaggtgtagaagatgctatcctgtgaaaaggctttgaaaatgtgggttctgtgtctgtatatttttatatacatataccgaaacagtattttgttcccatgttctcttagaacaagatcatttgtatgtgaattttcttctacctcttccatccctaagacagcaagaccaagtgctcctctcttcctcctcagcctactcaatgagaaaacaaagataaagaccattgtgatggtacacttccacttaataaatagtaaggatattttctcttccacatgactctcttttcatttctttttttatttgtttgtttttgagacaaagtctcactctgtcacccaggctggagtgcagtggcaaaacatggctcactgcagccttgacctcccaggcttaggcaatcctcccaactcaagtctcctgagtagctgggactacaggcacatgccatcatgcctcactaatttttaaattttcttctgtagagatgaggtgtccctgtgacgagcccaggctggtctcgaactcctgaggtcaagagatcctcccctcttggccttatgattttcttcataacagtttcttttctttatcttactttattggatataatacatacaacatacaaaatatgtgttaactgacaatttatgttactggtaagacttctggtcaacagtaagctattagtagttaagctttggtgaagtcaaaaattatacatgggttttcgactgtgtagggttcagtgcccctacccactgggttcttcaagggccaactgcacaattaattcatgatatggagttagaagggtagaataaaggacttcaaagtgccttcctaagtctaaacaactatgaaataagagaaaaatttttctgtcctgaccacagaaaattgttcaagacatactttaagtgaaaaaagtaagttgtaaaactgtaggtacatagtggtagtattttttgtaaacatacaagattttaaatttattcttatttctaatatttaaagaaaaacatacaaaatgttaaagtcgttcattacctagttggaaattcactcaaataggaacatcctatttgtaattgcaaccatttgcttaagaaaataatggtaatcacttatagagtgctccattcaagcatttttaggaacattaactcatttaatactcacaacaactctacaaagtgatggtcattatcacctctttttgcagacgaagaaattgaggtaagaaaagcaactttcttgctcaaagtcacatagagctaatgattagtggagctgagcttcacagatagattctttggctcagaggccagttttctccaagctcacttcctacactatgctgccctatgctcttccctcggcagcccactccaaacattaacctgatgtttatgctaatcaacaatttgattttatatttacttactatccatgtattttacaaataatgctttgagcaccaattatgtgcaaaacacagctttatctccagtaactggtaagtccagcttttcagtttgttcccagtaatagctagccaaaaatttatcagtccttcccccgatcctgatctagtcatttcacacccatttctaacatcaccaatattggtaaaaaataagaggcatttgaaggctgctgggagagatataaaggcacctacttcaataccctccagaaggctgcaatttcccaaactcctttcaggcaactcaaaatgctcgtgtattagaataggtactgtatgcatacctacagtgaattgttagaagagactactgacaggtataggaggttgagctagatgactcctcaggttcatccagataagtgtggaaagagccagttacttactaactgccttggaaagaacagcactttccccaggaatgaagactagtaataaggtcaacaaactgcaaaaaccaaatgactcctccctttattttttaaataaaagaagtatttaaagctgtattaaggtttccaaaggaaataagaagaaaggttaacaggaaagaacaaaaacccattaattctgaagcaggtaatgaaacacacacacacacacacacacacacacacactcagacgtatcaacaaaaagccagatgatccctaggagcataataggtagcagagggtgaggctgcagtccttggtttggagaataggaagattccccataatctatccgatgcctatggccaaagcaagaagttactgctatattgtgcgatcctcagttatcaaatgggcattgtacatatttttctgtgttggtgtgtttttctgtgaataaaaattactttctaccatgtaatgttaaggctatacttcaggctgtatcttaaccagtgtcttttggtctcaggaccattttggccacaaggaaaatttaaaccttgcaggacaagaggtgctgcgtctgctgaacctgcatctttgggataagggtagtatttaaacgaaggagtcaactgtggaactcctccgggtgtggagacagaaataaaataaataggtgtgtatatcccatagtgctgatatagtttcatattttttttttttttttgagacagggtctcactgtgtcacccaggctggagtgcagtggtgtgatctcagctcactgtaacctctgcctcgcaggttcaagcaattctcctgcctccgcctccttggtagctggaagtacaggcacctgccaccatgcccgctaattttgtaattttagtagagttggagtttcaccatgttggtcaggctggtctcgaactcctgacctcaaatgatctgcccacctgggcctcccaaagtgctgggattacaggcgtgagccaccgtgtccagactagtttcagatgtttaacatcagtacatatttattattattattattattattattatactttaagttctgggatacatgtgcagaatgtgcaggtttgttacataggtatacacgtgccatggtggtttgctgtacccatcaactcgtcatctacattaggtatttctcctaatactaaccctctcctagcaccccccactccctgataggccccgacgtgtgatgttcccctccctgtgtctatgtgttctcattgtccaactctcactcatgagtgagaacatgtagtgtttggttttctattcctgggttagtttgctgagaatgatggtttccagcttcattcatgtccctgcaaagtacatgaatacatccttttttttatggatgcatagtattccatggtatatatgtgccacattttctttatccagtctatcattgatgggcatttggattggttccaagtctctgctattgtgaatagtgctgcaataaacatatgtgtgcatgtgtctttatagtagaatgatttataatcctttgggtatatacccagtaaagggattgctgggtcaaatggtattgttaaataagtgaaaaaataaataaaaaaaataaatataacatatattatacaaggagtaggagagtaaaaaggatgaatttattttacaaaaaaatgagaaacatcagacggaataataggaatagaaaattataacataaaaagcatgcctctttccacatcttatataagcctcacagaagagagaatatcatgttagaaagtttaggaaaatagattaatgaaagaagacaattttttctgtgaatttgcagaaaatcattgctagatagtagccacaaggtaataatttagacagggcaaagctaaatataaaattatattttttaaaagttatgtgacaaatctttaatatctaattgaacttatacggttttatagtaataaaataagtcaaaattggcagatggctggcatcatgcaaactatattgtctgggttttgtttatttttgttcagcttggtttgctttattttttaatataatttctgagcatcagataattgtaaatcttattagtggctagaaaacaaaaacagtttgcttaaaagcaacggagtattaggtttatcaaagtaattttaaaatttttgttgtatttctctaatagcaagattgatttgaaaaaaaattcaattaatgctgctataagaactcagaaaaaaattagtatatttggtgatattaccattgcctaaaaaccaaaagtaaatttatgtttcccttccttccttccttccctcccttcctccctccctccctccctttcttccttccttctctctctttctttctttctttcattctttcttttttgttgttgttgttgttgttttttgtttttcatggagtctcgctctgtcaccaggctggagggcagtggtgcgatctcggctcactgcaacctccgcctctgaagttcaagtgattctcctgcctcagccccccgagtagatgggactacaggcacgcaccaccatgcccagctaatttttgtattttttagtagagacgggatttcaccatgttagccaagatggtctcgatctcttgacctcgtgatctgcccgcctcagcctcccaaactgctgagattacaggcatgagtcaccacgcccggcctctttctttctttctttccctctttcacaaaatcttgctctgtcacccgggctgaaatgcagtggcacaatcacaactcactgcagcctccaccactggcactcaagcaatcctcccacctcggcctcctgaatagctgagactacaggcatgtgccaccacacccagctaaattatatatgtatattttaaagagatgtggttttgccatgttgcctaggctggtcttgaactcttgggcttcagcaatccacccacttcaacctcgcagagtgctgggattacaggcatgaaccaccatgcccagactcatgtttgaccacaattcttatggcctctttaccttcttcagagtttattgttaagacaagacagagagtaactttaggctacatttttttttagagaaacagttttagatttttctgtaaacagtacaggaataagctgaagtcctacggagtaagacacttatttcacttatttactgaaaaaaagttcacaagattcttctttgtatttcttttgtgttgcagatcctgtcaataaagtgttgataactagagaaggtaataggagacaatacatctgtaacctgtcactaacatggcaaggaaacagaccctcacactattgaaaagctaaaagagaacacccacagactattatgattgtatccagaagtcctgaagaaattgtttaaaaagcatcagaatgacatgggtagagacacaagattatgaaggaaattctggagtgtgggaaaggtcttaattcattgtatctgtagtgtagcttgacattagattagacactgagtcaatgtattcctacccttggactatagcaaaagacaaaaacaccagcatggagccatctatcagaatactttactgctaaaggcagaacagttctctggaactttcagggagcagaatactcaaaacttggaacagaccacatgatacaatccaagctggcttcagggagcaagactgccgttggtgaattctggattatgctgtatttttaaagttttattatttatttgtttgtttacttacttatttataatttaatgagttaatacactctttactatggactgaatgtgtatgtacccacaaaggtcatatgtataaacgtaattcccaatgtgatcgtattagaaggtgaggcctttgagaggttaattaggtcatgaggatggagccctcatgaatgggaatagagttcatagaagggactgaatcgactagagttctcttcttccaccatgtgagaggacagtgggccctcaccagacaccagatcttccagcactttgatcttggacttcccagcctccggcactgtgagaaatgaatttctgttgtttataaaccacccagttctaagttttttgttgtagcagcctgaagagacaaagaaagttttccacacagatatgtgtcttttgttaaaaaagaagaagagaagaagaatttaagatattgtggcaattttaaggcataggcacaaattccttggccctttgtccattgaaagatggggtttatgtcttcatcatctgaatctgggaggagctgcatctccatggataccactaccatccaggccactattattatctcacctgaaatatatcagtcacttcttactgggttgatctgctttcattctttcttcccctgtggtctatttttcttaccagataaaaaataatgtttaaatataagtcaaagtacactaattatatccttgcttaaaagtctctaatagcttcccactactcttgtctattatggagctttaaaatgcctacagaaactttgactttcatatatgtttggttttctgtcctagaattcttcattgcagtccttgcttcagggccttttcacctactcttccatctacctggaaaatttcccttttatctcctgcctcatacatctcaccaaaatcttcacatggatcaggtctttctcatcattcagatctcagcaagataactctgtctgtattccttgtgttctccactaaaatgtaagcctcataagaggttagacttgatccatctcatgccctgttgtaccttcaaaagttagaacagtcctattacagtgtaagcactttattatatttagtacataatttttttaaaaaaacacttgacgttgtctactatataactcattacccccgaagtatacgtactacatcctgaacattgatatatgggagatgaataaaccatcgtacaattcttagattgttgttactgtcattaaaagtacagctaccacaaataaatatcacttgtttgctgtttcacaaaaagcacaccaagatgttcaaatttcccataaatcattcacactcacacttggatagataccaaattgtttggaagtaaaacaatctcactcaagacaaaagaacgtttctttaaaatcttcagattaaaaaacacaatcaacataaagaaaatgctgtctctgcttattagttgggtgtccttgacaagaactttaacctgttattgggtttgttccaactaaaaaatagggaagttaatagtatttgactcagaacaaggttggtttctcttgtattattattattattattattattggtggtggtttgcaggaaaggtgctactggaaataagggaagaggctatagtttcccagagtgacctttccctcaccccagctattcttccttcttcctctactgccatgatctggacaacttcactttcaatccagatttgtaagatggtaaaatagtggtcactttttactttatcaggccattttacagctaaagggaaagtggatagggaacatactttgattaaaggtaggatacaacatagaaaatctagaattcataaatactagattctcatgaagtacacaaacattgttaacaataagataatcttataataaataagaaataaattactaattttattcaggcaaaccactttcagaacagaatagggttgtgatatatttaattgtgacagcatcttttcacataaaatataatcataatacacacacaagtcccttctcaaaaagaacaaaagaataatttaatcacaactttgcatatttctgttcatgtgaactggctattccatttttcataatctagtaagctcctgatagcaataaaggtttaaaactatgcaagaaacatgcagaattttaaaaaattgaatctgttaatttactatgtttttactgcaaattgagacacactgacattataccattttggtgatgaaacacaagtgcttacaggagcacagtttgggagtaacaacctgaattcaaagcttgacagatatgaaaatgctaaacagatctgtatgttagaatacagcaagaactggcaaaggagtgaggagaaggaaaaggtgagagtgatttctcaataaaggaagaaaataacatgtacacgtgtattagtccattatcacactactataaagaattacctgagactgggtaatttagagaggaaagtggtttaattgactcacagttaagcgtggctggggaggcctcaggaaatttaacaatcatggcagaaggcgaagcaaacatatccttctcacatggtggtacgagagagaagaatgagagccgagcaaaaggggaagtcccttataaagcatcagatctcaaaagaacttactatcatgagaacagcatgtaggaaaccacctccataattcaattacttcccactgagtccctcccatgacatgtgaggattatggaaactacaattcaagatgagatttgagtgaggacacagccaaaccatatcattccacccctggcctctctcaaatctcatgtcctcacatttcaaaacacaatcatgacttcccaacagtcccacaaagttttagctcattccagcattaacccaaaagtccaagtccaaagtcttatctgagacaaggcaagtcccttcctcctattagcctgtaaaatcaaatgcaagttaattacttcctagatacaaagagggtacagacattgggtaaatacaccagttccaaatgaaagaaattggccaagacaaacgggctacacacaccatgcaagttcaaaattcagtagggcaatcattaaaacttaaagttccaaaacaatctcctttgtctccatgtctcacatccagggcatgctgatgcaagaggtgggttcccacggccttgggcagttcagcccttgtggctttgcagggaacagatccctccaggctgctttcatgggctggtgttgagtggctgtggcttttccagaagcacggtgcaagctgttggtgaatctaccattcagggatctggaggatggtggccctcttctcacagctccactaggcagtgcccccatggagactctgtgtgggggctccaactccacatttcccttccacactggcctagcagaggttctccatgagggctctgcccctgcagccagcttctgcctagacattcaggcatttccatacatcctctgaaatctaggcagaggttgccaaacttcagttattttcctctgtatactcacaggttaaacagcacatgtaagctgccaaggcttggggcttgcaccttctgaagcaatggcccgagttgtacattcgcctcttttagccatggctggagctgaagcagctgggatgcagggcaccatgtcctgaggctgcatagagcaggggggccctgggcctgccccacacaaccatttttccctcctagccctccaggcctgtgatgggagaggctgccatgaaggtctctgacatgccctggagacatttcccccactgtcttggtgatcaacatttggttccttgttacttatgcaaatttctgcagctggcttgaatttctcctcagaaaattggtttttattttctatcacattgtcagggtgcaaattttccaaaattttatgctgtgtttcctcttgaatgctttgctgcttagaaatttcttccaccagataccctaaatcatctcactcacactcaaagtttcacagatctctagggcaggagcaaaatgccaccagtttctttgctaaagcatagcaagagttgcctctcctccagttcccaacaagttcctcatcttcatctgagatcacctcggactggacgtcattgtccttatcactatcagcattttggtcaaagccattcaagaagtctctaggatgtcccaaacttccctacatcttcctctcttctgagccctccaagtttctaggaagttccaatctttcccacattttcctacttattctgagccctccaaactgctacagtctctgcctgttatccagttccaattttcgggtattcttatagcagagccccattaccagtaccaatttactgtattagtccattctcacactgctataaagaactgcccaagactgggtaatttataaaggaaagaggcttgggtgggaggcctcaggaaacttacaatcatgatggaagaggaagcaaacatattcttcttcacatagcagcaggagagagaagaatgagagctgaacaaagggggaagtcccttgtaaagccataagatcttataaggatttactgactatcaggaaaatggcatgagcgaaacctcccccatgattcaattacctcccatcgggttccctcccaccacatgtggggattatgggaactacagttcaagatgacatttgggtggggacacaaccaaatcacattaacatgtgacatattacccattttaattttgcaagaaaacagaaaacagaattctgaaaggttgaagtatctaagacattaaagagattgtaaattgacaaagggaaaaaggatataccaaattttaggcaaagcgtggtagtatgaaggaaaacagtatctcagaggaagagcttggaatgggtttgactagacaaacaaccctccagggagtcacgggagatgaaagagtggtggcaggggactgactgtgtgccttacaggtagtgggatccaacaggtgcttttatgtaagatataacatgatcagatttgtgtgttcattgtaggtgttcagattcaggttgttaacacttagatttgtcccttggccctatgcctgcatcttcagaagcttttcaaaatttatatgcaactactttcttcacaggaagttttcctaggccctaacttctccctcctctttttaatcctcattttcttttcagcttccccaatttccataggatgaagtttcactgaaattaaatttttcatctttgccttgttacttaaaaatgataatttggtttaataggtgcattagcttttattctgtcaactgcttgtcatagtacctcatattttcacattccttggtcctacccaatgcagttctaacataaaataagcttccaggatattattcttatatctgagcagtgtaggcatgttagtcctgcttgtctggtaaatgagatcatagaataagtattactggaaaccagtattggcatatttgtatagtccaggtgttaactgatgttatcccatcttttgagacttttacataaaattaaattgacccatttcctgcatcttcccttcccctaccccactctctacatttagtgggaagtttgatgcccacctccagattcctacaaattcctcaaagtttgggttattttaatgggccttttttggttttaaatcaaatttctttttttttttttttctgaagccctgatcttatatctcactctgatggctattttattcaagccccacagcaacctataataccttcctttaaaactgacgtggccagggcatgattaacatggagtatgtgtgggagactactgaattttgggatggtttgagaaaggggctatgattacatcataggagtatcaatattaccaatcaaaaaataaaatattcaatatgcctgcccctaaatgtctttccgtcactttccttccactccagtcaggaatttatccacgagtgacactcaccaacagtaccctttgctcctatgaccctttctttctcctgtctcaccccatttctctgcctacatttctctggtcctccttacttgtagtagcagtacatttatccagtttatctatttgcttctttctttccaaacacagcatgcacggaagtatgcatcttgcacacttaaagaagatatgctaaacaaaatgtcatttctctggaaggaaattctgatactccattaggagaagaggtgattttacatagttgtgactttaaatataactttttccttctttattatagtttgattgagttggtttgtaatttggaaggaaatcgaataacactttttattaaatgtaacaaatcataaaatggtaatttaattaaaattagagccagaaagaaagagagaaagagagaaggaaggaagaaaggaaagaaggaaggaaggaagacaggaagacagagagggagagagaaaggaagaaagaaaagaaagaaaaaagaaggaaagaaagaaagaaaaagaaagaggaatgaaggaagtgaggaatggaagaaagggaaagaaaaaaagagaaaagaggggggacaagatgaaaaaggaaggggataggaatggggaaagaaaaggatatatacaggaacagttaggttaagagagcccaagtttgaaagttagcttagttgtgagtaacaacactactttgttgtggcttgcagtatttgtactcctctgttcaaagcactctaaatagcttcctggcttagaataaaagacaatgtcatttcaatagacaccatggctctgtgtttctgctccccttgcttgtcagatcttatctcctacactctcatagcccacaccagtcctctcacaatgacattttcctcggtaatatttgtgtgatctcacctcagagacctttcccttgctgttttctcttgttttgcctcggatatttacatgtgtcactcctttgcctcctttagatttttgctcaaatatcagcttcttacaaagattttcctaaacatttaattggatcttatttaccccttgacaacttcttccagctctctccacctactactcttatattttattatatatgtttattgtctgcatcccctcattagaatgttcatgaggacaggaattggcatcattttgttcataagtggtttgcctagaactgtgcctggcctatagaattactttaacgcaatttttgtaattattgaacacaaaaactattaataattttttaaactgactacataatttgattagtgaatcactttttatagtccaagaactctacccagaaagcgtcacttggcctgaaaagacaggaagaacagaggagtctgggcctcagaaagagaacctgaagacttaggtcagttctttccagagtgttttgtagcactggtctccacatacttcttgttcatattcctcctaggtgacttttgaaaaaacagatacttctcatgtatttttttattgacatctaatattattttcctaagttttaactagttgcaaagatgcattttagctattgagatttgaaagtaaaatggttacatcacctctttaaataggtccatggaatatacaatctgatactcaatatctttcactgaaaaatatgaaagcactgccttctttaatagaaatgctatgatatttctttttctccttgaatcattttccatgacacttttccccacagaattttatcttcatgtagtatgttcatttgctggaaaatcatttactaattatgatttcatattacatggtatattagactgtcctcatattgctacaaagaactacctgagattgggtaatttataaagaaaagaggtttaattggctaacagttctgcaggctgtacaggaagcatggctgcagaggctcaggaaacttacaatcatggtggaaggcggagaggaaggaggcatattttacatagccagagcaagaggaagagagtgaagggggagatgctacacacttttaaacaaccagatctgagaactcactcactatcacaagaacagcaaggaagaaactcgccccatgatcaaatcacttcccaccaagcccctcttccaacactggggattatattcgacaggagatttggatggggcacaaatccaaaccataatcacatgggaagtgggaaaatgtaggttttttgagactgagaatcttatcactaaaattatattagtacagacttgatttaaacaatataaatgtattatataatgtgaaaagtatttattggaaatgcatctgttaatcagatggatgaggctatttttttttctaataattcatgtacttggaagatcatcacttgttgctggaatggaacagagggttcagtatgctgcttatttttttttcatttttctaattaagaactgagaaatttgctcacataataagaatatggaaattttaattcctggaaattcttccaagctacaaaaagaatatacagtgccatactaaatcatcaaaaatggtttcccataacctgtcagctgaaactctattaggtatatcttcaattatgttgaaaacaaaaagaattgaaaaccaccttagtttcagaagaatctgatactcaaacctaaaagctattcactgttttctacaccaagaccaatttccatttgtttgtttagtgccctggagcgtttttgttgttgttttccaaggagtaatgtaccaataatatgattaaggttgctcagtatgtggatttttttctcttttataaagagataagagtgattataatgggtgggggaggagaacttaaatctcatcaaatctttctgaagcagattttaggaaactatacacatacaggttttgtagatatttaggttgattccttaaaaatatccttctacttgcatacccttgtttgaagcttgtactttaaaacaagcaaataaaaataaccaatcctataaataagtgtcctaaaatgtgtaccaaaaagatatgtttgagaaatgctacttttgcttttctccttaaaaaactcacaatgttcactgttggcatataatgaacatatgggtgttctttggtaaagaaacctgtttggcttgtttaacacaggctttctaaatcaaatttgaacacaggacacttttctcttgtgacattatttgacaacccacagtactagtattccattggtacacatgtagcactatactagatgtggctactgaaaagaatggcgatatataaaataggaactccgaagaaaagtggctttagaaaataagggctcaatgacactggttgctgaagtcataggaaagtgaattttgctaactatggaatctgagagagtagagagggacccaggggctgagcaggatgttgcacatttagaacagaaagagggctagttgaagaaatatgggggaagggagaagactcaatgttgccaccaagctattatataagagactttgacaagacgatctaacatctaggatatttcatacatattcaacagataagctgctgctgagaatattctttcattttgaagctgggggcggatggggagcctagacaaaaaataactctgcatctccagagatcaagggagttaagaaaattcattcagtctcaaatggtgctagatggaaaaatggtaatttagaggaggagaaaaaggatagcatggcccaaaatataagaatatgtgaaaaactgacctgcctggagaaaatgggtacaaagtccagatgagagcaatgaatctttaaattgatgcagatgaattaatatgtgaatgagggaaatttaacttgttttgtttttcgtatacagacagctttctctctgagataccctagcactataatcaaattttgtgtgctcaatgcagtgcatatattttggggaaaaaaggtgacataagagaagtgaaagacgacagtcaagctttaagcaggaggtggaatctttactgagcctctaaaggacacagaagtcacctaagatacagagctgataataaggtgtgtccagaaggtgtctctcttgaaaggctttctataatgtacctgttctcttctcagtacccacagtgtaatttttaaaggtttagaaacatcatagaaaaaattacaaagataagtaaaggagaaaaactgaacagcatagacaacaaccacagtgaaaaaatacaatttttgtctatatagtccctgtaatatttagatcagcatccttcttagagttctctgaacatacatttgacaggactggactgggtctgaacacattgtaagctgggagctgatactggatgtcactgaattgactcctcaatcaaacctacattttcaggatacctttgtaatatgtatcccctttgtacatagtacgttgtactatggtcagtccatagcattactaaagaatgcaactaccagcaaagatttaaatatggaatccaagagacagattatatttggctttaatatcagttactatgacaacaaatgggttatttaaagtggttagcattctagcccactgagttaataatatggacaagaatggcataaaagttgagcaaaagcaaattacctcaatgtcatatcacatagcaatgacaatgaaagctgtgtaggcttaagagggttcagagggtttggaaaaacatcgttaggaaggacaaatccatcaaaaaatataaacagttttatttataactagcagcacatttttgatgcctcctcaatatcatgttcttcaggctttttaaaattcaagccttcagatttaaaacaaaacaaaacaaaaagccaaattggaacagaaattggcatttagctagaatcttttacaactgcatgatctccatttactaattatcccctttccatctcaagcacatggtcaagagtgaaatgtgaaattagatcttggatatccagaagattttaacaaggaaaaaggtaatgcaataagtaagtaaggatcaagttttataagctgctgtttgaaagattcatctgctaaaagcagcaaagaatggcatatcataagatgttaaagcagatggcctaagtcacagtgctacattacacaagtatgaagactagaactgaaatagcctaagtaatatttttattaacaagatgccaagtacagcagcaaaaatacctttaggaagaaatctcacttcaagaaaggtttttcctctttacactttatgctattttctgaattactcttgttctgttgcatatgtttaagtgtctgggtgctcaccatgcccagatgaaagaagctaacctctttccttaaatgagggcctccttgtcttatgagcccacctgtgtgatggagataaatgagtgtaaactaaaccagcaacctaggaaagagtgcactatactgtatagtcttgcagataattttttgcacagtaaacaaggagagtgggggactcattggtctttgaattagttataaagaaagcaacactcattaagtctgtgatgacactaaatgttgctagagtgatcttaagattataaaggtaatgccaggtagtcacttccagaatccagacacacagtagtggctgtaaacagggagctgtgattacccacagacatttcaactacaaaaccaggctacgacaagcagatcagagagctgacactcagaaatgcaaaagactttttcaaatcagaaagaacaggctaaggctgaacaaatggattcacctatatagccctatcaatacatattgttcactaatatatgtgtattcattcatctatggattatatttagggaccactgtgggaatggtgtagtggttaaaagcatggaatttcaaatcagacaaccttgttttgaattttcagctcctccactctggatgagttaacatgacttaatcttggctttatttgtatttttctcacaaggctgtcccaaatatcaaatgtgtttaaagcccttagatcagcgactgacacaaaatttacaccatacactgtttgatgttattattaaatagtatgtgcattgtaaaatacatataaaatagaaaaatgatgcaaataggcaccagtggaaattctgatgtttttctcccttactccatgaatttgcttgggcaacaccatctaggccatcaatctgaagaatagaagttcaatagggaaagttttgagcaaagtacagtcaaaagacaaagatggcagaccttattcaaatacagaacaggaaagttaagaccaaaaggtcataatatttggcctgacaggccctggtatcttggacttcactttcatggagatgaagagcatagatttgaaagcttaatatcattatatgtgaatcctatatctatctctctttatgaaaatttggctttctttacagctttctaacaaggaaaaaatgtcatagccaaagaatgatactacctctttggcaggtaaatgtatcataatacataaattaatcatcattctgcttataaacttaacattattgtgagttttttcagcatgagtcagcctcccaagttcattgcaaagtgtgagttttagggcctatcgggctgtggggtagatcctgcacaaaggcaaatttagcagggtaattcttgcctttgcctgcctgccagtctggctgtattgtcctggtgacatccggcttctaagatgctactactttaagttttctaagttcaatctggcactgcatagttgggtcaataaattggaaatttctcctttatgttttcatgtctcacaatcttaagaacgtggatttagttaggcacgtggattcaaattataaattgttattttgtttccaccacccccaccactgccacccatcctccatccccaaaagccttatgatctcatcacctaagaaaagtattcaggacacaactaaatagtaatatgaagccatatttttcaagcttctcttagaaaatatgtgatttatattttctggctgaaggactgtcttttgaattagaaaagtctttgatctactactagttttttagtgtttcagtggagtcctcattaaaaaactgttatagggtagtacaactgatgatgttctttattttctgaccattactgtgattgtcatacatgcaaagagctagaaagttccaatagattaatctgcattggactttcttaggccaactctcaggcttcattccatggtggtgatcacatctgaatagcaaaagcatcacatttgcttgcatttggcagaagatgatttgccttgacaaatattcacttataagtcaacatttttagccattctttatatcaaaatgaaaaattaatttattaattttatcctaatttttaccatttgtcatttacaatttttaccattttcataaagaaaaataacaattgaactctaagttcaaaaactccaacaagcaccaaccaacctgtgaccacacttacatctatggagcagtacaagctttcaaagtcatgttccattttgtaacaggtttagccaaaatgatgatattcaaaccactttttatatcacagaatttaccccattaccatttctcgaacccatgaagaaagttaaagctatttaagtcagcgtgtccttgtgtaataatttaataactgcaattgttttcaagaagcagggaggcattagttttgaaatctgtcctatatttgtacttctgagacccatctataatgaactcactaataaatcacatactactgaaaatttcttcacaggtgtttctgctctaaaatctttggcaaatggaacatgtcattatagacatcatcagtaaaagataataaacaaaaaataatagagccaaactactaaaattcataattatttgctccaggtaggctaaaagtattgggttgactgcaatttttcaaccatttcttaaagcatatttttggaacacagtacaattagtcttctatggcattactcaaaaaggatacctttaaaaaagacagagtgaattggacatcgaaagtcttttttaaagggctgaactaagttttctacattccaagtcttaccttctaaggaagtgtcaaataatttaaaatattttcttagtaattagggcttttcactctgttgactctagtcaatatatttcacttcagttttaaaaaatatttgtgatttttttctttaaaaattttatgattttatttttattttattttatttttattgtggaatacatatgcagaatgtgcaggtttgttacataggtatacacgtgccatggtagtatacacgtgccatggtagtatacacttgccatgggtaaatgacccatcaactcgtcatttacattaggtatttctcctaatgctattccacccctagcctcccatccccagacaggcccccatgtgtgatgttcccctccctgtgtcagtgttttctcattgttcaactcccacttatgtgtgagaacatgattttattttttaatgttgctgtaaaaaggtacctatgttcagtgttatgctggtaaatgtttaacaagtagctctctaaacaaatgaaaccaagcaaaacaaaaagcttcgatttgtagcatttgccaatttctatgatgaaatattctcaacagggcagttttcaaattaccactataatggcattgaatgcagagttaggaagagatgcactgtacatcattacatagcatttccatcatatggattcagtagacataaataatttcaaaagcatttgtaatacagtaaaagaattatgaagtgattagttttgagtatgtattacatttggttttaatatatttaattgtaacaccgtgtcatttaatttgtaatggtcattgtgtttaagaataatctttcacaggccatgaagagatggctctagcacatcactccctatgttataaagttaatcaagatttaataatatatgtatctccatgatagcaaaattcatattttaaatatccatataaaaacattctagagagttttcattagttggtctattttctattcatgatagtttgagtatgttactatcttatttgctttgaagttcatggagaagaccctaaatgtaatggcataaacctgacattattgtggaagccagtgtttaacttcgttttgggaatgcattaaaaaaaaaaaaaactcattagcttatcataggataaaattattttatttaaaaactgactagccaaatctgaaaactcctagaggaatcacaactccactgtaaggagtggtgacattactataatcttatctcacattagaggccttccatgttaataccaaataaactaatgcgcccaagttcccaataacacagaagtttaaaattttccaatcaagctctcttcagacctttaaaaagcaaatcacaaatcacaacacctaccacataagatatacagaaatcataatctctggcctccacaaatctttactactattattacaactaatgctattgattgcaaacactatgagcaaggcatgggtctaggattaaatgaggtcacataatcctcatatgttacctcatttaatcctcacagcaaaatagggaggtacctctcatcttcaatgtataggtggacaaagagatgtagtttaaatagactaagtaactagcccaaattatcgcagggataaagctggaacccaaacccaggtctgcttaactcccaagcccattctttattccagaacatttattatcatattatctctactcacctgtcctctgtctacccagtgttcaaactagaaaccccagacttatttaattttgtctagtccttcactccctacatatattcaatcactaaatcccataggctatacttccaaaataagtctcagacacgttcatctccactgccactaccctggtcaggccactgtcatatctgaccaatgtaactacgagtcttctacttcgtctccttctcttccatcttgccactattccctgcctcctcatgctcaatcattctttagcatgtagctagaataatcttcctaaaattaaaatctgattctgtcaatatcttaattaaaatatttcagagaggactcaactccaaagtccttatgtagattttcctcagctcttcaggatctgttccctataatctcttcagtctctggaattgtattttcccctcttagagtgactgatttctggttctctgaaggtgtcaagctctcaccacttagctttctaacaagtaattttctctgcctgaggtgctaatcttctgctcctactcttctccaacacttccagtgtaatttgattaattattcaactttcaacttcactctttatgcatagcctttttgggctctcaaagtctaggagaggtgctctgccttcatgttatccagaacatccccattcaaaacacttagcacactaattcataattttcctgttctctgaagtcagaaactatgtctgtcttatttttgtctatatacctaactttgaatatagtggcttacatggtaatggtaatcaataaacatttgttgaatgaattgatgagtttattcagaggattaatgagggatgattgcatgaagtacctggtaacactgtccttgttaagaatctaaccatgtctatagatacaaaggtggaaaagggaaatgacacagtaaaagctattttgacctctccactttgatctcaaaatatgattctttttttggtaaatacacagtttttaatcataattatatgaatgtggaaatattctaagtgaaaaaaaacagtctttaaaattaagatcacaaaggcaatttaatgacttggaaaggaaatgaaatgattttaaattccattaaaattcattttattgaatgtttttatatgtattcatcataactaatgttaatgacataaaaaatttgactcattgatttaattttgtccatatccaatttttaattgttatttatgtcattttttttcttttccagtcactgtgactgttgattcctaatttctcaggtcacgaatggcaaatagaaactttgtcacaataatttaatttttccattattttctggaaataatggtttaagtgtatgcatatctgaacaatatctgttttataggttacttctaatgaacacacacataccaatttgaaaatcccatagaaaacacaatcttcctcaattgtttttttcttctacaaattttaaacttaaattttgtccactgtttgctttgtgttatttgtactggtattatttattatgaatgatataaatgattaataatttgatttatttttctgaacaaaatataaagcacttaaaataatttcaagccctttagtaagtcaaagttatagtttctaggtgctcaacattagggtcaaaatgttatggtttgattaacaaacatttattggtagtactgagcaacgttctttctgcccttcccttgagttttaaacattattttgtttatgggcttaagtacctaacacaataggacaaaggctacaatctactcatgcagcctcaaaacatcttatttccttttcttcttttttttttttttgagacagagtttcgttcttgttgcccaggctggagtgcaatggtgccatctcggctcactgcaacctccgcctccctggttcaagccattctcctgtctcagcctcctgagtagctggggttacaggcatgtgccactgcacctggctaatttttttgtatttttagtagagacggggtttcaccatgttggccaggatggtctcgaactcctgacctcatgtgatccacccgcctcggcctcccaaagtgctgggattataggcatgagccagtgcgccaggcccttatttcctttttatatacaggcaaattcattataaaaataattttgaaaaatttattttaaaaagaatgatactaaaagaacaaatggctggattctactgactatttaaaaaacagaaaagacaggaatacaaacaatagtcaggactagaattcagacacattccatcctgaaactctataataatgagaaagcaaggtgccaaatgcctctaaactctccatttctgaaaacttgaagtgttttactgtcatatgtctagatgcaattctgatctctttggtgccaaaaccttataattatgtaacctttagaaacaaagatgcagtttgggttgcacagttatgtctaccctgtgatgatctgatgatactatgaaactctactgcaaactatgtctgaaacattctctgcattaatgaagcatgaattaattctatgagtagataaattattggcaatgttaatggaaatcagtgtttaaggataaatgctgccatatgcaatagaataatagcaaaatatgatttaaataaatatgctttactttttctgtaagcatattaacactttgggattataaagttttcacagagtactgtgaagtaaggctcactgtgagctaagtcctacttgttaatacctgggtaaaactgaggaggagaaaaaaatctctgtggattgaggaaggctccaatggtaggacttggcatttaagtacagtagttaggtttagctgagggatatagtttaggaaaatattctgtcatccttaagatcactgcctagtactatacgtagtaggacttcatgggcccttccctaagcatttttttttggtgaagctatgtcatatatgtattcttataaaagggaagctataggccctttgaaacgatccatggtcatcattaactatattcatttataccattctgtacgtgaagaacataaagtcagttactttctcatgtaccaatttccttatccaaaaagtaaaaagactagacaggacagttttcatagaatgagtgtataatttgtatttctaaatcagaggactttgtgtcttcattgaaaatttaggagaccataattaatcaaagaagcagtagtaataactcattctaatcagcaagtagcattttttatgaaaattcctgaaacatcataaataaccaggttctgaaaaaaattcaagtaattgcaaactatagaacataaatatgctttgttgatccttgcttcattaaagtatcagtaaagtatatgacagactctagaatttggtaagttctaggctcttactcagagcataatgttttttcagattttaacataaaaatttcaagtttgtgacatctttgtgagtactgagatgagaaaaattcagtagaaataagcaagtgatatagcatcatctatgtaggcacctttgagggtctgttttcatctatattcttagattctttcaacatatgacaaaagagactgatgaaataaagtctggaaaaacaccaatattttttccccttgcaacccattacatcagccagcatttccctgtagttgtgattattacattatgacttgattactaactattactgccacagttggaaaagtgaaagcacagcgtggagccatttccattaaaggaatatgaaattccataacaagctctgaggctgcacggctgctgtggggttgatctcagaagtgcataactatctacttaagatgctgtttgaaggagcaccctaacttacatcattatttcatttagtttgaactgtaccatggatttttccattaagcaataccagacacttaaacactgttatttgtgttccaaaaaaggtaatgtgattttttttctacctactttccagagtaccagaattttctactgcgtgtatgtgcaatcctgattgtgtctaatagaacaggatcaagcggttccataaactagagactgccagtcatcttgaagtggcataactgagaagagaagcgttaatattcatgtgggtaatatttgtatatgccatgtaagaactcggagagaaagtagtttcagttgctatgatttaacagaagaacataaaataaaaagacccaaatatattcaaaacatatagattaatgttaatggggaaaaggaatggtaataccactttacatctcttcttggtttatgtgtggctcaaatgacaaggtggcatgagatgaggaggtgatgtgaggaagctcttttacggtgtttttaggacaaaatacagtgatggaaaaatacaaaaacttcttaaatattttataggagagtaatcatcactgtaagaaaactacaaatacattttaatttatgcttggaataggctgtatgtaagcgtgcactgtttgtgtgtgtgtgtgggcacgtgagcacacatgtgaatatgctctcaaaataatagaaagacgtagaaatatatgtcttcatttgactttcaaaacaaaagaggcttgtttactcatgtgatttcctctaaccgcaatcctgcagggaaaatctatacttagcaggattgaagatgtccctagaagctttccagggaaagttaaaaggaagtcactcctcctcttctgtctgtttgccattttctttcctgtgtaggattactaactttagtcttgaatgcatatgctctgcagtagaaaatgcaaggttttagggttttattatcagagagaggaacttaaaaatggttccagacctccatatctgcaccccaaacctttcctgcccccaaagtcttagctctacctgcctttgcattagtgctgctccaatactagcaacagcttcaccttcgaattccttctttttatttttaatattttaagcacaattaattgaaaatccctaatgcaattctgtcctatttccccacaactaattttgaacagaaaatacctacaaaagtacagtgcgagcaagtctgttggccaactaagagtttgcatgtgttttttctttttgaaaaagatgaaaataaagttgaaatgtaaaaatctaaaatgtggttccaggttctttcgcaaatattcactctgcagcagagaatgagaattgcgtataagtagaaccctgggaaaaacagactgatttgaaagatgctgggagtgctcattgccctggaaggagtcatcaaacagcagtaggaatgataaaagtcagagttcccgtcccattcctgtggctggctctgcacctcctgaccttgaataagtcatttaagctacagagaccattcttttctccctttagacataaaacatcaataatgttagaaaatagctaaaaaactttaaaaacttataaataattttatcagtaaaattttgtttataaataatttctcaaatatcaaatattcattccttattttcttctggatttctaaaataattttctttctcaattgtggtgaccaaattccagaaaaactgttttaatctaggacttcacccttgacaagtcacagtatgctgaaaatcacttttaagttgatagtttgctattgtgtacaccccagttttgacactctagatattcataaacaacgttttgcttttcctttacatgctattatttcatgaaagtatcctcaagccaaaaccttgacaaagtcaaatgaaaatgcttagcattttttttctttagttaagtataaataagaaatacaacacattaagtgttaaaatgaaatttaagggaagacgagggaaaggaaacaactaatgaaagagcaattgttaatttcgttgagacctaactacctgcccaggccctttgctaggtgctttctatgggctgcctcacttaccatcacacaaccccacgagggaggcatcatgattatctctattgcacagatgaagaaactgaagtcaaagctaaaggtcttactgaaggtttcattgtgggtgaatggccaagctatctctgataccagttatgtcacaccagaagaaaggagagagaacaagatagaaatagagattaaaatcatggtcaagagaagaagaagatgggagggggagttgaaagacgaagggaaggaaaagttctcacctatcctctgcccttctaggatggacctgttcactcccttcacccactcttaaactcatatccagggttagaagcaatccccatatcagctgtactccactttttccctagtactccagttgggcttttaatgaagaagaaaagggaatacagataatttgactatagaaatatcttcaagttttttcccaaggaaaccatttgcaaaaattgacactttaaatattattggtaacaaatttcatgcacctcattccatagctattttcatcacaccagtgtgttttcacggggttaacctattaacacctttccatttttaaaaagtctatagaacaatatacatatgaggtaggtgtttgctaatcagttagcgaaatgccattaaattagcttagctgaaggtaattggttactataaaaaaatacaactccttagatgcagggaaatgcataggcctactttccacttaactaaggcagtgattttttactctaaggagcctgaagcaatctttggaggtatcccaggggatgacgctggccacgggttggatctcttgaccccctttttagtccctgataagcagaacaactctgtccttctgacttatatactggattttgaataagattttggtggaacaaagagttcagtttaaaaaatcttgcaaatcactgaggtaagggactttctatttttctcaagcataattttgaacataaaatcaactcataattgttacttaaagccatcttcaaaattcgtgtcaaattatattctgatattattaatgaagccaggatgacagtggaatctttcagtaaaaccatatgataatatttgaataacaatattttagtggttcagtccagctcttttgctcaagtatactgaggcaaggaaaagtcagagcaaactcacaatgtttgaaaagcttaatggtgctttaacgaaagataaaatagtcataagggattttttgaattataagatccttataacaagaagaaagtaaaaggaagctgatctgatttttccttcataaaatcatattaatggcctggtacattttgtcactttcagtatgtaaatattgattgtcttctcttacaatttattgttatcattcacactttcaaggtgaaacctttgccttattaaaatttatatttattttcaaacatttagagagagatttttcctgtccataaaaactttgaatattaacatttttaaaaataatttcaaaagcctgtttgaatgtaaaggataatatagtgaagttcagttgtatgctccctatgcatgaagacctatgccagaccctggcaaaagtttagaaaaacaacaataataataaagaagaatttgtctccgatcatgaggaactttgagtttagctataaagattgacatatgaggaacttttatgtcaacataaatataagcacaagcaaccaaaagaaaggaaaatgagctcaaattgagtttcagataaattattctagaggctacactaagagtagggcttttatttttttaacggcttcactgcaatcactactgaaatttcattcataccatccaacctacccatttagagttttacaattcagtgtttaatatattcacgtggttgcgcaaccatcaccaaaatcagattttagaacattttggttccctctaaaagaaaccctgtagccattagttatcactcatcatctcttgccattgactctttccccaaccccaccagccctaaacgaccactatttactttatgtctgtatggattcacctattctggacattccatataaacagaagtatgcacgatgtttttttttatgactactttctttattaggataatgtttccaaggttcttcctttttgcgcatgtattattagttaatttatttttattgctgataacatttcattgcatagataggccacattttatttatccattcatcaactgacggatatttgggttgtttccactttttggtactatgagcactgttgtatgaacatttatgtgtacaagtttttgtgcgaaggtatgtttttatttctcaagtgtacgctaaggagtaaaactgctgggtcatattgtaactatgtttagctttttgaggaattctcaaatagttcttcaaggtggctgcatcattttttattactactggcaatgtataaggataccaattccccagcacttgttattgaccttatttttgttcataggcattttagtgaatataaagtggtgtctccttgtaggtttaatttgcatttccctaatgactaaagatgttgagcatgtattttacgcacttattgaacacttgcatatcttctttggggaaatctctattcagatcctttgcccattttaaaattgcattatttttctactattgagttgtaagagttctttataaactctctatacaagttcctgatcagatatatgatttacaaataccttctcccattctgtgaggtgttgcttcactttcttaatggtcccatttgcagcacaagcgtttctaattttgatttagtacaatttatctacttttgttgtgattattgcttgtgcttttggtgccatattaagaaatcacctcagcttaggtttgaatgatgagtaagaaggaacaaatcaagaatagtggaaccttattccagacagacgttagcgaacaagcaatgtcatgtaaacatgatatactgtgaattcctcttttgttagcttagaacagggtagagtcccacagagccatacctaacaactttggcataccattatatagattttctaatgtacgatgtggttcccagatggatattattcacactatgctattgctagttacaggttaagctcagttgaaagagtatatgtgctgaaagaaggccaatgtaatataaacatttaaaaaatatttatatttctttaaataattaaaataacaattacacaattaaaatatttatgcctctcatgtggaggccctaaggcaaagtccagtttaaatattttagttactatcctagatttaaactaaatctagataactgtcaaatatacctaaaaagctttatgtaatactataattccatgaaaaaagggggaaacatttaataatattgctaactatagcactcatgttaatattttttgctttagacaaatatttccagtttcatttttaaacatgaagtgttttgcttagtttttttagagtttagtacattgaactgaagcagagaagcgcccgatcatcttatcttacaggagagaaatacttcacttctgcatgagagcagcctgcgtaatgtaatgagccaaggtctaagagttgacacacagttcctgttcttccctgcattaactttgtgtcctctgaaacatcacttgccatctctacattcccattgtctcaagcgaaaaattcaagggtttgactagacagtcttttcaactgtgactttcctggatgaagtggccaagcagaaactactggtgaagccagtgataaacacctctgtcaaggcagtgtagacatgcagtggtagtagtttgtcacctatatgattttatttgagagtgccagttcagtctgtcagaagtatcttccagctattcatctcttaattaaacataatcaggcattggtttaaaaatgcataacactaccagagtccaaattataagttctaatccagtctatgaggtgaaagggaacctccttagatgaatgaggaaactaagtcttggaaatgataaattgattaaaaaacatgctactatttagccgtaatccctggtatctctccagattacttatcagaaaggaaataaatacttgtgcaaataccttattcttaaatctaaaatccagaaaaatgtgtatcaggcaataatagattaatatattaaggtggtcagataaaccaccaaatgttgatggaggtgttttgtttaattgagtaaaccacctttataaaaatgggtcatttttatttattctaagtaaaaagagataatgggtcatactataattccattttgtctccaatggaagttatctctgataaaaaaaattccaattaaaaaagacactagcaaagaaacaaattgtaattctgtaattgccaatgtctctgccaattaatacgtgatgactattctgtgccccagaaatgtgttatttggagtggtcaatgagtttggtcaacttggtctgaagtacacatcttttgttcttcctctgaattacaacagcaatttattttttcagctttcatcacgctcctcaatatcttcttctgactagagtctaagctccttgatattccctactagtttattttccattcatttctcttacaaatatatatttagcagtcctaggttactgtgtggagtacaaagtcagaaatccaagactaaaataccataccacaccactaccagcctgggaattctcttttctaggaacagggcctgaccacggcggacagggcagtggactcaaatctacaagggacagcgaagctctgagccataaagctcttatgaaggatcaggctgaagccattctctcagtgcctttgcctgagctcacacccttgttttgcttccttccctgctccatcctgctttcttcagaccctgccaatctcctgtgagcacttcccttaacaaatctctttcatgttaatcctcatctcagaaactgtttccaggaaacctgacctaagacttgcttatagaagataaacaattaaaaacatatatgcaatgtggataaacagtgaacaagacatccttctatttttcaagggaggcaggcttaaataattaattgcacatttagaccatttttatcaccttgatttaactagcaatgctctagcagatattccctaaatatgtgttgagtgaacaattataaatattaaattaagcaacaaatataaaatacatatattcattgtctaattcttatgcatttgattggacaatattgaccagagaaggacttcagagaagaaatttatttaattgaagatggaaagtaaaacagggttaatattaactatgagaaattgaaagcatcagttggggaaaagcatataggtcacttggacctaatctaccaaaactatgaaatgtttctccaaccaaaatgatagggctaagaaatacagtgggagttggactgagatgaattaaaatctcaggaaggctaaattgttcatgcatttctcttgaatgtcttggtaacaggactgaaacttgagagtacttactgacaattgcccaaccccgccagtttcctggaaatgctgatggctaggaacctcaccctaagtaagaatttctttaccatcattctgctctatgacaaagtgagcccagagatgaagaggaagcaaaaaacaggcaagggattccaggcatcagccagcagaggggaaaaagagttagggagggaaagcccaagtagctatagaggggagtaaaggatggaaaagagaaagaaaaacctctgaggtttaaaatttccatggctgcaagaatggatacacaattcaagttgaatgatgaagagtcaagataaataaataaattaattaaataaaaataaacgaatgaacacacaaaaaaatcagaaaagttactgcaataacagggatcaaattcaatacataaagtaagagtagtaaaaaggttactcttggagaatattttaaatttttttcaattttatttttaaattgacaaataataattttacatagtcatggggtccacaacgagattctgatacatacaatgtatagtgatcagatcagggtcatgaagccagaactcagactgtgaagctggctacagctctgggaaacactgccccctagaggtcctctgtgttttcagcgagaccagctttcaccataaactgtcaggagccaagccacagactcaggcacccgggatccccaggcagagacctcaaaccgggtccaaaattatggtccagtcatctaaagacctgtgttaagtatcagggcttagtgaaggatgtcagattagaatgagattatttttctttttctagtcctcaccaacctctcagtacttaaaaactgagtactattcaatttttaaatttaaggtatggaatagataatatacgcatatgacacacaattcaaaagaaacaagaaatgtatataataaaaagtaagtatctttcctcctcatcccctgtcccctacattattattagctttttgtatgttctttcaggattattccatgaatttttcatacacatgccagcactgtgtttccacttgccttgtcattttcccttctaatttaataatatatcttggggaaagtttgacatcagaatatataggaaggctttattatttttaaaaactgcatagtattctgctttttgattgatttatgtatctaattccctaaagtttgacaattaggttgctagtatataatgttgcaatgaaaacccttgttatacatgtacatagtataaatgacagtatacacatatatacatatgcaagtatgaatacactgaaatgaaattgtggtcaaaatctaggtgcattagtcttaatcgatatttccaaattgattaaaaatgtgtgcttccatcagcaaattttgagggtatgcatactgatagagtatattatcaattacttttttctctacaatgtaacatttttaagtctctattttccatttttatcaggcttattaataagtgttagattaagctagttttggtctaagagacacttgagtgtgtgtatttctgcctattcacattcttagaccatgtttctcttgcactgtactttttcttataatatgctgtgcttttcttttgttgaaaacattatctctttttcttggatataagctgtaaatattttatatattcttttccagtttgacatttgcctttaatgtaattcaggattttccctagacatattttgcattattattactacttaatgtattcaaacatactagttatttatggcttcagagtttcccgtcatccttaaaaaggcttccctatcctgtgattttttttaaaaaaaaatcatgttttcctctagtattttcattccttttttatgtttaactctagatctcttccaaacagacaaacacacccacacacctacccattcccctacacacacactttttcttttttaaaaaattcaaatgatatgttgcccccgccatcccctaaatatggctttattagacaactggtcctggtatttaactgctcacaattaaaaggactagagatgggatctcactttattttccaggctccagtctggagtgcagtggcacaatcatagctctctatcacctcgaattcctggactcaggagatcctgcctcagcctcctagtttttgattttttttttttaatagatattgtcaggccaggcacatggctcacgcctataatcccatctgagcacttctgggaggccgaggtgggcagatcacctgaggtagagaattcaagactagcctgaccaacatggagaaaccccgtctctattaaaaatacaaaattatctgggcgtggtggtacatgcctgtaatcccagctactcgggacgctgaggcaggagaatcacttgcacccgggaggcagaggttgcggtgcgccgagatcgcaccattgcactccagcctgggcaacaaaagtgaaactccatctcaaaaaaaaaaaaaaaaaaaaaaaaaaaaaagagagattgtcagacatcgatctatctcattactcaaacaaaaaagcaagttaattcttgtgtacaattcattaaatattgtataacccacgttatagtggctgtagcaggaagttactacattcaaggttaaactttttataggtgttttactatgattaaaaatatgattttctagatatttagcttgcaatgttttaaaatgttttccagactaaatctccaactgtggagatttgtggagagctctatgggacaggattctggatgctctatcacctgttcatctgcatgctacagccaatccaatgctactttttcatgttcatcatattatactaaaaaattgtaaaccgactcaaaagtaaaaaaatggtttagtaaggccatatatacttatcacacagcttcaacaaatgataatttgccatttatagttcccctatcctccctctcacctttaaataatttatttttattttattggtcttaaattcaagacatatcatattctctgtaaatacttcagtatgaatctctaacaaacacattttttaaaaccaccataatccatttttaaaccttgtaatataaacaaaataatataatatataaggtatatatgatataataaaatatataattaatatattatatatggtatataatatataataaaatatataattaatataatataaaattaacaagctgtgttcaattaatataatataaaataaaatataattaaatatgctatgaaataataatttaatgtaatatgaaataaccaatatagtttaatataaccaagttgtgttcctctattgtctcaaaatatctttttaagtatttttttttcaattagaatctggacaaggtctatccattgcataaggatgacatgaccattaagtatcttaattaatctataaaattcacccctctccccccatcccatgtcagctattaggtgatttgccttatagattttcatacattatgtattttagtgattatattttgatgccaattaatacatttctctatccaggtattttccagaatttgtaattcattctagaggcttaattgtgtttatttccatttttaaaatgtatttgataacagagcatgaataaatcatggatagcactgttagtgcttagtgcttatcaagaggcacgtagaggtatatactgtctggttgcaccattcttaggttaggacttatcagagaatctaggtattgtcatactgatccatccatttttaatttcctcaacatatttcaactaatgattttagcagtcattgatgatcacggcataaatccattattttttaggtgttgtaaaatgctgatttttgaattctgtaatttcttcagtatgtattaattgaaattcatctgtaaagaagacactttcggctaggcacagtgactcatgcctgtaatcccagcactttgggagaccgaggtgagccgatcacctgaggtcggaagctcgagaccaacctggccaacatggtgaaactccatctctactaaaaatacaaaaattagtcgggtgtggcggcgcgcctgttgtcccagctactcgggaggctgaggcacaagaatcgcttgaacccgggaggcggaggttgcagagccaagatcgcaccactgaactccagcctgggctgcagagctccgtctcgggaaaaaaaaaaaaaaaaagacactttcttcaacaattatttggataccttgaaatgatgtttgtatagaaaagtcaggaaaatgctagactctttattatcatttttctgaaaaacgaatatatgcataagcattctaaatgtggccattcattctttttgttgttgttgttgttttcatgggctggtgttattatatactaatagatactgatatatttgacattaatgcagtcacttgaggttcatgcaactttccatggaataatactaaataaatagttgacctgaagagctagaaattcccacttaaatgttcatggacagatgtttacaaaaattcaaacagggtagggtgtggtggctcacgcctgtaatcccagcactttgggaggctgaggcagacagttcacgaggtcaggagattgagaccatcctggctaacacggtgaaaccccgtctctattaaaaataaacacacacacacacacacacacaaattagccgggtgtggcggcaggcgccggtagtcccagctattcgggaggctgaggcaggagaatggagtgaaccagggaggtggagcttcagtgagccgagatagggccactgcactccagcctgggtgacagagcaagaatgtgtctcaaaaaaaaaaacaaaaaacaaaaaacaaaaaacaggtaatcagttctatacaacctgtcatctttttaaaaatgtaaaatacatgtgaatattaagaatggactagctgggtgtggtggcttgtgcctgtaatcccagctactcaggaggctaaggttaggaggattgcttgagcccaggagttgaggctgcaatgagctatgatcatgccaccgcactccagcctgagcgacagagaaaagatcctgtctttaataaataaataaataacatacattttttaaatggaaaggcagtgaaaatgtctattgttcaaatgtacactccaaaaatctctttagtgatgaagtcatcacatatcaaaggtctttgttacattattatgcttatggctattaattttgggcaaatattgaatgcttattttaaatgtatagattgtggtaacagagaaaggaaggagaagtgagggttagggaaagaaatagaaagcaaaagagaggaaaacatattgagggaaagggcaataagttggtagatgagggcaaaagttcacaaagaatgaatggaatttcaatcagtcctctaccttcaagaaaagtaaattaaaatgagatttggaaagggatagcatgaatactggtatgctcttctgagaagatgcttcactcaactctattttttgctatttaatgcaataaaatttaaaattttaatatttggtgatacggtacactttgtgtgtgttttgcatgtcacctagaacataaccttatacatatgtatacttcatgcatctacagtgcagttaggaagaaacattacatgaataccattttgttacatttgatgcaagttacaaaagcaaccaggtaaactgtaaataaaattccaaagagagaaacaattatgcattctgccataaatttaaatctttttgatgctcggtgcttgtcattgtcaaattctcaaaccccattttcaggagactatacttttgtttttgctttgtcttttaagaaatgatgataatcctgtagtgctatttttaaaaaataataacaaaaattaaccaccagctttcctttctatagtcgttttaataaataaacagcaagacagtggaaaagtcctggagttagttacattggctgtgcttttgatgggtgacgataataaaatctgaacaagtcaagtaagatcatttcaatctacaaagctggaaagtatgcaaatcctaaaaaggggacaaagtgtataaacgtgtgaagacatagagcagtagagtggaagcagcttgaagtcagcactttggtagcctctgtccccaacaatctaggtggccttggtcttgtcacttaatttttctagccttagtctgcatattcatgaaatgcaaaggaacaaataaggtaaaataaaagtttcatcaaaattttgtttttctaataaaatataagaagaagcacccatcccaaataacttaaaagagactatcctcagagagggcagttatgattaattaagtagaatttggaatagagacatgcaaagtcagcttaatgaagccaaattgttaacacatctctgggacttgagtgtaatgtgactgaatgtattaatattaatatggctaaagaaagaatgtgtcaatcaaaacagtaattggtcagccctgagaatggaaaaacaaacttgtgggtggacagcttggcaagtagtacctatttgagaactgtgtgagagagaaactctttgccattggactcaagcccatggtttcctactccatagtaggtaagatggccttcaggtaccccagccgaaagtttttgcttgtcaacctgatactatttggtttcttggttgacttgcatgcattctcattatttctcaaacataatgagaaatgtccccaacctgatttttggatcatttgtacatgtgtcagcctttatgagtctggaaaatgcaaacccatctctaatctactccattatactaacaaaaccatatttatgaacttgtaaaatgaatattagaacctggagtggccttattttaccaaggttaatgctctcctgtggtaagaaactgcctaagaagcaagccagcattacccagatgatatatctttgactgtctgcctgtacctaggcagctactgacttagcttatcggtatgtctaatagtatattaaatatagtttttagtttaatccatgaacataccaaatctctacagaggtggactagaatgcttagcaatgttcagactgctaaacataatgttacagagtgccatcacaatattggaacatttaccaactctattaactaacatattggccaagtcaatatgttgctctccagagaggggatccaaagatatattagagaagtttatacttcatagaatgtatgacttacggatcacccatgcatcctatttcatgcatccaaattctctctgcctctaaaggaattaaatttacccttgggctttctgttttgtgccagagacaatgttccctcaaagccttctagcaaaattaactatggctagttgtcagtatgaagttgaatgttttagcatacactttttgtaactctgttttattttctactaaattgattttttttccttttctaacaaaaaaagctttcatcatctctgtattattaagacacaggattataactttttagtttggtgtaagcaataaatcataagcagtaaatttagagatattgtctaaaaatttattactttgtgaatatgttccaatgacttgagatcccaatgtttcaccattacatctgtactttaaactgtgtgctgttgtcaaaagtaatgtagagggtttaaagctagaattttctctgactgaagggctttaatagcttcatattattgagtcccatttcccaagtgtctttaagtccaagctgggtagtaaaataagaagacaaattaagtcttctaagccatcaagggagcatttaatacattcctacaggcattgaggtatatggcttccaacagtacctcacggacataagtaaatcggaagatttccttattaaatgcttaattcttagaggtaaatagcagaagcacaggcaaatacaattcagtattttccaaaagcagcataattaattaaaatactaaattaaccaaattcacaggactagaaagtggagacattagattttaaaaccatgccatttgactgaaaagtaataatgcctgtcatattcactcattaaataaatatttgagacctactacgtgtgaagcttttatgtttagggtcctatattgtgtgtctgtgtgtgtgtgtgtgtttgcattgtgtgtgtgatatatatataacttttaattctttttaatttttatggatacctaatacttttacgtatttgtggagtacatgtgatgttttgatacaagcatacagtatgtaataatcaaagctgagtaattggaagtaacaatcacctcatttatcatttatttaagttaggaacattcccaatctacggtttgaattgttttgaaatgtagaaaaatttattgtgaacaatagtcaccctattgtgctaccaaacattagatcttattccttctatcaaactgtatgttttacacactaaccaaaccctctttatcccaccttccctattccccttcccaccctctggtaacctccattctattcactgcttccatgagattagtttatttgtagctcttacatgttagtgagaacatgtaacatctgtctttctgtgcctgttttatttcacttagcataatgccctccagttccatccatggtgtagcaaatgatgtgacttcattcttttttgtgtggtggaataacattccattgtgtgtttatacactacatgtccattatccattcatccaccggaggacatttcggttgattctgtatcttggctattgtgaatggtgctgcaatagatcccatatattttaccctccagagcaggacactttttgaaatagagagagaatgctattgaaaagtatagtggaacaacagccacaaaccaggactatctcaggcatatcattatatatatatatatatatatacatatatatatgtatatatatatatactttactatgatagaaaatgagaatgcaacatgaagtccctgttctctaagaatttgtagttcactgaaagacagaaaatttgaaaataatttgattattctcttttataattctacgataatcattattatccagagttttaagtctttccttgtgtgactttatttgatcattaaataactgtactatatacttactgtaactattcttatgttacacaagaggaaaacaagtaaaagagaggttaaataaattaactaaattcacagggctagaaagtggagacagtagaatttaaaaccatgctgtttgactccaaagcctataatctcattcactcccccaaacagcgtcctgtgatatatgccaagccttttaaaccaaccaaagcttttgggaagaggtgacaaataaggtgtttacttagttagcaaagaggaaggggtgggaacaagtagaagggaccacaaatatagtcagtaggaaaagcactgtcgcttccttcaatattaatgatgcataccagtcatatttatcatgttccacttattaatattttatcaacaaatagttgaaaaatatgaattatatatttatggtgtacaatgtgatgttttgatatatgtatacattgtaaagtggttaaatcaagttaattactatatccatagcttcacatagttttcatataagatctacctccttagcaattttcaagtatacaacatattattattaactatagtcacaatgctgtacaatagaccctttaaaggtagccttagaatttgttcagtaaaagtatggattatctaatttcaatgaataaataatatatgttacaggttgattatgtgcccctaaagcatacactgaagtcctaattcctagtacctcacaacgtgatgttactcggaaataaggtgttgcaggtataactagttgagatgaggatactggaatagagtgagcccttaatccaatccaccagtgtcgttacaagaagaggaaaaccccatgtgaagacaagcatgtgataacagaggcagagattggagtgatgaagctgaaagccatgggacacctaggattgccagctacccccagaagctgggaagaggcaaggaaggattctacccagaatctcagagggatgatggccctcctgacaccgtaatttcagaattctagcctccaaacggagagggaatacattcctgttttaagcactttctttgtgatactttcttatggaagcccaagggaagtaatacaaggcactatcacacaattcaggcacttgcccaattttggaatttgagaaccatttagactccacggatgttagcagatataaaatttacatatctcatgaaatatgtttacattcattctgtgcagtagcagacatcatgcttttgtgctatttcagaaaattcttttcaaaatgacctgtaagtttgactgactacagtacatcttcctgaagacatcacaaagagttattcaaaatggagagttgttctgattatgtatcgtatcaacacaaaaaattcacgtcaatttgataccatattgcagacccagatgcacaaaagttaatttttaaaaatacagaatttctatgaaatccaccagtgaaggcactaattaaccaaggatcatgttctgctcaagcttatccagcatcatttaatgatttctgccaaaggcgagtaagtaaacaagaaggggccaggttgtagaagataatgttttctcatgtaccacaagaagcagaaaaaggaagaaatcaatgtttgctgatggaaaaggataaaactgccaggaaaataaatgttatttttagtttttttgttaagaccttggcattaaaaggaagtcaaaataaaagattaacaattccttaaaaaaagaattgattgaatcattcttaataactgttttcttatttttcggttctggaaatacattttataggcactttccttgtgtagtataagttaactttttcagatcacagaaagattgttattccttactgattttgtttgaagcatcttgcagcttttcagaaaatggctgtgatgagcgtaatttagaataaatgtatcatgtttacaaccagcagttgtatagattattaattaccactgacggcatattccttagcatagaagcagataggcagtattttctatatttgtaagttattaaacttaagtctgaaacctcctttaaagtcattttaatgagtgtttcattagattagagatttgaaaactcaagtaaattaattgtcttaattggcatctttaatgtgctaaccaaaagtgaaaaggataaattgtgttcaataggaccacaagtagattgctactatatttatttcatgctacctttttaaaataataggggtggatataacaaataactcatactttctggacttacacacacacacacacacacacacacacacacacgcacacactctcatacttaaggcatatacataatacagactcatatactagatcaattaatttgattatcatttcatgattaaaaaagtctcttcaggctatgctgaagttggttaatctgaggaacaaaaacatattgtgaaatatctaccatttggtgatcttcctacttaaataatacatttctgaactatgtcaataagagtcttcaaataataaaaatacaaaatccaattcatcgatgttcatgtaactgttcagaatttccacattaaaaaaattacaactgttttccttaaaatgatatatttataactatgagcaatgcaatcaatagattttcaattctatgttgacagatggtatttctttcttcttgaaacgccctgataatcttcaaatacttatttcatatcaactcttgtagtaaaacaatggttctgaccttatccttctacctatataatatttttcattaaaatacatagatttcacagagagacatctaatttcaaattttcaactaagttgtatatctaattattttgattctgagttttcagatccattttctgagctcccacatgatccaattttgaccatcagaaaatgtgagtggcaaagttgttaggaccaaacaaatccttactttgcatttatatcataaatctctatcacacaaaattccttgtgcatgaacttgcaaacgtaaaatgcttagatttagttcaagtaaaagacattttttttaagagatgagaagaacaaacaaggaaaatatagccctatactgctatgctctgaatatgtgtccctccccagaattcattcatattttggaatcctaatccccagtaggatggtattagtagacggggcctatgggaggtgattaggtcacaagggtagagacctcatgaatgggattagtacccttaaaaaggagaccctagagagcttgtgcaccctttctgccatatgagattaaaataaaaaggagaacaagtatgagaaagcaagccctcatcatacatggaatctgcaggtgccttaatcttggatttctcagcccccaggactgtgaaaaataaatttctattgtttataagccacccagtttatgttattttgttatagcagtccagacagacttagaaatatattcatgctaattatgttacataaaggtcttaagaaataaaaacaaaatttcactaaacattataccctggctaatgacttatggcttttctttacaagtctataagaaaataaaagtacaataattctgaatcacagttaagcaacacaggtcagcagcaaagaagaagatactagggtcacatgtatggatacactcctcattgagcttgaaaattctataaaaaggagtttattttgggaaataatcccagggaaaccatgtagaggatttagaacagtgacacaaagaatgaaaaaaaaaaaacacaatataagaaagtgtgattcctctggtcattgcttagagtaacagactccattctactgtgaatctctgagaagacatgtagaatgtgcccagaactccctgaccaagggacaacaaagggagcatgtatcaactaaaacctacttttaattaaccaaacagaggcttttcaaacagcaattagtacttcgctgcagaaagcttagtcttgctccaaaatctaaagttctgtgctgtgattctcttctcaaacttactgaagaatctacacagcatctttatccaacatcaaagcagctagattgtattgcctgagcagtaaggcgattttcactgaaagctggacttgctgctgaacactttcttgctcttagccctactcgaaactgccagccttcaaaattaactgataaaatgacttggagaaatattttaaatgtagtatgtgcagcccatagaatccaaaggtctatcttattctgcaccccattcttagtgataggacttgtgaagagcaacaacttttaccaccttccgttatgcacacatcttactatggcatccacactactcgctgcttcctgttcactaggtaaaaaatgccatgatgtaatcaatgcaatggaccagtacagatgctccttaacttataatggggttatctcctgataaccccaacgcaacttgaaaatatcgtgagttgaaaatgcacttaatacatctaacctaccaaatgtcatagtgtagcctagcctatcttaaacatgcttagaacacttacattagcccacagttaggcaaaatcatctggatacacagtacgctgtagattatcagcattacgtggctgtctgagagctgaagctcgctgccactgcacctcatcacaagggaatatcgtactgcacatcactagcctgggaaacagtcaaatttcaaaattcaaagtaagatttctgctgaatgcttatgacttttgcaccattgtaaagttgaacaatcatgttaggagaccatcgtgtaatcatctctaggttaccaagacaatcaagttccttgtgcactgtaatattacagagagtgagcgttagccctgatctagggcagatatgtacatgtggattactgtctatcccacataagagcaaacttctaaattctctttcatgataagaattaaaaagcatgcatttgttagattactagctgcataccagctagtgccaggggtgtgattttgttccagtgaagataccacatctgatccagcagctgcgctgatttggttgtttaccataagctattatatatcataatccgcctgactttttagttgctttacatgtgaaatgaatagatgcatgatggagactatgactccttcactcttaaagctttgacggtagcatatagcctctgaagtttctcctgagaagcagtgttactgatgatttcatacatcggtttgggaagaacagttttataggattccactaggtcttttctactaaaatgattctgacttatttcacaggtcatataaccagtgtgaggatcctgcttgttgctaagtatgttggtcccaattatgtacttgggagtctggggaaataaccgtagatcaatccacttacccaggctagaactccatttatcgcttgtctttcataagcccccattagcattagaagtccattgatgtcagtgctagctcaggatctgtacctttaagagccctcaaaaggctttgctagttcactttttccagtgtaagctgctatgtaaaatggccataaatcctttgaaggaaggattgagacagcatttttgtgtaactttcagggatattgctaggtctttctttaagaaaacttggtttccctttcaaccagtaagagttggctccatgaagtagtttaaatttggaaactggatgaatgattgtgatcttccattatagcggaaaatgcctacttcctcaaggtgtcatttttgtctttttagataagtcaagtaccactctagtcagctacccttgtatttcatccctaaaaacactatgatatattatccattgtcataaacccttgttgataaacgaattctggttgctattctgaccttgttgctcttcacactattgatatctatattgagtctgttggtgaagtgttactactaaacttctgccatttctgaaaatggcagtcagaccattgagtttagagatccttgttctatggtagcatctcctactacaccctgggatacagaggacagtcaccctgagcttctcagagatgccagtgtccatctgactactgcatttctcacagtgaatgccttgggaaccctctaaaaatgagtctcatataataaatatgtgctaacattcccacctccctgagtcttctaagttttaatattctgtgaagatagctcctatatctctagctctcttactataagtcctcatgatgtttaaatttcaaagaactatcataacggcatattaggactagctccaggtattcttactcataattaacccaagtcatggaagagtactttattcttaaattagtcctagcccagtatcgtcacactctagacccacattacctctactcaaagtccaggagccaaatccaggcatagagaagagacaaatttcaatgggacaggcaagaatactccacctactttgttgagttaaatgtaagtatatagtgataagagtaatagcttataattattaagtttgtaaataaattattatttagtatcaacgactcaatcacaaatacgattatcatttactaagcatttatgttgtgcttggcactctgttaaatgatctaatattttttgagatagtatctggaatgaatgagatgttttagattgttcataaaattaaacaaaagatgaattctgagagaatagtagataggtaaatatgatgaacaaaaataacttttcttgagaattttaataaaatttctaaaaatctttggttgatgctgatacactgagagtaaaaagtattagcaatttaggagtatgttaaagtgttgaccccaaaaagcctttcttattctatataaaaatcaatggaaacaaaactatttgaagactataaggaagactgtaagtgtttcctcctaaacaagctatgctaatacatttattcatgtaaccatgaacttaataaagatgtacatcacctggagatgggactaagtacatgaggtagaggcagggattgtgaaagcagccattgatatggcaatctttttttttttttttttttttttgagacaggcttttgctctttcgcccaggcaagatcagggctcagtgcagccttgacctccccaggctcaagcaatcctcccacctcagcatcccgactagctggaactacaggcaaatgtcaccacacctggctaatttttttatttctttgtaaaaacaaggtttcgtcatgttgcccaggctggtctcgaactcctgagctcaagcaatctgctgacctcgggcctcccaaagtcctgggattacatgagtgagccactgcacccagctgatgtggaatttttttaaaaataaatgtttggatgcttatcctaaacattttccacatcttatccaaagattatttgaaaaagtattagttattttagttggaaactctctaacatgatatagcagacagattcagtctagatatgtttatcacagacgaaaaaaagcaaattatattaattttataaaacacaaaaaagaattaatataatatttgattatagtagaacctaaacctgcccacattaattggagataaatccaaaaatctagtatgtttcttattcaagtgcatgcactctcattttgtaaaaaatttaatagactaaatcagaaaaaagtataggaatatgaatcaagatatataaaatatctgcaaagaacaatacatgtagcactaatggtttcaaactgaagaactggctactaatgtttgctaagatttttatcatggtaagattaccatttgagaatctgcatagaagattaacaaggacaaaagcatcaataactctgcaacagccttggtagttaaaaatgcatttatacaacaatcaaatgactgaatacaattctattataaaattgaaaaatggcctagccaaatttttttatgcaaaaagcaaatgctcactaaggttaaggtgtaataaactactagacaattttaatgcttcctagtgttttggatttacataattatttttaaagagtggctttcaaaaatattttagtgatgaaaaatattattcaaatgaaatcttacccagaaagccagcatataaaaagaagaaaagcagagctgctttgattgatgcacattctttctttgttttatttttgaacggagaaggtcagtatcttccaaccttgcaaacaggcatacctatgtttattattaaaagaaattcaaagacccacacattatactggttacaattaaattgtattgctatctgagaagtctgaaatattaagagttcaaatgttcagtattcctactgagaacttccttttaaaaaccggtcatactttctacatatgacctcattgcaagaataaagcaatgtaactaaaatctcaacatttatttgggtggagaacatgaaaatcatattttctaattcatagggtagataaaaaatgtttgaggtcaactgaggaaatattttaaaacaactataaaggaatgacctgctcatttatatatcaaaatgtattataggccgggcgcagtggctcacaactgtaatcctagcactttgggaggctgaggtgggcgaatcacccgaggtcaggagtttgagaccagcctggcctacatggggaaactgggtctttattaaaaatacaaaaattattagggggtagtggtacgtgcctgtaatcccagctactcagtagactgaggtgggagaatcacttgaacccaagaggcggaggttgcagttagccgagattgtgccacttgcactcaagcctggacgacagagtgagactctgtctaaaaatatacatatatagatagatgataagatagatagatagatagatagatagatagatagatagatagatagatatagtaaagctgtagaagttaaaatggaattggtacagaaaagaataacagtaaggtgcagactaatgtaattttgctaatgctaaaaatatcattttgaagctgtgcagtggaatattgaccatcttgtttgtataagggcaagagggaaagagagagaagaaaaagacaaagagaacactagactaacacttcatactaaggacaaaatgatttcctgatgattaaattgtcaaatacataaatgactttaagctgttagaaaaaaaaatggatataaggagatcttgctaaagtagctacaaaactcagaagccaaaaacaattcatcttttaaaaacaaaaacttgagaacaaaagtatcttaaacaatcttaaaacacaagtaacacactgggaggtgcaattggcaacatgtttatcagcaattgaatttatttacgtagtatatttgtcgtcacaagtctacaagaagataagcagcaaactagtaagaaaagagaagataaacagcaaccagtaaatagagatgtacaagtgactgataaacatgtgggaaaatgttcaaattggctagtgatttaaaatgcaaatttaaactacaatagagtgtaatttactttcttgaatcaaattgacaaaaataaaaaaaatacactgccgttgagaaagcaagtaacaggtccctttcaactttggctaaataattccattttgaggaaggaaactatgctacagcaatgctaccatacatttcacaaagatgtacatacaggcaacacaaacatataccctacaagtattcattggattgtttataacagtgaccatctgtaagtaatttcatgatgaaggacacagcagcaattatacacatttgagagtactcacagcaaaactcagtgcacccatacaaagaactattcagcctgagtgaagacaatgatccaggccactggttcaaactttagtggacatcagattcacttggagggcttgctaaaacatgaattgctggccccaatgcaggggtttctaatgtgaagggatctgagaatcttcatttttaatcaattatctccagaaaccacatattaagaactaccagccttgacccatacttggtgttttggacacatggccaagtgaaaaattctagtcatagaataatacttttcattatctcacttattaaaaatggaacatgaacataaataattacatttaaggaaatgcaacgaacgagaactgaaaggtgatatgccaaactatttaatatctactgctgggaaggagggcaggtaggagtgagaagagaaacatttatgttaaatatcctactgtttaagtcatttacaagaagactatatttataatgtatttaaattattgacgtgacaattttgagagagaaagaagaaagaggaagggaggggaggagaggggagtggaggggagtgaagggaagggaaggggagtggaggggagtgaagggaaggggagtggaggggtgtgaagggaagggaagggaagggaaggggcagggaggttaggaggggggcagggaaggaaagaaaaagggtagctgaatcctgaagctgtagacatctagagtttgtactagattgttagatttactggcaaacccttactttctttctttcttacttcttcatgcatctttgtaataaaccctcattaaacgaggtagtctgaacatagttctattccttgcaagctaaaaaggctaattaacagagatgtaaaggctatgcagagcaataaaacacaacaaatactgaaattgatttaaatgcatgtaatttaaagcaggatataggaatgctaaaaccatttttaaaatctacttattttcatacctacacatccaaatctagatcttagagctgatggtcctaaattactgaaaaataataaagccaacatatgtttctattacatgctgacataatgcttatgtaccaagaatgtatagttgtatttgtatgtgtgtgtttgtatatatatgaatatgtgtatatatacacacacagaatatatgtgtgtatatatatccataatataaatttaactctcaaaaggattctatgatataagatagttattatcatccctaatatataaaaaagaaaactgaggcacagaaagctgggagattacggaacttttccaaggtcacactgttagtcctggtggagccagggttacatccagacaatctgattccagcatcatgctcttaaccattgcatcgtactgacctctccttcacttgtttcattttctttggatacatcaatactctcaggccactacccatcactaaacaatataccataaaaaaaattaaagaggctagaaaaaatgctgtttacaatacttttggaaataaacaatctttatgactcttactgctacaagaataggcagcagattaagaaatctgctgatgagtgaatgaggaacctctctcttccactgcatttccaactattattatactcagattagaccaagcgagaaagtcattccagctttctcatatcagccaagaaaaatcatcctcaggaccagctgccaacagcattgccctttagactttggccgggatgccagggcccaggtgttctgtcagctttccttatacagtttgttgacaatgaagaggcccacttaatttttctttttttttttttttttttgagacagagtctcgttctgtcgcccaggctggagtgcagtggcacgatctcggctcactgcaagctccgcctcccaggttcacgccattctcctgcctcagcctcctgagtagctgggactacaggcacccgcgaccacgtccggctaattttttttgcatttttagtagagacagggtttcaccacgttagccaggatggtctcgatctcctgacctcgtgatccgcccgccttggcctcctaaagtgctgggattacaggcgtgagccaccgcgcccagccgcccagttaatttttcaatgggcaatataagctgaaactgattcacctgcaaacaccttaattacttctaggaataaaaaaatattgataccaaaacaatacatttttcttaggatcaaaacaccttgaaatgtttccaaaaaatggaattgcttaggaaaaaaataaaaatgcatgatctactttgtttcagaacctaatctggtttgtctagaggtcaaagtttgtactcctgattgtgaatgataaaaagggaaaatgtatggataaaatgggaaatttctaatattaaggggacaggaggatggagagagaggcagcagagcaacacctggggtatgttagaaacagagataagaagttgcattttaaaatataatttggagttcagaaggtgtaaatttagtacactctttgtgggactaatgggaacctcaatgagtcttctcttgccataaactgcctctcataaagctcttcaaggcttcttttggatgtgtttagaccctcctgtttagatcccaacttttgattctgaaatttctattccatgtctacaaaacaaaaaatataatcaaattataacaacactatattttccttgagttaatattatcttgaattaagtctatcattgtttaaatttttggtaacattattttcactggacttcattgttttctgtataaattttaaaatgaaaatgtttcacatatccatttccttgtttcaatttttaacaattatcagtcatcagtctgtccttgtatgttgtcttttggaatcttttttttctatcaagcgtaattatcctggctcaaattgtgtttctctaaatttcattatgacaattttattctttaatccattttcagttaatagcaaatgttatactttgaaattttagttatcgtgagttttcctttttcaacatttttaataattattctttcagattacttttgttctttttcattttaccaacagcatgagttttattaaacatattttaccatttctgttttagccatagtcttatctatttaatgcttcattctgtgatgctttatatgcctatttttatcatttcagagtcaaaatggtaaataaaaagatacttaaggatccgtcagtaagagttaagaatggcagaagttaaaaacagggttaaaatggtgagttcataaaatctccacattacttttcgcttttccctctgtagctttgttagctggatttcttttttcctgtaacacaaatacttaaaatatgtaattttgtctactgagtgaaactatttttcctaccatagtgcttgtgttgattacaaatgtgaattttgagctagtaaggtcattgacaataagaattatcaattattgagtaaaacatcctcaatattctgcatctaaattagattgttgcatcatatatatataacctaaacatattatcttctatataactgtttcttttgttcctacaaattttttattcttttttttttggctgttgtttgtttgagaaagggtctctctctgttgcccagactggagtgtggtggtacaatcatgacaacctgcagccttgacctcctgggcttaagtgatcctcccacgtcagcctccagagtagctgagactacgggtgtgcaacaccaggcccagataattttttaatttttttttttttttgtagagacacagtctccttttgttgcccaggctggtcgccaacttctggcctcaaatgatccccttgcctcagcctcacaaagtgctgaggttgtaagcgtgagccaccacacctgggctttgcctttgcatattgtaattttagtgccctttaaaagtctccatttttattgcttctattaaattagtttaagaaagctgtggatgacgattctgaaggcctgagtgcatacagtatctgcaactgtttgtttttcaaggttttctatgaataaaatgacaaggagtaagaaaagtatgtgtgacctcatgcttcacattcttcagaacaaatacctctcggttgcaattatgtcatcatgaaatcatgttccacgttttaaaataaactcattgccatatgaattgttatcctactgagatatttttgtagttgtctgtttaacagcttccttagaagtgtcttctacatttcccacaataccaaaacaaaaatttcttttttcatcttatacaaaagaatagctcaagtttgaatgttccgaaatccacactcttgtcctgcgttgcacatatacttgcacttgagttacacacacacacacccacacccacccacacacacacacacacacacacacagttttagctaaatattctaaaatatacactttttgacttctgagaaaagtcagagaatgttttctccagtgtcacagttcgggactcacctgtggacgtggatgtcctgtgactagacaagtcaactcaagggtttctccttcccggatagtgtagaccctttcggagtagcgctcctcttcaatgttacaggccaagcctgagtgcacaatacgaaccgtgggaggagctgtcgagtcaggaagaagagagacaagatacatgaaaaggtaagtcagtgatcttctcatgaaccatcttgactataaaagcaattcttattagacttcaccatagtcagattagtcagattcatcagtcttaacacctccccaaggcattaaagattttgctggaagaaatcttcaaatttatctaacagtgaccaacacatttccaggggaacaaggtagtggaagaacctcaggaaatcaccatcaatacaagaccacaagataaaatttgattgttaaaatgtgagaaggtcccttcctttctgagttcaaattttaacatagtaaggaatattgcaccaaaaatatgtagtgcaaaagaaagaagacaattggaggagaaaagggaatttgaatggaagacattgacatttgtctgttaattatttaagtcatgtagcgcgcaagttaataagctcacgaataagatgatttggttttcaggaagtgaaaaccaacttaatttaccatacttatagacatctgtattgatgtaaacaaagtatgattcttgattaagccatggaagaagacaatataccattgtcgcctgagtctaaaattctgattcaaaagaaacttcattagcataaagctgcccaaatttctaaatataattttctcctacttcagtgccaaggggccagtaaaatttaactaacactccttgacttacacatcgttggggacaactacatggaaactttctgtgagtcatgagagaagtacttagctaataagatatgctgcttgccatcaagtaaattattgacagctactagcttcaaattggagatcaattccttttgtgaactaagcatttttgtttgtcatacatttgggagtgaaagagaatgatcatttcagttaaaggcaagtggaaaggttatatcttcatgtaaaggacagtgatctcaagaatttcctgatagatatcttcaacctaaacagtagtattactagcagaggttgtgattgcttaaaaattaacgccagtgccagcatattaggaatgttttatctaacattaaagacaatgaatcttatagaattttaaaataaatttggtgattctatggaagaaaaaaagattataaggccaactcatgaaaaaaatcattctgggaaaagctgtgttctgaaagtaaaatagaatagttttcaatatctactattttgttttatataacataaatgcacagtctacccatagagcttaataattgacatcaggttgtatttcattatctttctcaatttcaggcagaaactggaagatggaaaagaccgcttatgattaataaaacaactggttatgtccagctctttctaggtaccaaagcataatcctgttactcaaccttgaaactcagaaccctgctttccaatatccatcatcaaaatgatgggtaaaagtttccaatagtagaataagaacaaaacagtacttctagaaaagtggtcttgacattaaatacgcataataaacacccctcaagaacttgttaaaaatacaaatttcaaaggtgttcagagacctgatatatctgcaggaatccccaggaatctgcatttttaccaaacactcagatagctgcaatgacagagctagttagactaggttctgggtattatattcgttggctaaagaaaaatactccaaggaataaaatatccttttcctttgtctttttaaagtaactaaactttctgctatgcatcattttatctgatttgaaaaattaaatgatgcttaagtcaaatgtccagcttggtctataaaaccaatttattaaaaattttccatcatgtctctggactctgtctagacattgtaataattcgtttggttttatgacattagaaatccttatctttggtgtttctcttagtgctctgatatgtttcacaccacatttcctacaaatcatttcaggcagtgatcaaatttggacttcaatttagataagtaatactagtgaagtacttatttttaggcatctgtctaatatagtcatatccatattatagaggttaacgaattgatgaaaatctataaatgcttgcaaaataaaataaaataaatgttcaatagaaaatacagatctattatcttaaaatatatttccatgctaactttagcttcatatgtgatagtgatagcccacgtttattaatatatctaattatatagtgacatgacatcctttccagactaatttacacttgttatttttgttttaatttcaaatcaatgcttagtattgttatttttaaggtatatctttcaaaaacatcattatgcaaataagtagctttatttaaaccacttaaattatacagtaagcacactgtgacatttacaagggttaattttctgctatttttcttctatattataacacattcttggaaaaggtaattgcctgcatactgcagtcatcatgaacctaccacctatcctgtaggagggtggaatatttcatcaaattttaagtgtggaagttgtcttccttttagtattcatcaaaatatgtgctcaatattttagctgctcaacgataatgagagtattttggaagcttcccttaattcttttatgtgcacaaagctcacttgaaaggaccttagagttcatataggtcagcactcttatttcccgattaggaaagaaaagcctgaggacatcaaatgactttgtcacaatcctgtggctagttgtggctaaacgagaccaaagccactggcctattgttcttttcattacttgatgctgtctatttaaactatgtctgtcatagttaaattagtgttctaaataactcccaaactagacccagacctagactaggctaggggtataaaaaactattgagaaaccattaataaagcagttagagcaccataaactagattaagaatgtaagtagcagaattgctccaaacttaaccaaacttcacaatagaatgttgtcccagttcatcatcctacctccagtacctgccaaatccatgacatttcacaatgatcaaaatagtattttgaaatttctatttacattatgttgtttctctgcttaagaacctacaatatctccctatgacatttcatagagtcctaatcgctgtgcatgggtggcatttaggccctctgtcaagggtcctcatgcttaccatccaactaaaagtcccatttctctgtaatatcaggctatcctcagtgagaatgcaaagaaccctgagattttaagtgtctttgcttataatgttctcccatctaagattcccataccaataattggacccatgttcctgataccttcttggattacttataaatgattatcttctcttttcttccatgaggtatgtatttattgctttgtgattttcctttctctccacattcaaacacgatagtaagcatctcagtgccagactgagcatcatttttggcatcatccccatatcacataattcacagcacagaggaggtatttatttactaattgagttttagtttctattttagcaactatcactataatgacatcaacttcttactttagcaaaatatcaactattatggcagtgcatttgcttactttaaatataaatgcaatttgcagttttatacctgaagcaagacatctctgatcctctgccttgttggtaaaaaacctcaattcatcatccttaaattggactaagggttaagatctcctttgccctgtagagtcagcaatgaattacaatgttaaaatattgcatgagactcatattcatccaaattttcttgaagtaaaccaaatttcattatgtaaaatctttcctaacactaatcatatcaactgtcttaatccgaggacattttggctttgggttgaagaggtcagcctaaaagggcaaaagagagacattcttttatcttgttagaatatacttttgaaagttaaaccaaattcactctggagaaatagtacaaataaattattctacaatggcaacaaccaggggcattttaatcctttcacctcatatatagactttcaagcgtatatttattgagcagctgctatagcaggcatgagactctgtgctggggatatgatgattaatgccatgagctgcacctgctaaaggcttacagcctactgggtttgtctaaattatttaaaattatatgataattgaataggatagacactctaacagaagaaaatgaaaagtactaaacaaagacaaagcagacgatagctaaatctgcctgggggagtctaacaagtttcgcaaagtcagtgacatttaacctaagtttggagagatgctcttgggagcaaaagaggaaggagatttcagagagagaaaacagtgtgctcaaaggcaaatctgaaatatgcctttgtaatatgccagtgtctattgtgtttctgaaataaccatgtaaaaatgtatcccctgtagtttatcatttactccataccttgccactgtacagccttatcagcttgccactatgtctcagacataggagagacactggagaggcctgggaatggataatggaggagagatgcattttagaggtcttgttagaaaggacatgacaattaactgaatctgagggtgagggaaagagttaagatgacactgaagtttataccctgactaggtgaaagatgacaattttttattttaataggagatagtttcttgatcgccatggaactcacattacccaccgttgggggaatcttgagatgaggggccctaagcccaattcattgggggtggagggttgttggcatgagggcttagatgagaaatgtttctgatgaagaaacttttttcagtaatggcgatgcttcctgaaaaacgtgctgctaatcaggcatttatggttttatttatggttttggtacaaggagcttcctctctgctaagagcttcaagtaagagcctggttttttagttaaatctctcaaatccctcacgcagctattctctgggaattcaagttgccactggcatgttgctactcttccacactaggtcaatgtaacttatgttcttggttaaggtaacagatctgtttagttaagtagtgtggagagaaggatgttcactggtccctctcctagaacctctagtgaacagctcagcaaaccatgctgtgccagcattactcatgtactattgatattttgaagacagacagagagatagagagacagagaaagagaaagagggagagagagagagagagagagagagaggcagatagacagatagagacagacagacagcctataccttactgttctcacatggccaagagtcagtatgtattacttataccattctcttagctgtcattctgttttgcttgtaaagcaaacataacaataatcaaactttcttcccagctttctattgatttaagtgatcatacgctttcataaaacacttctcagttttctacaacatgttacatttagctaatcagcattgtcaatgattggtttcttctgtttatctcaaaatgttcaatgtagcacgtgtatagtacttcaaggatatggtggcttccattcttttctttcctatctgagtttctggtttaatatattacatgagatctcccccacctccctttttcacaatgatattctaaactgatttttatatattttttgtgcatacagtcctagtccatattactcctgttgttgacaactccattgcctaacatcttcctcattagcctagttacattacatgttttattatcaaaaaatttgacagggccagctgtggtggcttatgcctgtaatcccaggactttgggagtccgaggcaggcagatcacctgaggtcaggagtttgagaccagcctggctaacatggtgaaacccagtctctactggaaatacaaaaattagccaggtgtggtggtgggtgcctgtagtcctagctacttgggaggctgaagcaggagaattgcttgaacccaggaggcggaggttgcagtgagacaagatccgagatcttgtcactgcactccagcctaggtgacagagagatactctgtgggggggaaaaaaaaaggcaggaaaaaaatatgaagatttgaagaagaaggtggagaattcagttttggatgctgatggtgagttcaccaatagttgacaagttgttgctggacattaagttttagagctttcaatggtagttgatgctacatagaatagaggagagttctataggagagcatgtagagtgagaataagttatgatagaaccatgataaatatgtattcttaactagagaagctaaagaaagagacttagtgcgattataaagtcagagaggtagaaggagaacaaagaaaatgaggtgctttagaagttacataagtagacagccgagcacagtggactgtccaaaaatattacataccatggagttgtcagttaggagcagcacagacaaaaggtcattgcctttgggaattaaggcagcattagtgaattttgactgagcaatggctgcagagaattggagtcaaaagatgaacgatgtgtggtttgactgaggaaaaagatctcagtaggtcaaatcaagcttgaagcaaatagtaaaaccgctatttaggcttactcatatgtaaaaaggagtgataagtgaaaaactgaatatttcaacaatattgtaccagcattttaggactgcaaagaataattactttaatcataagaaacaacaactcatcatgtttgtacttctagcacaactgcaactttttgccactacaatattattttctagtatccttccacattcttaaaaaataaatttctctaaaaggccactttctttcttttcttttttccctctctttctgttagttttttttttttttttttttacaaattcaactctgtcaacttcaggaccacatatgagggaatctctcaaagctgtttaatatcttctgtaaaacaatcaaggctaatcctcacagcatttaaatatgctacagcatataaataagcttagtgtgtcccattaaaaaaaaaaacagagacaaaagagcaacatttatcctcccatcaacaggactcctcttgtctttcctttactgtctagtgattagaaataatgataacacattcacagccatccttggcatgtgctttgccctcctctgtctactacagtctggctctgcctatcatttgtatttctaaaagaacagggcaggaaaatagaagaccactttggtaaatcgctatttctttttttggtcattattgtgatcatttgctctccttcagccttagcttacttgcttttacttctatgcaaagatctttgaaattacatacttgtcctatactataacacaataaagactattcttttatcccactgccatactccctgcacccatgaacataaacacatatccaaacatgcacataagctaaatgttcaacttgtatatctattcaataatttcttcaaaaaatggttaaaatctttctgtaattgtcatttatgtaatcccaaatagaaaaatattctgatacataaacaacatatatattattttaagtcagactgcagatcattttatttgtttgattccattggttattttaaactaactacaatatccacatcaatgtaaacttatttctgcactccctctaccaacctcccaccgccatgtttggttaacattgtattcctgtccactagagataaatatttttttgtccttaatttgatgagttgtaaagtgaaagtagtaagatcctattgatatactggatttaatcaagagaaggttatatctttctcatatgactttagttgaaaggccttgattattaaaggtttttaatattttgtattatttccttagtacatgttgggtagcattgttataaagtaactgaaccactctaagagactttacaaagcccaaagtaaggcaattaaattaaatccagaagcttctggcttcagatggcaattattaacgtttgctaaataataaaagttgacataattttttaggttgatgttaaccaagaatttaaagaaaaaactttaaacatttaatttaagttaaattttaatttaatttgttatttaaagtcaaattacttgtttatgtgcagtatatggtatactattttgaaagacagatgaaagtttgtcatcaaaagagagcaatgacattcaataacaatttaaacttacattaaatgtacattaaattttaatggtaaacaaaaaataaattatgtaatttaaattctaatggtaagacaatgataaaaagcaatcatattttctgtgtaaaaactatcttgtttgacaagtattaactttataaaaaattgaatacaaaattgcaaaatattattctgaattatcttccacaaaacaacaagtgtcctattttttaaaacaaagcaatatcaattctaaaaatgttatttcatgaagatttacacattggcagcttcagatttcatcaggattacctttatttgttttcacctagaagagttccctattagcatctaagcctaaaacttcaaaaacccttgcatgttttagagatgaaaaaaaaagttacactgaatctaaggttcataacattcttttcaaatacagcatttgacaacttctgacaagtatgccagagaagaaccatgggccatcaagtctaggcagtcacgcatagccatcggtcatccatgttccctgtctctacctggctgttcccgccctaagtccctcactatgttcttcccagtagatttgacctgaacctgggagatatttgaaaatccatcaaatatctaactaatctcatgttgctcaaacgacttgtataaactaagtggaataccccaacttgaaggtaaatattgtagggaactaagctttcctcttctttggtatgaatgtaacatcacataatgaatatatatatatatgttcctttttttatattggatcctatgctacatcctgaattgtctcccactaaaggttaaattagatatttaccaaatcagtaaattttagaccaaaaaccccataaatattccagaaatcttggcaactaggtcatagagtataaaacaaacaaacaaacaagaaagctgagataaaaacaatggagcttacctcttgcctttatggtaccactttttataggttttgaaatttgtacaagaatatagtaaaagtgggagagaagctattataacactgcaggaaaggatggcatttaatccttaaaatctttgatcaggtctttccctccaaatcaaacttgtgaaatggcatcctgttaatagtgtcagaagccatatatcatgtgggcaatgaactcttcaaggttctttgaaccaaatcttccttgcctcttataaattatcacagcaccttaagagatcaggactcctaaaggcagaggtactaatgacatcatttttaatctctgtagactgaaatgtatacttaaatccttctctaaaattaagggctcttcagttttcttggaaacatccacaaagccccagcaaatactaaccaaaatgaaattagtcttatcattgtgctccaaccttaagcataaattgggtaattagagagagacgttatttcttccagcctaactcatcaagaaaacaaataaaatttactgtgaaatatgacaacaatgaaaacttcaatttgcttttccaagagtagcaatagtaggcagagaattgtgaggatctggcctgccaatgtccccactgtttctctccattgagaaatcactgccactgcctgtgactagccccatggacaagtttcttagcctgtcaaaaaaaaacatcttggatcccaggagacagagatcagtgagataatggaacataccccaagtctggctcttttctccttctacaaaaggcagaagaacagtttaccacaaggtagaaatgattcagactccactggggcaataccctcatggactgtaaacttagtaaatatcaagcacctgtgtaattcatgttattttttgatgatctatagtcctctctaaaaccctgaagatcatgtgttttttatttccatttgaacaaaattaatatccccagtgaaggtttgtgaattgccaaagcttagttttgatgccaattctgccttatgctagaaacacattttgtgattttttatatatattataatttcattttaccctgctgcattcccatttttaaaagtctagacattcctttgtgtctttggggatttggggagcaagaatagaatacagaaaaagaaatataaataatttatactctgataaaaaagatactcttattaagttaattggtgccatgagaatctaaagtaaaaacatttgtctaaaccatacaatgtgaaacataagcaattattagtacatattacaattcagctcctaatttttaaaatattaggctttgacaatctcatagatttatatataggagctgaattatccaaaatttctgctcaaacaattcaattttcatttatttgaggatggagttctgaaattcgctctgtaagtatgtatctcagtgattcacatatgtggcaatgtggcatggtacttcccaggaaccttcttatatctgccatcttccagattacctgtaacctcaggctcccagggctgagcctcacactctggcctctccacaagcacttttaccattttggcttgccatagagcaagaccctactttcagtggtaaagagaatatacttcattctcctgaataaattaataaacacctcttctaagaagtgtcattaataatgttagagtttgttaataaaataaacaatataggaaatttgcattgtcatgacagtcctttttgttttttaaggcagtggcaccatcacaaatcaccgtaacctgtaaccttctgagctgaaaggatcttcccatctcaacctcctgagcagctaggactacaaggtcatgccaccatgcccagctagtttttagttttttttttgttttgttttgttttttttttttgtagagatagggtatttccatgctgcccaggctggtcttgaactcctagcctcatatgatcctcccacctctgcctcctgaaatgctggaatttcaggcatgagccaccatgcctggcctatcacagaaccttagaatcttaataataatggaaaatcaaatggatgactcacaacacttaaatatacaagatttttaaatttaattatatatatacatatatatatatataaacctattttctctaatacaaactgctaattaatatttccctgccgtttttaaactaatgaagaaatattaatacataaaaagtaactaagcattatttgtagccatactctctcattgttaaatgtaaaattattttgcttagattctcacaccaaaatttgcacaactttaattttaaatgttatcttggaaattattctattttaaccccgaagaagtgatgagatcatgtttttgttagatgtcaaaccaaataagctatttagactttaactaatctaagctgtaaaacacatggatcggtgcctttcaaaatgtactttctttttattttactttttaaaataaggtaaggtctggctctgtcactcaggctggaatggagtgacactaccttggctcactgcagacttaacctcccaggctcaagcaatcctcccgcctcagcctcccaagtagctgaggacacaggcacaagccactatgactggctaatttcttcttcctcttttgttttgttttgttttgttttgtagagatggggtctcattgttattacccaggctggtctcaaacacttgggctcaagcaactctcctgcctctgcctccccatatactgggattataggcatgagccaccatgcccaactcaaaatgtactttcaaaaacaagtggtctatacatgttcaatgttgttctatctaaattattttaaaagaaatttacataattcaataatttgtttttgcctgagatattagtaaatgtaataagtaaaataatgaattggttaccctaaagctggagtaagtgtgaagaaatatatacctccatacttactggatggagtcagtacagttgtggggggaagcagtttgtcaatgttgatccaaatatgaaatatacttaacttttggtccatctctaaaaaaattactgtaagacgacaaattgccaaaagatacatatacaagtatgcccaccataatatttatattgggagaaactgtcaataacagcatatatggaaaaatatacacttgtaactccaaatattacattggcatggaaaaatattgacattatttgatttttaaaaacacagtttgagaagagtgtgaagtgtatagagattgagtaagcactgtggtttttcagcaagagctctaaacttaactgtgtcacactgggcaaatggtttgacctttctgtgcctctgtttctgtatctgtaaagctgattaataatttaaccttccacaaaagattttatgaggatgtgatcattaatgcttaatggaaccatgtcccacccatagtgtgctggccgcaggtgtacaccattaatattttctagtttatgtgtaaacttagtacatacacagatagtatgtacacataagagttctctaaaaagatgttctcaaaatttttttcttaaaacataatttttcaggcacagtggctcacgcctgtaatctcgcacttttggaagctgaggcaggaggataacttaaagccaggagtttgagacaaccctgcacaatatagcaggaccttatctcgacaaaagaaaaataaattagctgggcttggtggcatgagcctgtatccctagctacttgtgaggcttaggtgggagggtcccttgagtccaggaggtcgaggcagcagtgagctataattgcaccattacactccaacttgggtgacagcaagattctgtctcaaaaaaaaaagtgataacagagataatcatacaagagggaaaagatatgaacaagtataatcattaaagtggttttattttttaaatgattggtaaaattataaatatcaagccataaagcattggattaataaagtgtgaaaaatccataaatagattacaatatgaccaatacaaaaatggtatagtttattgacatgacgagaaatccataatatattgctaagaataatgtgcatagtatgaccccattaatgtactattgcatattgtgtacctagagacttgtctagagggacgttaactagaatgttaacaatgatgatgcttggaaaagttaattttctgatatctttgctttttgcttaatatggtactgtatttttcaatttttttgtacaatgagcacattttttcccccagagctaatataatgattctgtagtttatttctaagtttatttctaagctaagctctatctccctgactataatactttttctacttctactttacagttaccctggttctcttaatccagatggataaaggaaacacttatctatctggatccactatatttttctctgtgaacttccagacattttttattgacttagaatcttctgacttgtcttaaattttgtttctggccttcagaaagctcaccctcttctttgccctaccaagtctgcctgaagcaaaaccaacacctctatttataacttctaaaaagtttgcctttttcacttattgtgttactgtaagtgactttcttggcagggtctcagtaggcatcacgtggtataaatcttgggtcatcattggagcataacaagtatttgtcattttccaagatgccagtgtagatttttgcttttcctcctcccacattccttaatgaaactcaacagcttcttgcactcttccaatctcatttgaattcttttcaattcatttgtgtagcaaataagacaatacataaaaatccaaggaatgaccaagctcattaaggtttaggtcaccgtctctgtcaacttggcaaggccacttttagtggcccactgtcctaaggatttatctcccaaataccaacattacaattttacaatatcaacataatttagagcagtaactaaaacagtcaaaatttaaagcaaagaaaaaaaagcaatgttattctttcaataataattttctgccacaagtttttttttttcacatctgcctaatggtattggcaaaaaaacaaaacaaaacaaaacaaaaaacaaacaaaaaaaactttcctctagttataaagtctccaatgataaaagagttaaatcttcccaatgttgctaatttattgtgatgtgtgtgaagttggatttgctgagttggaaatgctagcataatctaaggtaatctccttttcctcatttatataatggggatgatatggctttctacctcatactgttgtagcactcatgttatataattcatatctaggacttaccatactttctggctcatggcattaaccattcaaatttttagtttttgttgagagtctgaaatctccatgtatggagcaaacatgtgaaaagtaatattattgctcattactaaaaaacattacattttcttctcaataatttctacaaaatccaaagaaaccaaaaataagtacatttgtaaaaataaaccgcaactttatgtatattgcccatgtaaagaaatgatcaaaattgtcaacaaatctaaagttctctttttgaggtcagttcatcaaataaatgaaggaaaattattgctgaaaatttcaactgaaactgggcttttcaaaaataaacatggaaaataacttgtttaattaagtactatttcatttacttaatatcacaaacaacttaaatatataaaaataaggaaatatctaataactaactagcaggcttatcaagagagaagcaattctggtaggcttctgtctaatcaatcactagaatcagcatttttagaaataacattttaatatttagaatgcaaagtatgtatttgattccctattataatctcaaaaggagccaaatatttgtagaaaattaaaagaaatatccaaacaagctattataaaatggcattttccatactgaaatttcaatacctaaaatgaatagtcaaaaagtgacataaaccagaaatgtcattatgcagatgaagcctctattttaattaatggttgagaatgagagaactgagggtctaattccagagctattttgacatatatcaaacttcccttaatttacactgaaaggcctttttgacaagttctcatgtcgataagctcctattagctaccagtaccttaaagtggtgttttgtcactgacctacattagtatatcaaactatgacagcaaattaatggttacacatgatcctaattcagattacagtctctagccaaacatttagaagagcacctcagtaacaatgaaatacaaatatttctgcgcctacattactcatttgataagtgacactaaagaaaagataaatacaataataaatagctgtacaggtactcaaaatctttttttagttaggatttagtgcaaagatcacataattcaattctggaaataaacttcctctttaaataaacagagaagtaatcattaattttgagaaacctaaggactgtcttgcacatgatatatgtgtgtatatttatgaaaacctcaaatcaaaaatacttacttatgtcatgatatttgttttgaattattttgtatcttcttgagatggagactgctgacaatgtgctgtgaagctaagggcatttataccttttttttggaagagtttacctaaagctctgattatatcttttcaagaaaagcttcctgtaatgctagtcaacactaaataagccttcccctagaaagatcatgttctcccattagtgatttatatggggagaggacctagggctcatcccaatttggttgtatagggaaaagagtaaaaaaccacaagactgtccctatgctgctctagctttttctcatccattcttacctggagaacacatacatcacgtttagaatggcccagttaccatctatatggcccacaaatttatattttccacacagactttgccctgtcttctaggcccctgtgcccagctgtctacttgacagtttctcttgatgtcttaaatatatcccaatatatccaattgaattcacgttcaacacctctcttctctcaaaaaaggtgtcttttttcagcctttcctacatcattgaatggcaataccatcggaaatgtttcatataccacaaacataagaacttgcccttttaatctgtccatttcctccatctttgccattctcatgccaatgcaagccactatcatctctcactccaaccactgcaaaagcagtctgatggtacctatcccattgaatctccagggagaacactagtgatcttttcaaaatgaccatattaatcccttactcaagaatcttcaatggttttctaacactttaaaagtaaaattgtcattaacatgaccttaaaaacgctggaaattcttcttctgcttcctcagggtattcaaactcgtttctctctctttccggtctttctaacttgctctgtttaatcctggcccaaggcctttgcatgcatgttgttctccctagtttcgaagtcctttccactaatctaattgcttacctaaaactcagctccagtgtcccctcctcatggacacattccttgacccctgtgaacaaatccaatcattcatttatgggtactcagagctccataaaccagctcttcatactacttaacgtgatacagttttacacacatatctgtgattgttaaagtcagtcagtcaccttctgttaaaaataaactccttacaagcaagaacggcacctgattttattggcattttatcccaaggaccaagcaatgtgaccagcacattgtgttgttcattcaacgcttaccgaatgaattaattaatgcagcagaaaaaaatggcctatctagatctgtagtagaatgaaaaggagggaggaagggagaaaggaggggaggggggaaagggaggaaagaaggaaggaaggaaggaaggaaatagagaagttaaacataattcttgaatatgtgcaaacactaactctaattttacaaattacttgcagttgtatttctaaattctatcttttcctaactgattgtcacttgatcaaatgaaactaattcaggtcaatatctcttatggtaagataagttatgtcatactttcctttaacctgaggagtaaagactaattgcctttcctatgttctatttattatgtggtaacttttacatataaaaatgtctgaaagtgtgctgcttaaaatgcacattatgattgtattacaatattttcccgaggtgtcatattataatattcttactggttggtggatcgtcaatcacctcctattattctggactggaacagtagactatctgctttatgtaggcaagtcacagatactgacatttgtaaataacatccttgagtttgaacaaattcaaacaaatcttctcttctgtgagtgtacatttctgatttgcaggcaagttgtaaaacgtctattataatctgcaaaattatatttgttttccaaataatgaaattgtttttacccatttctagacctttattcatcttaaagtattaaatatatgttcctcctattacatcaacaccttgtaaactaaatgattaaaagcatatcccattttcagctaacacatgctactaaactccaacctatagaaagaaggtgccaagggtatttaatctcttcaggctcatctccatattttctatagacctgataaaaattatcaaagctttattttccatgatagagatacttcctaatagatatttcatctactattttttcatgggaagaaagtacactatgctctactaccttgaatcttttgtttgtttgtcttatggcagcaataggagaaacatactttaaagattaactttttttctgtaatattaccaaaaaaggacatgtcatttattatagatggaatgtgttcccccaaaagagaaatgctggagtctcaacctccattaattcaaaatgtgagtttatttagagttaggatcttgacaagggtaatcaagttgaattgaaatctttagagtgggccctaatacatatacagatgttcttgtataagggggaaatttggacacagacaagcacacaagaagaatgccatataagcattaaagcagagacggatgcgttgcatctccaaggaccaccaaaagctaggggagaggtttgaagcagattcttccttacagccctcagaagaaaccaaccctgtggacaccttgatcttggacttagagtctctagaactgtgagacaataaatgtgttaaagccatccagtttgcagtactttgttgcagctgccctagcaaacaaatacactattaaacaatttgtggctgggtgtggtgacttatgcctgtaatcttaacccattgggaagccaaggcaggaggatcgattgagcccaggagttcaaggctgcagtgagctacgatcgtgccactgcaactccagcctgggtgacagagatactgtctcaaaaacaaaaacaaaaactctgtgagaaagatgggatgcttacagtttggcatttctccctgattatatgagaatatagttaccaaacctgtaggtgagtaggaatgatagcatccgatacatctacctatccttccttccttcatgctcccttccattttcctctctctaccactttcttttccttcaatatttttctctcctcttttcctccatccctccatcctgtctcctcccttcctttcttcctttgaatagtgtgatgaataatgatgctctcaaccttccaaatactaataaagagaaacttgaattttccaagtgaagaagcccaattttattgtaccttaaacttacatatagtaaacttaagtgaaggatggttataaaatctgaatttatatcaataatctcctctatttttcctggaggggaagagcctcggttaaagagatttaagaatgctttgagtacttgtgtttgccctaaagttaggggaaatctatcaatctctgccatttacccaaaaaacattgtaccccagattaaactgaaccaaaatcttataagagattatgggtaaagaagacatgagcaagggcttcatcggcagaggagtttcaaggacatcctatcgtatattatggcaaggatatgaccgttctaggaaacacatgtaaagcatataggtgactacacaggacatatttgaaggtgaatgaaggcagacagagtagattgtgtcctgaatgattagctgtctgctctgtcttagcttgagagtggaaacacacatgcacacacacaaaagtgactctgtactcagttctgggtaaccctatgcatttgctcttgagattctcttatgtggcagacctgaccttggtcactggattaagaaaagagcttggttggtatttttccttgcctttcaattaatagctttttgacacagctggtgtttaatagagcatcgttaacatcacaaaaaaatagttcctgcagattttatcaaatgaaatgtcttgactaaaagatgcattctatttttgactatcaaacattgattgccctaaaggctggtaattgaaacctaacctctacctgctcagcttgtcaacattcaatgccagttgtctcccaccagagaatgagattaccatctgctattctgtggtttcttctgtgctacaaacagatttagtaggaactattaaagctaattaacagtcacagactaccctgtgatactcaacttactgcaattttatctgagccagagaaaaaagaaaaactacaacactgttcataagtgattgtttagttatacaagttaaagacgcttacaaaccaagagcagtgcaatgaccttaataagaatgtagtcacattgcattactaaatttccataaactttttgtctggaaaattgctatgcctttacttccatcttctctctccttaataactactaattggtaacattcaaaaaaagaatgtttctttaataattcatttttaataatttatattgagaaagtccctttcagttctggagcttactattttacaactgtataaaacattccacttagaaataaatagctagtttatttgtcattaaaatgctaagaatggctcttctttaaaaatactcaacttcaaacgtaagaggaaactgagtggagagaaagagagagacagagacagagcgattcccagatattccatagaaaaagtacttcctgttaacagtgttatatttggatttgatttcctatcagtggagaaacagactaacagacatgggccatatgtcacagagcatacatttttaaaccttagcagaaataacttaaacagcagagtaaacagttgtaaagcagggaagctgaagatttccacatataaaataacattttctcttctttaataggtattctactgacaagctttaaagtgtgaaaattaggttatcctctgacaacagtcttgggaagtaattttgtgctatatttcatttcgtgctttattattattattattttaatatcagtgctttctagcaagaaaataaggaagcctaaaaaataaaaattactgctaagttttttgaactcaaacaatctgacgaggagatacagaccctggaagaacagagctcaatcagattttatccttcaggagcagtgctagacagagcaggcaggacttttaatatgacacgacccagaaaacgcaacctgcacgtaagtaacgtaacttctgtggtatatccacatctcagattctatttaccatgtgtggatattcagattctcagttcgggttcagacagtgtaataattctagcttctatgaagagtagcctgttgttattactattctttaaagtttatttatctgaagtctgaatatttttttcaaaatcataaagccaaaatacaaatgcaggaaatattttatcagcattggattgcatctgctaacgtaaacctccctctcccttccaaccataactggaatcgccactaccatattctcttacacacacatacatcctcctcctttggacagctgcatggtattaatagaaattctgtagttgccatacataatgaaggagagatggtgcctaaggctctttcagagaagcagagccacaaattccaaagtggaactcttctccccattttaaagactaaccacccattttcctggaatgaactttgttatgtgttgaataagccccagagaaaaaagagtcatggatatatatatatatatatatatatatatatatatatatatatatggtatatagttacagatgacatttcggtgactgtatgtaaaactgctaataaaaggctcaagtacaggtattttttaaatgacttgtggcttgacttgattagtagatgtgatgaaattgatggttcatttcctacataaaagacaaacagtccaggtgcagtggctcacacctgtaatctcagcatactgggaggccgaggcaggaagatcactagaggtcaggagttcgagactagcctggccaatatggagaaatcctgtctctactaaaaaacaaatttaaaaaattagccaggcatggtggtgcaggcctgtaatcccagctactaaggaggctgaggcatgagaatctcttgagcctgggaggtggaggttacagtgtgccaaggtcacgccactgcactccaggctgggcaacagagtaagactccatctcaaaaaacaaaacaaaacaaaacaaaaaacaacatgacagagaaaataaaactgtctttaactatagaacagttactaaacattttcaactggaatgacgtcttcagttagaattagtttgcaatagaactttgaaactggaagctggcaaaagcacaagagggaaaagaacttaaactagaaaggaatttgataattatgaaagcatgaaatagcatggaagaaatcggtatgagaaaaaacaaatcttaagtaactaaatttaattcaatttgatgaatatttaattgagtagctactctatacaaaatggtgtattaagatctctgagtgggccaggcgtggtggctcacgcctgtaatcccagctctttgggaggccgaggcgtgagaatcatgaggtcaggagactgagaccatcctggctaacacagtgaaaccctgtctccactaaaaatataaaaaattagccaggcgtggtggcaggcacctgtagtcccagctactagggaggctgaggcaagagaatggcgtgaacccaggaggcgaagcttgcagtgagctgagatcacaccattgcgctccagcctgggtgacagagtgagactccatctcaaaaggaaaaaaaaagatctctgagtgatgcaaaagtataaaaaacagtttttatttcttcctaaagtgcaaagtataattaggagagtcagatacattggtgttacccatgagccaaatgcaccagaatcactggaaatatagatgtgaaaaaatgcacatttgattaatcaggctgaaaatatcaaagttaccttccatttagagaaactcagaacttttttttctttggtaaaatttcatccagactctggagttctctgtgtatctttctagtcgcagaaccatcgagccaactcactgttttatcaatattatcacaagagtattcttttcatatttatttcccatcttagtttccttgaaaaatgtgatgaaaatgcaaagatcacaaattcatgcatttttttttgactatgaacctttgtctatgtgttaatagttcaggttctagtatcagttgatttatcttttataaatggttttaaaatttaaacatgcaagaggttttcttgatttctattagtgattatctcaccctcgtgaaacagaaaaaagtgttgtaaatgttgtaattcagtattgtatacacagagagagagagagagaaagagagagagagagagagataaggcagttttcagagtaattaaatcaaaaagctgtaggctccatatatgacatagcaaaatggggaaagattgatcaagggaaaataggcccatatatctgaataaaaagtagaagaacggtgctataataaaagtaaaaaacaggacatgattattgtgttgtagcacaactttaggagtaaaagttgataagcgtaggagaaagagaaaaaaaactagaactagtgtgtaatagagaagtgggaaatagcattgaagatatgggtatgaaaagtggtatattctgattgttttggttgggtattcagtatctgactgatctctcaactaaactatgaaactgaaatagaaaattcagcaacactgaagtcattcatcaaatgtaacggggatgattgcctccatccatttatcccataggagatatcacaaccatgagggaataataactttataccaagaggagacaccataggcatgtagataagtagtgtcaatcattttctctttgactattgattgtcagaaaataagcttctgcattaaaacctgaagacctaatggatcagaatctcttgggtcagggtacccaaggagctgcattaatgatattcacaatataatctgaggatctcttttttaatacaaaaatactttgaaaagtactataatagatcatcacttaatatgacacgaggacatgagggattgatagaacacaactaagatcagaagaaggaatcaaaaattgaatgtgacctgagctttgcaagatgattagaagtttactaggcatgtgcaggagagaagtatatatgccaggtatagggaataaattttaacaaggctcagaaatatctgataatggagtacagtgaagaaataaagcaatatataataggtgggccaaacgagcaagaactttgaattgtagattattctggaaataccagagagccatagttggttttagataaaattatagagaggccactttgggtaggatgaactgaaagaaagatgcattggatcattacggaggactctactagggataacgggaccaaattaagacagttattgcggaagatgcccagaattcacttgagattccatgcaaaggggtttatttgagcatgttgaggatgacaatattagacattaatctaagatgacagcaatgtgaatttgaggaaaaatatgtgcatgtaattaacagaaaaacttgaagatctgaacttcctactaaattacctacttcagtgaatggtaccaaaaaaatcacacactgtcacatcctatatctgcaagtcatttagacatgttctctctgccaacatctttccacatccataaatatactgctaataagatttaaaatatatattatattatgcttaaaatgtgccaagaactattctatgcactttactcataccaatttaatccaaacaaacactctatgagataggtactattctcctgagtttgaagaggtgaagaatgagactcagaaaggttaaataacttgcccagggtcacaaagggagtaagaatctgagcattcttaagcattgtactatagcacccctcaaatagctttccaattattcctctctagtacaactttcctcctactgatctagttaaagttactttcacctcttatctaaatttcaaaggtctccaaatgaatgtttctgccttcagttttattccttctcaagtcactctcctttatgttgttgccccagtcattctaaaatgcaagtcacatcatccctctaccctgaagccagtaagatagtatacacacacacacacacacacaattgtatcatttttctaaactcttaatcacacacacagagagaaattcagggaaattggttatggcttgtcttggctttagaaacggagacattaattgctattgatccctggagttaaataatgtattgttccttcctctctacagagaaatcattaattttatttcattgaagcttttttcatcagtcaaagccctgtcgggaatcagatagcacactcaaaatcatgattgaagagatattaacaaagaggctgcttaccaaggagaggatggagttgagaaacagcgaggagtgtgaaagactctggaactaggagggctagaagccccttccccacctgggcctgaacagacaagaagtctggatctgcccagacatttagctgatgagggcctccaggcaggagccattacttggacagaggaacacagccattgacaaactgtggctccctaaaagaggaagttagagcaataaacccccaacctcttctcttcctagaaatcaatctcttccccctttgttccattggcctaatccaatgagagctcagctgagtcagcccatcaaggaacaaagccaggtagacagggttagagagtgagtatggaagcaccaatcggaaacatccagcgcatttgtgtgcctttatatataacagttttgtctttgacattaaattgtatgaattcaggcctacatgagtgtaagaaacaaggatatcatctgattctccataacaagaaggcttctgggcttccatttcccactgccttattgcaaggattttgacaggtggagacatgaataaatccttactgctgataaatcctaatggaaagcaagaccagattattgcactcgtcttccagaaataacagtttatttcatcttcctggctcttagaattgcttctcattatgatttattcacatcgtataatgcaaattactacacaaattataaatttaacatacacacatgttatgcatatacagtacaaacatttatatgtgtgtatttccatgattttaaatatactgggctctttgttgtgtgtttcacataaagttactcatttaaagttcaacaacctaggatacttgtctcatcatcatttacatagaagaatcctaaagcttagagaaagtaagtgaataccaagagttcacatattaaggaaaaggtggaagctagaatgcaagttacaggaatctaaaagtgtctcactctcagtgacaaagttttcctgcctacaattgctgaatgacgtagagtaatgtactcttacacattttctttgtgtaatgtcgagtaatgtactattacacattgtgtttgtgagaaacaaacagaaacactgttcttcctatgataatcttaacaaagtcactctctttctgaagcttcttcatgatcaaaagattgaggtgattttttaaccatcacttgacatcacataattttatggtctgagcactccatatcgggcagagggggataaactaaatcactggaagacaaatgtggatttagacacaaattcctgaagaaacagaaagggaaagattttctccacacagtatttgtcaactgctatgaaatcctatatttctactaactcagggaaactttaatgatcagctggagcaagtacaaaaaagaagtgtttggagaagaaaactacatattaaagaacctattcttcttctttcagggcatacaaccaaaatttaagctaatatcatgctgcattttaaagatcctaagtaatacaaacctatttttacaatttgcacgttttatgcattcttggaagaaacttcattcacactgtacgtgctcacagcctgtactcttggaactaattggcaagtgtgaattcgtaagtctgtctgaaagaactgtgtccctgtgtacatatccaactgttttgaatttttttaaatttatttctgtttttacttttccaggtatctaatgtgagaggtaagaacaaccttcagagaaaaagcctttcactgaaggaaattcacattataaatatgagacaacgaagagaagcaagcaaactgagtgattttaaaatataagttgtggattctttttaggacctgctgcccaataagccaattaagattgcggagaatataagtgttttggaaggcactgcatccccaaataaaaaagataagaatcatagcaacatttggttgctctcacattgtggatacagtaaatagagcaggagtcacaaaatttttaactagttcttgcttttaaacttaattgcctatttaataaataccatatatgtgaaagcacataaagctaattcatattttaaaacaatgtgtttgttataaactagggggaaaattcaaatatatacatatatatagtagagatggggtttcaccatgttgcccaggttggtcttgaaatcctggactcaagtgatcttcctgccttggcccctcaaagtgttgagattacacgtgtgagccatcatgctcagcccgtagtctctattatgttgaagaactatctaaagacaaacaatgtagcttagcttgttagactagatatttattttcttaaacatgtcttatttgtaaaaaagaaaaaaagacaaaaggaagaagggaagtgaagaaaataaaagaaagaaaagaaaagaatatgagagggtatcactctaatagggagggcccaagtgaaccttagtagttcctagcatagaacgataggtgctctgcctgagtttctcaaagttgatattcttcaaaagcttctcacttcccattaatgagcatatcgcttttctgtaagattccagtgtggtttattttcttccagaaacaaaagtaaagttgattatgatcatttaataaattctttttttctttatcttctgctctccaagaaattttttaaactatatatcatgaatacttggaaagtctcaaatttttataataaaaatgccaggtgttgactatagtgaactaattattgctagttaatatatacaatttgacacgaacagatagtgaaaaatacatacaaaaatcaataatcacagaactctaggtaatctagcaatcattttataatgagaaaactaaagaaaaattaagtgatttacccaaaagccacacctttagacgtcaacattaaaatttagcccaaatcatagaatagaaagtggggaaaaaatcctctatatttagaaagagagaaagaaagcaaataatttcaatgaaccaatcaggtgttttaataatattcaaactgatgtttattttcttaaaatagctgcagggaaaccacttgggctggaaatattaaggcataacaatttaaaaggaagaactgcaaaatcacttgtatctacacctatatgtatatttcacaagtagcaattttaaaggttacatttctctaatttttatgagtgaattacaggtcacttaatataaattttaatttatatcaggtattttgtatgtcaatttgatttatttgtatatacctagatctaaagctgatacacatttcaagaattattattcctttatatattttagatatattaacctataacaaaatttctacttgagatatcaaatgccatagtttgtgctatgtgtctgtgctttaaataactgggatatacaaagaaatgcagagaaagaaggacatatatttcaaacagtatttatatgacatggctcataattcaatgcaccattagaggaaataatctacaaatatttggtaaattttaagccaggaaagcagaactctgatagtaaagtgaaactgtgtcttcaaaaagagaggtttaaatatacagaggatatgtctttgtctctgatgagcataaccagtataacttgtattcccaagtcaatttcaatcatgacaggtagcatactacagtaaatattataataaagctatatcataatgattctcatctttctacagccaccaaaaaaaaagaaatcaaagatatgagatacttaggctcaaaaacctaagcaaatgatttaaccacaaaggccatttcctttttgacagctgaaatacatatgagtaaaatgaagaatccatttaaacagctgcattccataatatttttcagatcctttgtctatctaaatttgtgtgtttcaataaagtcaaaaggtagtttctatgaaaaaattagacattaatagactgtgttatctctatgtttctgtgatgtctagagctgtggaacttggacactattaatgaaattcagactgagtaggctgcttttatcagtgtttaaaaatccaattcttcttaggtttactaaaccagcaacttttttataatgaaaattttgtaaattgctgtaccattccattaagaattttattagagatcaatgaaaagttaagtttaaagataaattcatatatctacataaacatacataaattccccaaaatattgaaaaacaacactacttccaacattaggggaaaacgtacttttatgacaaaatacttttttataaactggtaggtgacataattcttcaatcaaatgctgagattagaaagaaaaatataatttcctgtatttagccttgagcactttggtatgaagcaagaaagaaaaatcaacagaaatattactgtagatgtcattatgccaataggaaggtactcaaataaaatttatactgtagaaactagtattttaatctatatgtagttagtttagcttatacacatagacatctgaaaaagttcctttcacaatgcttctgttgacgcagattctttactgactctcccactctttcataccacatttcatgcagacatatttcctctctttttctcaaatgacttgatatttttcctggttattttaatacttgtctggaaagctacttagcattgcttggtttttgcttccaaactagcctatcaggactaagggaaagagaagcttattagattatataataggattaataaagaccaattgccttattttgcactcacttattagtttaactagatcagggacacctttgctgtcagtaattaaatttatgtattagtgaattttcatttctaaatctcaaacatttcaaaaacagtccttttcgataattgtccacttgcatgtttttctaaaaggaaatcaaataaaacaactctcatttagcacgtacgaacattttggcataaagaagtcaaacaatttaaccaaggatacagaaaaatggaagaataggaaattatatccagttattcgcatgtctagtcataataaaaacttgcagaatgattcaggatatgtctatgcacacaaaataataatattgagttttactacatgaactgttacttttatcccattaagtcctggatcaaatctaaacttctttaactctctgtgtaattccatacaaggtgatcatattcattgtctcagctttctcagctggaaagctgaaagacagtcatttatgaagtttccctcaagctctcaaattctgttaactagtgactggtttgcattcagaaactggccaagtgaccacactggccttactccagtcacttttggcaacagcatgttagcacaacattggcagaattcagacatgctgttgaatccaaacaacattaaaacaatggcaacaagaaaaaattaaacagccaatttgagttaatacacaaaactataaccctatcagaaaaaaaagaatagcacatgtctgcctatgcagctgagagggaactttggtcatcatcaagtcctattgaaagaaaaagatgtaaagcacttaaaaaaaattcaaaactaaacactaagttaactcactgttaatgtaaaacatctttcagaaaataattctagtttcatattttaaaacaaaaattaaataacaattttttaaatttgtaaaatgtaaggggtacaagtgcagttttgttacatgggtatattgctaatggtgaagtctgggcttttaacgtaaccattaccaaaatcgtgcacattgtactcattaagtaatttctcagccctcgccccctcccaacctcctaccatttgagtttccaataactattattttatgctctatgtccatgtgtacacattatttagcttccactaataagtgagaacatgtggtactgtttctgagctgtttcacttaagataatagcctctagttccatccatgttgctgcaaaagacatgatttgattatttttaaagctgaatagtattccattgtatctctatgccacattttctttatccagtcatctgttgatgggcatttaggttgattccatctttgctgttgtgaatattgctgcgataaacataccaaatgcaggtaactttttgatataatgatttcctttgcatatataaccactagggggattgctagattaaatggtagttctatttttaattatttgagaaatctccatactgtttttcatagaggctgtactaatttacatttcccaccaacaatgtaaaagcgttcccctttctttgcagcctcatcgacctctgtcattttttgtctttttaataatagccaacctgactggtgtatgatgatttttccacaaactatcacaatagtagaaaatccatgtttccaattattttgaatgcagttacattctaatgtgtagtcacagtagatgaacagtgtgtaaagattaatattttatcccaaattaccaaaaatatgaaaatctttattttggctatgaagtcttgatcactataatccaaatgatcagacaatttttatttgtttcataatattattttttgttagtaatataatacagaaataatttttaaagttataaatttaatcacagttccactatcaacaataggccacacaacacaaataagtctttctcctttatttctcccaatttccactctcaaccttcatactcacacaaatttaataagtcatcatttaataaaataagataatttcacagataaaaatgatctcaaatctattttactaagtaatgtatgttgatataaaattctattttgacttgacagatgagaaacaaaaatactctgtgcctacattttaaaatatatttgtagtagtagttttattaaaatgatttctcagtttcaagtgataaacaataatatttctggatccctatatattgtaaatatggttcagatatttcctctaggaaaatgttggcattcagaatttggaggaaatatagctctcaacagggatgataatgacaaactaaaaataagtctataatggaattaggactcatcacactcaaaaggtgatatatagaatatttgaaatcttcaaatgacatataaaaacaaaaacaaagcaaaaaaccttcttggcttttttgtggtgctctacagcacagacttagtacagaaaaagcaaaaattaaaaaaaatatctagagttgagatatatcagacctgttttcaaaccttatgtcttgtgattttgactcaccacaatgaaacacaattatacattcattattaaaaatccttttcgtaggaaatctgcattttcagtggatcatgtctgttttgtgtggtgttattttttaaaagcaagtttctggagtaaggtagcatagcttttagttcatactttatttactacttgcacgatcacaggcaaatcactgaacctccggaagcatcagttttctcagttgtaacgggattataatacatccacaggattgttcagaccattagtgggataatttctttaaaccacatgcagtgaataaatagtggttatatctaaatttttatttaaatatattgctcttaatatctttaattctttcaagttatacacaaatgaaaattagattatgtgagttgttaatcttttcttgacaattctgtaagcaaagtaaagatgttattgatatctctctggccagattttcagtattgtaaagatgcaggctgtggcatgactgataattcaaatagaataaaatacaagcaactgtgactgctcagaaagtttatctaatgtggtggaaggatccctgaggtggaggtccagatcagctctgtctttacactgaatgggcaatatctgttgaattagcacttaaaatctttgagctttggctttccagataaaacaatgggaatgtgaattgcataactgctaaggtaatctggagtagctttgaaattgggtggtttgtaagatagcagtaaaattattatttgttgcaggctatccatgaaccaacagcatgcactttatgtatctttccttatttaatttcattaatttaaagctattactgaatacctactaaatgctagccccttactctttagaatgatgaggttcagcagtgaaaaagcaaacaaaattcttgcctttgtaattcatatattgtagcagccaagacagatacaacttaaataaaatgtaagcaacattatttggtgatcagtactacacagaaaaaaaaaaagtatatggtaaaaaaaaaaaaaaaaaaaggtttccgtaggttgaggggttgcaattttaaatagattgggtcagggaatactttcctgaaaagaagacattggagcaaagccttgatgtagacgagggaatgagccatatggatatgtaggcgaaaagccttccaagttttggaagcaataatgcaaagatcctgagagggagggatcctgagatggagctcagagaatcatgcagactgaggggacagtcatggcaaataaggtcaacagttacaggagatcagattgtgtagggcttttaatctctgtgtttacactgagtaaggtaggaagtcatctgatgattttaaacaatgaaataatgtaatcttacataaatacatataggtgtgtacagatgtatgtatttgtgtcagattatatgtatatgttacacatacacatgcacacatatattttatatatatatatacatacatacatacaggatcactctggctgttgtgttgaaaatacactaaagagagacaaaatttgaagcaggaaggccagttaggatgctttcagtttaactcaggagaaagtggacttcaggactcaaatgtagggtataggagagaaatgggcaggagagctacatttgtgggttctagtgaagacagaaaaatgatgtaggatcccttgttcaaatttcaatacaaatttaggaatttcagtagagtgatagtggagcaataaaccaagcacagaacttttctgagtgtgaagccctagaaagaattcgataaagactttaagttttttacctgaatggagtgatggagctgcccctaactcatacaagaaaaagtgtaggagtggaaggtttgaggctcaggaaaaggtcaggaattgtaaatatcaacatttaggagatgtcttgtagacttcatgtatctttacctttaacaacacacaagtcatcactgaccacaacagaagagttttggtggacagagtgatgggaagcagggcagcggggagactctagtaattctgaggaagaatggaatgagagattagccccagcaagtacccagccatctcaagaatttagctgagaaagaaagaaagaaatggagactggcattaaggagaaaatagaactgagaagatatgtttaagaggaagaaatacttgcatcctcctaataattctttgaagttggcattatttttcttatttttgacgtataagtaacttgccctagatcacaaaactagtaaggtgcaatagtatgtaaccacaaattattttgtttaaattaaagtacccactttgagtcactacattagattaattatttagagtcttagcatcttagggtttgaggaaagagcttttacattaataatgcagtaagatctcagcttaaatttcacctccctcaaagaaaagtaggccccctcaagatctccatcatatcacatggtatgcttctttaatagtgctcaaaagaagtagttaattatatttatttatttattttttatttacttttttagtttcctgagtgtaaaagagttcaggcatcttttttgacttgttcaccattttttccacagtacccagcacagtgcccattgtagtacatgttcaatgtatgcttaataattatctgttgaatgaatgactaccattctttcatttcttcttttcacattcatgccaatgtggaaaacataaatatgtatctgtacctgccttcttgaatattgttacatcttgccaacaacaaaactacaaatattcattagttctcttttcaaatctgattccacttacatttcaaccctaatactaactataactgtaatttacattaaattatagtgataccgtttttatataaactgtattctttactcagtttctcatagaaattaccaatgacataaagtaataaattcaaggaaggtaaaatctgtaagtatgttaaaaattctatatgttcaaaattgtttgtaaagacccttcagtaacagcacagctgcaagaggtgatgtgggtgccactgacagatcaaaagcctaagattaagagaaaagtgggcaccaacttgccttactggctattcttctttctgagaaatgttgatacaaatctgtttataaattagagctcccgtctatctgactaatttggcaagaacaacaaggcttttgtgtcaattgaattaaaagagaaaaagataaaaaatgtagatataaggtaaagaatgagaaagaggagaggcactttaaaatttctcagatataaatactactagagactgacagcacagtgatgttttttagaaatagagctgtaaaaataaaatcaaaagaaatcagatatttgataaaggaggagaaagagacaataaagagaaaatgggggggataagttgttcaaatgatggctattaataatttttacccttagtttcataatgtatgatatgatattaagcatttagaattatacagtattcaatatcacatgaccagactgtgtatgttaatgtatgtttacattagaggaaacatcaagaaaaaaactacatgtcacacctgcattgcccactttgtttagtgtaagctagtctatgaataccccttattttgaaaatatcttgtttcccatgatatgttgttttgaattacacacacaccagaacactgcactgcagttgctactacatagtctgattttccctttgagagtttttaaataattgtatggtgcaacagaacgattttgttctgaaagtatctaaaaataatctgtatgtttactttattctttctactaatctaggtgagacaagcctggttttcaatagctgttataccttaattgtgtatttgttctttttaattagcatgccatcaaactagatcatgaggattagagtgaatgagatttcattttatttgatatggtctgctttaaacagcttgtgcatgtttatggaaatcattttactgtctagataggatatattaaatatgtagcctctgaagaactctattatgccacgggagagaagaaacatgatgctaaaaacacaaaaggtctatctggatagactacatatcttgctagtatcatgggctataatgtcctcatatatatatatatgaaatatatatagatatgtttatttttgagagacatgaatattagtctcttttaaaaggcacattatcaatccagctgtatgtttggaatcataaccaaaggcagagttcacataatacctaaataagcacttctaagaaaatagttgttcaagtaggttggtgaagagtggtagccattttagtcaatccgtcaagttaagaattctgcaaagatgtagtggtaggttcatggacacctcaacattctactcacaacacaacaattgctttctttggaaataaaaggtatctatagattcagataaggctatttcacagaaggcatgttttcgagctatgagatattatgattcatttcttcaactctgaaatatttgcaagtatgtcaaacccagtagtgaatattttcactcctgaaacttgatgttaagcaacattaaggatacgtagtgttgttcatatgatgtacagtcctttctaactggctcacaaaatcctaatttaattatcacagtactattagccattaccttcatcaggagctgctcattttgaaattttctatgggcctattaagtatttagaaagaaaaaaatgtgtctattttatactgattgaaattaatcactaataataaatttgtatcttttacagggagtctatttaaaatggactatcatgtcttcatttataatcatatactcttcaaagtacaagggtgtgtatgtcatatttaggggtataaaagaatgagggaactggcattagtatttagaaaatgaaacactattttttgcatggctttatttaatattagtaatattttatttgcaattacaaataatacaaaaagagattttatttttctcaagaaaagagaacataattaataaaagtttaaaaatagtattctgtaaattatactgctatagtttggatatggttggtttgacccctccaaatctcatgtaggaatttaatccccagtgtggtggtattgtggtcagtgagatctagtgggaggtgtttgggtcatgggggcagattccctcatgaatggcttagtgtcttcctggatgtaatgagtgagttcttggtctgtgtgcctgtgaaatctggttgttataataaaaagaactaggcatcacctccaacttgctcatgcttcctctctcaccatgtaatcactgcacatgctggctccccttcctctttcaccatgagtggaaacagcctgaagccctcaccagaggcaattgctggcaccatgtttcttgtacagcttgcggaacaatgagccaaataaacctctttactttctgaattacagagcctcggggattcctgtatagcaacacaaacagactaagacatacttaaaaattttataacagaaagcatgatttctgtggctaacttacatttacataagcatatgtatatatacattatataatcatgagtttgtatccacacaggtgttttccctagtaatgccagtcctattctgaattttcaacaaattcagacttacatagtcctaaaaaataataatagaatttatcaaatatgtatgctctaaagatagatatatgagtaagaaattgcttttgatcttagactcatattagaattagaagaagaaaggaaaaatagcattgcagtgctgttggctggctactcggagaggccttccagagacaatcttgatagtcataatttaggggtcctcagtttcacaggtaatcatttaattttctcagcacaaccagagatcacagcaggatatactcaattggaatgattctggctagctaaactctccagacatcaatgcataaaccaatttataaatagaattcctacttgtcaatttataatgaaaaataggagtgccaaacaagccaaacatcctttatcactgtggtctttcccagtcagtaaaccaaaatgaaaaataaaaaatagccaaaatactaatttttactcataatttcaggatccagggtaattatatagaatacatcaataacgagtgccatctagttatcctactctggagaatctatctcaatcacagagatataatttccagatgggtctctgatactggtggcactgtcacttgttagtgccaaaaccaaaccaacaattcatttcaaaattgtcttaaaaattcttactgacctcttagggtttgtgaatgtagccttttatgagacagagtaacaagagcatcagcaaagagtttgctgccatttcttaatgcaatagcatggcaaatgtcaattaagttcctcttttctcataaatctggactcagtcttcaactcattctcagaccaggcaatcactacacgttgattataattgacattttaaatgaaatttgtttatttcagagatagaattaagtttcagtcatgttatatattcaaacactcaagatccaatgtcataaaattcatcccgctttgttatgctgtttctgtgattttagacccaacacttaagagaatattgattcaggttggttgcttgtactgatgattggtcccaccctctatatttaatttcctataatttcattctgaatgaaggccttatcttcacattttaacagcagcttgttgttgctttctatataagaaactgcattcagtttcatctgctatcttataatgtggctaacttacatttccctccacattgatcttactctaaacagtccttttaaggaagattgcagttagtaacatgcaaagaaacagttgaatttcacataatagtgttggctgggaaactatttcttaagaaaatgcaagtgaaattaataatattcgccataagaaaatccaaggattctgggcttcctgatgcaatggtatgtggccaaataagctgattttacacatgtcatagagtgaagtgactaaatctggattactcttttcaacactgatgacgataaagtgtaaaatgaaaactatttaaagtgtaagaaatatctgctctttggtacgtaatttcttaatttggagtaaattctaagtccaggttttgttctttaatgcaaaaataaaacaaatacactcagttgttcaagaaaatctgaaaataggaagttacttcaatgcaaataatattttctttgataatacatatttgactaagacaaatccattttaaaatttaaaaatgatctctgtaagtttttatgttccttggaagaaaagtgttatgtgttttcctttccctagaagtaattgaaatatttttgtgcagttatctgtgttattttggcggcagctatttgcaaaagacagagggctgaagtggagaaaacagcagcatggtattgtgggagagggtgtgcctagaacctgaacctggcttctttctttgtcttttatttcaagacagactctcgctctgtggcctaggctggagtgcagtggtctgattttagctcactgaaacctctgacctcccgggttcaggcaattctcctgcctcagcctcccaagtagctgggattacaggccagcaccaccaggcccggataatttttgtatttttagtagagacaggtagtagagacaggtgcaccatattggccaggctgttctcaaactcctgacctcaagggatccgcctgcctcatcctcccaaagtgttggggttacaggcgtgagccactgcgcctggcctggcttatttccattcataagctaggcctatgagttcctacatcgggattttatttatttaaacttgctaacagttactgaaaatttatgtccagcacaaaatgtttatatatatatatatatatatatataaaatatgttatatatataaatatgtgtgtatatatatttatataacatatataaatatgtgtgtatatatatcttctacaatttctatatgaaatgaacaataattattcccactctacagatgagaaaacagaggttcatagctagtgaatggtggaactgagattcaaacgttagtatctcttatttcacaacccacgttcttatattctttactaccttccacttaaaaacctagaactaggaaaatatactcctttcagaatattgttttcttatatctgtggaagcagtagctagttttctgtgataggagtagaaaatgcagctatatattttactaagaagaattccagcacagcatagaaataatgcgtagtcttgtgaagatgttgacccggaaaaacggagaaatgtttttcaggtaggcctacagtctggagaatgggtgctcaattgaggatattcttagaggagataaattgtcctagatttaggcagataaaacacttacaaaagtagcagcaaattcttctccatgttgtacttctattaaacaaagaaaacttccttaaacacttaaaggctaggttccgtgtgggggaaaaaagaggaaaggaactcatttcatacttgggataaattagggaaaaccataccttctgaagtcacagtagtaggaggaaggaaaggcagctttgcctggcagaatgctacctcaggggagtcagccacagagtgggagaagcaggcagcactaccgtgagtcctgcggcagatcccaagggattcatacttgaacatggaagcctcaccttgaataaccagatgctcgaggcacacaataatgaaacagctgaggttactttgaggactaatttccacttatcattctggtacaggctcaagctattaaaaggaatggtgattttttttgtttgtttgtttttttc

SEQ ID NO: 1403 - DNA, 615706 bp, Homo sapiens
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggaggtattcatgtttaaatgctacattgtgagctaattgtgttttaacattgggtagcacttctttagagcatgctctgtgtttacttgggtgaaagagtttacttgcaatgactttccatgctttactctgaggagcattttgttttactcaggcagctctcctaagaagttgggcttgatgatttaaaatcaaagaatatgttaaatgggtcatattggaatgagcccaaacttaacccaacacattgtggatcagatttctctgctaaatttaggcacaaaccccatttaacatcaactaactttgtggcatcagttgtcaaacaaaagttgagtgaaaccaaaggttaagccaacagcctggcatctatttcttggttccattaagtttacagggatggagaaaaaggtgtaatcttaaaaaaaaatgtgaaaagatggactctgagacttaaccactcattttcctatccattcaacaatttaggggttgcccataggaaaagttgtgtgtgcacaggacagtcccatggaagaccatggactcccttacaacctactggcacagtcagggagagcaatagagccaaggccctaggtcatgtctgagtggtcacaagctattctttgagaagagatcagtaaggggatagagttgagtggttaccttcttaagaataaagtcccttctccaccatggaaatgagaagagtaccttaactaactattttaattgctttcttgtgggaacaactttggattatatacttttggaaagtgatagttatatgtaaatgtaagagtttgtttactttctatttctcaacccaacttcctccgcacttattccactcccttaccatttattttagttgcatgctaattacttacatttttggaatagtctgttactatctaaatttaaatgaattgcatattattattatgttccctgatcatgggattgtcatcattaattaagctattactctacataatacttcataaaggtgtatatgaccaagtgttacttgctattatcaaataacataataatatctgcagccagtagctggttatatcttctctgtcttgaccaaagctgtgatcaaactcccctaaatgagccattttgtggttgatgtgagtagattattgaataatcagaaatctttactgctaaactatttgaatttctaagacaactgaaataactagggtttgccactctaaaaatctatctttataaaacaacacagtttatgtaatttatttaggaatgatataagtcaaagggatcttgaatgcactggctgttgcaacattttgtgtttttgttttttttgcagggatgggtagttctcaactatatttaaaactgatttaagagtgaaaagtagtcaaatgttatgcaaatgtaatgcatatggtaataatatctatcttatattggagtgatttttgagagtcggatatccttgttactgaaattcatttgctatttcttgggatacaggccagcagtttgacaatgtattttatttgctgttgattcagagtttactcaaaggcaaatgaagactaagaagtgcatgagcatgtgtgtgtgtgtgtgtgtgtgtgtgtgtggtttgtatatatctgttgtgacataatagagaaatgttttaatggcagttggttaatgtagttgcttgaaatgttaggcaatatcataaataggacaagatgatacatttcagaaaaatggatcttcttcaacttctaaaaattccaaattagcaagcctctgcaaagcagattgttactgatggtgacccttcagccagctaacaaacttagtcatccagtgagtggcacttaaccttggaatacacacatgctcttggttatctatagccacctggttaagaataaaaccacggataaaacaatcctgtgccatttacctgcatatgaggcctggctatagaggactcagacccctccatcctcttggagcttggcttcttattatcctgtgagccaactttgaatggaatctgttggatatcatctgtcctagaggaaatcagcacacacatctttaagatggtctctggttgctgaaaggtaccagattgactacccaggaagctgcggtagcctagattttaaaggctatctctgctccccttggcagcagtcaggcagttttccccatcctgtgccacccatatgcctctgaaggaaggacagccaaagaaggacattttccaggcccctttcctgctcagagcatcccaaagaggtgccaattgtcatgatggtttctgttcccatggccatctgcttactgggctttgggaagatgccaacatattttttctctccatggctacgtagttatcacgaggtagcagtgctgtcttttctccataagtaaccttagccagattggagtgcagagctcttgctgtcaaactgtgggatgctgtctctctgacacagctttatggaattataagctcacacatttgaattatttatttcaactgttgtcttcaggatccagaggaccagaaaactccaatgtttatagatgtggatatttgatgataatgtttcagagaactttccaccttaaacagcattccagtaggaagagaccttagagtgtgtgtagccagaagcttccccatgagtcaaattcttccattgttgctggcccctgctgagttggcaccatttgtgcagctgtcttgattcctacaccatgatggtgactctctgatcccccaccttcagccttgtaccacctatcaactggaattaactatttattgtctcctcaaaattcccatgtacttgcctcttatcacactgactctcatatttatgtgcatttctcattttctattccagaatagtctagaggcaagttgtctttttttttaatcctttaacttgtactgtgcctagaccagtgttttatacccatatggcattgagttaatatgtgttggataaatgcctgaatcaagagaggtgggatactaaataaaaaaacacaaactttaaagtcaaatccaaattcaaactgtggcttttaatcgctaagactatgactttatctcctgagaactcagaagaatagacataaaagcttattactcagaattactatatattaggccctttccaggctgtttacctgtttttcattcttttacttcttataacaccactattaattttattttattattatcccattttacaggtgaggaagcagatgctgaaaacttacctagcttaatgtcattcagctaataagtggtggatccagaattacatggattgttactttggctatttagagcagcagtatgcttattcacttcaaaggttgtttttattcaagttttaagttggaaaaactgataagagatgaagaacagagtcagccactaggtttagttcaactcagagatattcacgagaaaccagtatgaatatgaaaggcactaagtttctgggactctcaggttttgatgtgaaatagttcattctcagtgtttctacttcaaatccctggttcattttataaatcaagatttgtagagtgcaataaatactgtactataacagctgcttgaaggatgttgtatttgcagtctgatacactttacctgaaatcagaacctgacgtcagtttgaagtattaatagttttcctagcagaagaccaaaaatcttgttctgaaagagactgtgatatcggaaattagcatacttcctagtttttacatcatgtatatattctgttttctgaatggttataaaactgtcagaatatgttgacttccaagtaaggatataaaactgaaggtattaaaatttcctaaggtagatactttgttagactagtggttcctaatctggctggttgttagaatcatctggaaagcttttgtagtagttgttcctgggatgttattttaaaatgaccaattattagcatattttcacagattattgtgacttggtggtcctacaacggggccaggcatatgcctttaaattacacgagttactgatgtaatatatgccctttaataaaacaacagcaacaaccacacacacaattaaaaacataataaaacaaaatctaaaatgaaaagtaaaaaagctcacctgtggacagtccaggtcaggaggatgcagtctggctattcagatgctcccttgacggttctgagggatgtgatcatcagaacacatttgaagagcactactaaaagctatgtagcaaatatacctgctcacacggcgttcttaatttccccctttttaaacttgaaagagataaaatcagtctaaggaaaaatattaataatttttttctttttttcttttttttttttttgagatgaagtctcattctgtcacccagactggagtgcagtggcacgatctcagctcactgcaacctcctcctcctgggttcaagcgattctcctgcctcagcctcccgagtagctgagactacaggcatgcaccaccacgcccagctaattttttttttttttttttttttaattagagatggagtttcaccatattatccaggctggtctcgaactcctgacctcgtgatctgcctgccttggcctcccaaagtgttgggattacaggcgtgaaccaccacacccggccgatttttcttaacttaaaaacaaaagatgttttgtcaacctttcagagttaagtagattattacattttgtgaaaaggctttagtaatatctacatatgaaaatagagcaataaagatgtattccttaaaaggtatgtatgaatttaaaattttagaaatcatctgtatcaaaagtcctaggggattttcctgtagaaaccatttagtgcataattttgcctacaaataaattcctatccttccacattttatctgacaacttggggctttttttttgtttgtttttggtaaatcttccttcaagcatagcaatactggtaatagtagaaggcaacttatttgcaaaatgttccataaaaatgcagtgcataacaataaccttttgtctagtattttttgcttctaatacactagaattatctataaagtgattctcttgtttttttaattgacatttttatttgacagtaacatttttaatcgacaataacaattgtgtatatttatgcggtataatgtaatgttttgagttacatatacattgtagaaagattcaaagaagctaattaacatatccatcaccttacatattttttttttagtgagaacatgacaaatctattctttcagtaattttgagatatacaatgttattattgactgtggtcaccataccgtgcagtagatcactaacatttattcctccagtctagctcaaactttttaccctttgatcaacatcttcccttttcccacctcactctctaccccaacccttagcctcaggtaatcacctttctaaaatctgtttctctgagattgactttgttagattccacatataattgagatcatacaatacttttcttcctgtgcctgacttatttcacttagcataatgtccttcagttacatccgtgttgtcacaattacagattcctttctttttaaagaccgtgtagtgttccattgtgtgtacatctacttttttatccattcatccactggtagacacttaggttgctttcatatcttggctattgtgaatattgctgaagtaaacatggaagtgcagctatctctttgaaatatcagtctcaattcctttggatatgcagccctgagatgcgtaatgacacttcagttgatgatggactgcatatatgacagtctgtatacatgatggtggtcccaaaagattataatactgtatttttactgtaccttttctatctttgaatatgtttagaaacacaaacctttaccagtgtgttacaattgtctacagtaatcactatagtaacatgctctatatgttaaattgtaaatgtttatgtatctaaacatatctagcagcaataggctataccatatagcttaggtgtatagtaggtgataccatttacgtttgtctaaggtacagtctatgatggtcaagcaatgacaaaatcacctaatgactcatttctcagaacatatccttgttgttaagcaacacatgactgaatatgaagaagtgggattggtagatcatattttctagtaattatatttttagttttgaaggaacctccatagtattttctgaaatggccgtgctaatatacgttcctaccaacaatgtacaagaatttccttttctctacattctcaccaacacttgttattattcatctttttgatcgtcattgaaacaggtgtgaggtgatatcacactgtggttttttggctgtttcttttttttttaagcaacaggttctctgtcacccaggctggagtaccttgacgatcatggctcactgcagcctcaaacttcagggatcaagagattctcctgcctcagcttccagagtagctgggattacaagcaaaagccaccccagcccagcctctttgtggttttaatttgcatttccctgagatactgagcattgtttgatatatcttccatttacatctatccttttgataaacgtctgctcaggttctttgcctattttaaaaccaggttacttattttcttgctattgacttgtttgggttccttatgtattttggacattagccccttatcaaatatatggtttgcaaataatattttcttccaattcatggatcgtctcatctttctgtaaattgtttccttggctatgcagaagctttttacttcgatgtaattccatttgcctattttgcttttgctgtctgtgctttcggagtcaaaggagacctttgaggagtgaagtggccaagggcccctagaagcagtagagaaccagctagggacactacttcttgctagagataaagcctaaaagatccaacagtaaaattcatctaggaggcaagactagaacccaacgaatacatgtgtttgtaaattggttcagaggggagaaagataatatgtataaggagattagtcccaactggagccaaagtgtttaagtgtattctggtgtgagatggaactaagagaaagggaaagaaaccaataggtatgctattctatcagactcagttctaggcattttaatttcatacttgtcaccatagctttgggaagaaggtactgttagcctcatcttacaagtgagatgactgagtctcagaggagcaaaacaaggaaggcccaacatcatatagcgaattaagggtgttggttgactcctattgtgccttgcccagaatccaaagtcgatgctctttccctgacatcctgttgccaatgcaggccagtcttgtcatgaaagattatggcttatgtttttaagcatctgtgtaagttgtacatttaaagtcagccaattttgtgttagcaaatgtagttacatactgagctctcttaataaaaggtgagtgataatagtttgtgctaagagatagtatcatatttttaggaagttttgtaagtctggggaggtgatgctagtcacttgaaaagattttattaggggtgaagaagttaagtgccaataagattagtttttgagaattacaaaatttttatagaaggtaagaaattcaaaaggatatacaaagacccatgaacaggaacaacaaaaatgttgcagagttcataaacacagttaagttatgttataactattaaatggctcccaaactataagactggaatacctgtatttgcagggaagctaaaggcatggtgcattttttgaggaaaatattaactgacgatgaaagatggcagtttccaggttgtactaggaatgttgttgcaaagtgtacaatgcaaaatactgtatctcagagattcaagaaatgatgttatgtcaaaacctcagatgaatagtttttatttgcttgtttctgctcatgtcatcattcatgttatttcttcaagctcagagacatatttttatagaaattataaatcatttttgagattgctgtgtggaataagataaactctgaactctggtgtaagatagcaaaggatagcctaatcaattatgatgaattatgtgagaatggggtagatggaatagctacatccagtggggcaatttaggctctggcataaaactcaggaacaagagaggagaccgactccagtgcagcagagaaaacctgccacctggagagtacacgtcagaccacagatgatggcttctaaagcatttaggactctaactctggatatcacttggataggctctcaacatcccagaatgagaactattaagagaaatacaaatcctaggagggattgaggtactagagaggttatcaagagaattacctagttacctaaactaagacccaaggtgagaaatgagtatctgaaacaggtaaaagctttattgttcagaaggtatccaaggactgagcccaatttgcaagcaaaatgttttgatgctgagtccaagggagatggactcaaatagaactgtttcctgcactaaagatagtagcttaggttgcctccataggctgtaaaactggacagagctaaatgcattgattgagttctacaccatggctcatttcagcctattgtatgcttctgttaaaaaaatatgctatgaatgccgggcgcggtggctcacgtctgtaatcccagcactttgggaggccgaggcgggcggatcacgaggtcaggatatcgagaccatcctggctacacggtgaaaccccgtctctaaaaacacaaaaaaattagccgggcgtggtcccgggcgcctgtagacccagctactctggaggctgaagcaggagaatggcgtgaacccgggaggcggcgcttgcagtgagccgagatggcaccactgcacttcagcctgggcgtcagagagaaactccgtctcaaaaaataaaaaataaaaaataataaaaaaatgctatggaattttgctaaccacttcattcatcaaacttgatttactgactctcagctacttccaaatattaaataaaccatctgaagataaaagtgattaataattggcagattcaaacaactgtgaaataagaagaaatgatccataggcaatgccaaaaggtcccaagatatattgagcaatgtcactttatttagaataagtatgtctctccctcatccctccaagcatcttcactgccctcaacatatccttcattttctccctaactcaaccatgatgacttcaaaaaggatgctttttattttggagtatgaaatttgttatgcgtgtatgtgttttatatagcattggcacacacaaacacatactttctttagttttcttaagaaccctagaaggtgtggagcttaatactgggtaacatttattaattcctttcttatgtgccagatactattctaaatacttcactaaatcatatcttcacaataaccctatgaaatgggtattatatttgacttcattttatggatgtgaaacagaaatactgtaacctatctaagaggagggggaagaaaacccagaagtagcaaatccagtatttgtactttggcgtttatcttccacattctgtgtgcttaattaagcattaccccatgcagcctagtttaggattccagaaattaagtgtcggtgttcaactatataagatgagaaactgaggtggtaaatattgatttacccgacagcaccaatttgtcagtagaactgcaattacaagctattttcccaaatcataagccagcactcaaacgatcagatctttctcccattttacatgatgatattacaggcaacatgattattcaggtgtcatttctgtataatttgtgataaaagaaattgttgaccgcatataatcatggcaacaagaaatgacagcttgaatataatcttcttatttcccagagatgtaggttaagcttcccctgcccttttaatgccttttctgatgctgacagtgtcttgtggaaagcccgtggttttagatttacatttctgttctttagtgattacagttaaggcacacatactggtgttcctatacacatacataaaatgataatttacttaatgtttaagaaagcattttactatctgagagaaatggataggaaattctcgagctgatcaacatgccctttgcattttctagaaacaaaatgcaaatgggatattttaaaaagtcacctatcatatatattgaatcctcataaaacgttaatggagtagactatggctgaagtcctcaagtctctattccctgaagatagttaccggtcattaatgtaggttgtaaatgtagcatatgatgagatcaggtgacaggcccaggatttctgaatcctcctctggtattctttgcacaataacatgctcttagctacttgtgcacgtttatgcttctttcttctagaagttagaacacctggcctgtaatacaaactttgggactgcgtcaagggtatttctctactgattgctaaagttagtggttctcaggttgcagtaaaatcatctggagtcatttattaaagacatagattccttcatccagtctccagctgattttgctgtagggaaacccatggatcacattaagaaatacttaatagttgataattaatatatcatcccaagtactcctttcactcttttttgagtgatttgattagttccattggctacagttatcatctgtatcctgatgattccaaatcagtgtctttggtctaattttcctctgtcaaacctagactgttatatatatttattctttcagtcattaattcatgcattggttcattcttcaataaatctttaatttcctggctgggcgtctgggatatagcagtgacaaatcatatttggtctttgtcttcagtgaagtgggtgagaggaatttaattttaaaaattacacaaatatattgtttccaactttgataatggctgtagaagaaaatccaaagtgttaagagagcacattacagcttagaggttacagaaggcttccctaaggaaatggtatttgatctgagatttgaagaatgaatacattgagccaggctaagagaaaggaaaagatcccctcaggcagaggaaatagcatgagccacgttctataggcaggaaatggtatgatgtgtttgaggaattgagaaaaaaaaagaaaaaaaaaaaacaggaaaagcatgtaagagaaatctggtgcaataatcagaggccaccttttctgtgtcttttgaatttttcggagattttatttttactcctagacactatggaaagccatggaagaagagtaagataatgagttgtaggagttatgtcaaacaagatatcctgttgaactctcctcttttgttttgtttttgagacagagtctcgctctgtcgcccagggtggagtgcagtggcaggatctcggctcactgcaacctccacccctccggattcaagtgattttcctgcctcagcttcccaagtagctgggattacaggcatgtgccaccacgcctggctaatttttgtgttttttagtacagatggggttttatcatgttggccaggctggacttgaactcctgacttcaaatgatctgcctgcctctgcctccccaagtgctgggatcacagacgtaagccacagtgcctggcctctccctgggttttctgtctcaacagatggcaccaccatcctctgtttgcttaagacagggttgtcctccttagcagtttatttgacacactgtagtgaaaatttgcacatttcctttttttttttttttctggcttttcagcatctgaattcctttcttattggtgtctccttactagtaggtaagcccttagaaggaagtagtgctctgtgtgctaccacaaagctgaagggaatagaagcgccttcttcccacccctatcagccatgccttgagcacatgtcaaacttggctaactggaaatgcctgcccagaactttgaattgggaggaagtggtaggagatagggataagtagacattgtacattaacactgtacataaactaataaatccaggttaatagttgcagctgcccatggtttaagtaccagtagtggtgaacttactgtagtgagtgttggctgggatctatgtcatcttgactcctatatctcaagctaagtttttcagactttcagttgatttcataatgtacacaatgaactattttctccttttattagcaaaagtgaattttcctatgtggggtacattcatcacctcaaactcagttattgaataaggccgggcaactttgccttctaattgtctctcaatctccattgaacatcggacaacaatggaccattgctgtagcctcaaaactagtctccgtctctatttctttccccatccctgctctgccactaatccatcacgtctcagcatccagcgatacatataaattggcaaaactaaaaatgtctttatataacttttagagtaagggcaaaatgacagcgagcccatagcgctgaaaattgctgttttcctgctgcctccctcatctcctgcgaggcaagtggtatgcctggtacccttggcatttttcccagtgcccgccagtggtcaaccatgactcagccaagcacagtggttaagaccctggcctccagagtcagcctacaagtctttttttttttttttttttttgagacggagtctcgctctgttgtcatccaggctggagtgcagtggcccaatcttggctcaccgcaagctccacctcccgggttcacactcttctcctgcctcagcctcccgagtagctgggactacaggcgcccgcagcctgcaggtcttaggaggttgggcaagttgtttaacctcactgtgctccatttcctcacttaaaatgtggtgataaaataaatacataaaagatgaattttcagccaaaccagtaagtaatcagtagggaggcaacctacctaaaacgcacagacttcttttgattttaaactatttatgagaaatattaatcagaagccaaatgctacagttaccttcctaaacatttcttaactaaaccatccagaatgcattttgggaattgattgtgattatttttgggtttgaattcttgaaagactctgggcacagacagcttggtgaaactggacttagcattaatagcttcagttattgatgttttcatgaaacacaaaaaatgtgcctctgcctgtactctctggctttttaactgtgttgcctcggggcaatttcaacatagggaaccaaataagtcaatcaacatttattgagtgctagtagtgtgatgaactcaagattagggctgcagggagaaggcacatgatacaaacacgtggtttccttccttgatactattatgatccggttcaagtgaattcacaattatttcttgagctgactgttgtgagaggcattgtagctgatactcatattatcattcaattgttttttgaaaatatttattagcacctactgaatgtatacagtgaatgacatcgtggttataagtagaagagaagacacagaaaaataaataactggataattaatgacattacaattaaaatactaattattacctattcattattattagtaatcagcaagaaagtaagacaatgccataaaatggcacttatgcagccaaactgacagaggtgagcactttgcatgcattttcccacttaagccttcacacagcttcagaaggtgcggcagaggttcccgggaccctatgcggccctactcagccttgctctgatttcagctgcagctccggtggaccagagcatatggtcatgctcagcttcatctttcactcaagtgaacaccttcatcttttcagatctctgcctcagtcttctctgatattgagggattccactcagcaaccctcaaccagtaaaggacagcagatccaggataaatgctgcagctttctaccctttgggagggcaattcagggcagcacactgaacccaagtctggaggtcttagctgagtcaagtccctattgtctgctgctgcagcagcggcagcaggttcagtcattcatccttatataggctttttctccacctctacctcattctccctgcccctcttcctgcttccagggaccaccttccaaactacccacccccatgtccgtgtcccaggctctacttttggcaagacccaaattcagacccgaggtcatgactattaatatcctcattttgctcctgaggtgacagatccctagaccattaagctgaatgttacttacttagttaacgccccttaagcagagccagtattcaaatacctgcccctgcggttagttgttatacaaactcctgtgaacaatataaaggtaactgtgaaaaaggtctaactgattgcagtccaggtgtgagagaacttagagataatctcagacagtaaggtcaatcgggtagaaattattgttagtagtagtagtaaataagcaaaaacttttgtataaatgttgaaaactatcacagcaaaattatgtagaagtaaatgtggcttccatcatcctcttcttacccccatctttgtttgtattgctataacaaaatatctgagacagggtaatttataaagaatagaaatttattttctcacagttccagaggttgggaagtttaagtcccggttcagttttccagtgagggctgctctctgcttctaagatggtgccttgaatgctgcatcttccagaaagaaaaaaacactgtgtcctcaggtggcagaaggaggaagtgcaaaaagggatgaactatctttattaagcccttttataagagcccaaaatcctatttgtgagggcagagccctcctgattttattactaccttctaatactgttgcatttggaattaagtttcagcatgaatttgagaggatgaaaacattcaaaccatagtacacctctttttccagtcacactccccagtctcttaggcctgtgatgctgtgtctcccaattatcaagtatctagtagctcattggtctttgcttcatcatcccctgaccttcctttcattgctttgtagaatgagtgatatttatcgtaactgattttcagttgataagctgcatctcctggagatgtttgcattttatgtcttttctattatcaaatggaagcactcctgctgataaagatatttaggcattggaaattcagaagggtgccgtttttggatagcccaggctggagtgcagtggcacgatctcagctcactgcaagttccgcctcccgggttcacgccattctcctgcctcagcctcctgagtacctgggactacaggcagccgccaccgcgcctggctaattttttgtatttttagtagagacggggtttcactgtgttagccaggatggtctcaatctcctgaccttgtgatctgcccgcctcggcttcccaaagggtgaagtaacattattttagcaactgaacacacatcaggctgggcttgaaggaatcatctttggacaatttgaagtttctacattttgacaggaagttattactgatagagggacatagaaccagagcattagttgtaccaaatatgtaggaagatgcacaagtgtatgtgtttgcctgtgtgcatgtgtgtgcatgcataatgacttacctgtacaggtaactgagcaaatggctttcattgatgccttttatagatactatagaaataaggatcaaatattaatacaataaagctttgatatggctgcataaaattaagcataattatagtcaagtatgttatctgcttaacatggtcatgttattatcaaaacaaattatgcaaaataaattatggcatatcattcatgaactttatcatacattttgcttgttacaacatttaatttttccacagggcttgatctttatggtctgctgcttaggtaaatcacttttcttaccccaatgtaaatagctaccggaagtattaattagaaggattttcttgtcttatggcaaaggcatgagtctacatgtcttaaagactgaggatgattatagaatgaggaaatatatgtactttgcagttcagggtcagatgactgctttgtcctgagaggtattactcagttgcaaatgtactcatttattacagtaatttgattcaattggtagctttgctttctctggcattgttcatttttagtatgaacgatttagaaagaatagcaatttgtgtggaaggaagtgattttcatgtcaaggtacgtcaaatcaggttgataggaaaacactcctttgattacaaggccggataaacatgagagatgcttggacaggcctaacagcccagtcatcaaataaacttttcccaccttcctgggtgccttcattgcgttgatgagtgattgctcaggtttgaaattcaggtaactagtagggagttgtttattttgtcataatctatttagcacaaggtatccaatttttgaaaaactcttgcttttaagatgcaacagtagacaacaaaggaagatatgtatatatattgtgacatttcttagaactccaggttttctaggctggaagggaccttctaaatcatttaggccaatcctgtcacttaaaagctgaaataataataagagcctaaaggttaaatattttgtctgagaaaatacaagttattgtgctggaggatttcctagaaactggttctcctcatgtggtcccccatagaagtaataacagtacgctgatattaaaatagattttcctttaaatgaactaatgggatttgcaggaatccggatgggattggagacaattattctaagtgaagtaactcaggaatggaaaaccaaacatcatatgttctcactcataagtgggagctaatctatgaggaaggaaaggcataagaatgatacaattgactttggggactcagggtgaaagggtgggaaggtggtgagagataaaagactacaaattgagttcagtgtatgctgcttgggtgatgggggcaccaaaatctcaaaaatcaccactaaagaacttactcatgtaaccaaataccacgtgttccctaaaaacctatggaaataaaaaaaatttaagatgttcctttaataatggcatagatgtaattaataatgagacttatcgcctcagaacccaccccttagtttataaaaaaaaagatacaaataaaaaatacacaatgtacttctatttaccaatattctgataaaaagctgaaaatgcaaaacataaagtgttcacacattttggaagaggttagagaaacactgttactttggatataccttagttcctaatttttttaattaaatgacaagaaaaaatttttggattattttgctaacttattgacttatcttattgtcgtgggatttttgaactggaatctgtcttgaagatcattgagagcagctgttctcaagcctggatgcatgccagcaaaattttatatacacacattccgtgaaccacacacccaaggattctgattcagtgggccccaagaaggacctgggaataagtattgtgaataaaatcccctaaagttttggagactggccacgttggagaatcctctatctaattcagtcctcttgttttgcagatgagaaaagccaaaacccagagatattatgtacctgggtaatttttaaatgttaggacagcacatgatatggtgagagagggatctagcacccctcaggaaaatggtccaagcacaagccaaatgaaggttctcacagtgaactccttgagcataggagatctgtatgtcctttcactcttcatttctgtgggctagaagaattatgcaaaagcaatgagctctctaatataagcctctgctatatacagtggggtttcatcacagggtcattgaatttagtccaactttgctggcaaagacaaagagaaaaggagatacagataatgatttaaatagtgctagcgatttctctggccaatccattctgcgagcttttgttccagaatggacttccctggcttgctgtctgtcccaggaggctgacccctgtgtattggatcacccagccttctttgccagcaggcttgtggtcaagtttgcaggtcaaatagcagcagggaaaggtcagagtgtctttgctcactccctgttttggtgcctcagctctagctgtaagtgtgtgtctaccatttactgctgtaagctactgaagcagcttgtgttgggcaccgagcacacaatttcctccttttgtcttaggtgttaggcatgacaatcattttcttgtgtacaaagtctgtctctctctggggccttaccatctctttttgttcccttaccttatcttacacctctgtaatttatgcttttgttaaagaaatctatttgaattagtggtattaactctgttttcttcaggcacctaggttaatacaagatgggaaatataattgtttctctcaataattctaaatttttgagtttccttaaaaagtcactatctccttgaaccgaaaatgattaatgtttaagaatacaatgatgtgaaattcttagtgtatttgcttgatttgcatggtacattgctgtacattttatcatcttgcatgcatactactgtacagatttgttgatacaaaactatacacaatgtactttgtgaactgtttaagatgttttgaaagataattttgactacatgatctttactccttagaagctgacttcagaacctcctcagtggttgcagttcagtttagtttgtttcactgtatctatcacaaaagattttaaacctgggagactactctgaagtaagagaaccgacgtagaaataacccagtttatctaatccttttaacctacagtttgctgtggcctaggagtctgaaactcttcttcccaatgaccacttcaaaatgcctcccagaagatataaactagtacatccacttccaaggatgatttggcaatatttagcaaagttttaacatacccttcttccattgtttttttttatgaatgactcttcagatatacatttatagggatattctttgcagcattgtcttatgaaaaacagtatacaacctacacatgtctaaaggggccttgttaaaaaatgtataatgtacccagaaaatgtattagtccactttcattataaaaaatgaggcatacctagatgcttgcgatatattaagtcaaacaaaaatccaaagtgcagaatagcatgttacatgattacatatacacactgtatctatttccctttatatcttcctatgtttttatttttttttgttctttctaaacatcataggcatgcatgatttgtatagcaaaaatcaaaatgctccagtgatggtgatgagaatttggaagcacccagtaaacactgttagtcagatgacaaacttcataggaactcattttctccaactgagagatccttctgtatgggaagctccctctaaatttcactggccttcttctactcactttaaacctagagcccattcttagatgcatgcacctttgtcactgtggaggtgactggatttctgacccgatttacagagagatgcctgtgtcccagcaccatcactcagagaaaaacgtggaagccaatttgcacaggcatgggaagttttccatcaaccaagatagcagaaacacaaatgagaatagatgagcgcacccaatgctaggaagcagagagtctggggcaaaattccaaaaagccgagccacttacagaaaagtttcacaaggtggggaggtattgcaacaccgagaggatgatttggattcttacgtgcagccgttggatgccagaaagatagagaagatgaagatatggtcatacatttctgtcttgagaagaagatctggtagtaatacttcagggattttgtagtcttcccatctaggaattgaggttataaagaattattgtcattctaggtgactgcaagccaagttgagaggtttctctaaagagaatgaccccttcctttctgaggacacttgattgtctctgtcagccttcagtcttgtattcattctcaatgaaccttagaattccaggatgtgagaaattaaccgcaagttgttactgataaaagcttcaaagtttccctggcaccctaatatgccaaggctgaagatgtctctataatggtctaattcagtggttttcaacttgaggtgcgactgacactactgggcagaggccaaggatgctgttgatcattctgtagtgcccagggcagcccacaacaaagaatgatctggtgcagatggagaaatcctgatgttgttcaaatccttcaatttacggagaaagaaactgaggcccagaaatgttatgcatttcctaaagccattagggactgcatctctcacttaacgcgctcaaaagtcgttctgtctcagttcttcagaaacttcttttggggactccttccaatgtgccagtaatataaattcactcagctttgatttccacatacatgaaaagaggggagggatagagcccaagtaactttctgctttggcctgagcctgtccaggagaatgtagccattcttctctgtgttacctctccttagcagcactagatgcagttaaatctgtttctctcctttcttctcatccaccttcatctgtcattcctgtaatggatggagttggggcagtttgctaaattgtagcaaaatttgaggtgttcaaagaccaaaacagaatagataacttccaaagttcttttgcctctgaatttctatgactttatgaacatggaaaaccttcggtgattcagttgagaggattctgggaaagcagggagagtcattaaatgaatggaccttctgctcttaagtcacgagaagcaggccactgtgcctgcatgaagggcaggaatgccaagaaaatgggcctgctgtggatactaaatgtaatttattttatatgatttgggctactgaaagacctagcattaaggggagacctgtcctaagtatttctgtgtgctttccagttaaaggtgttcctaaaccttaaatgcttcttgaaagagaaatagctgccttgagtttagcaccactgcttccatctgttttgagtactagctacctttctagtgtctacataattttgcaggtttcctgttctacagttgttgcccttttaggcactccggtgatgtggtttaaagtaggtgcttcacagtcagaaagatacagttttttccaccctgagcatctccacaatgtgccgtgggcaaatagtttaaaccgtctgttccctaccttctacagctgtaaaattgcggtaataagagtatttttctcattgatttatcatgcaaaaataaaaaaaaattgtccaaaaggcttagcacaatgcttgtcatttggtaagtgattacaaggccaataattgtttcactgttttggaggaaaaagcaagtttgaattcatttatacatcaaaatgaatttatatatatttttttaaattacgctagtatctatatacatttgacatatggtaggagatacttctaacattagagatttgattggtctgtttttggatgtggtgttcacttattagaatagttgtctgatttatataagatactcccataaattcttctgtaagtgatctaacgccattcactttgcacttagggacaaaatggttaggtttgccatttatgcaagtgctgttatggagtacattcatttgggcagttttctttgtgtactattaatgtattttttattaatatttgtatagtatataaaatttagcaaatatatggaaatctgtattcttttaccaaaaagtgagaagtgtaaaagcaatggaggttttttgctgtctttgaggcagcttctgagcaagtacattctgtttacatatatcattttaaaattaatatttaatttattacagttaccttaaaaatagattctcttatgcttttatgttatacttgtatgtatatgtgtgtgtgtatatacatatacatatatatatatatatatatatatattttttttttttttttcctgagacagagtctgtgttgcacaagctggagtacagtggtgtgaccttggcttactgcaacctcctgcttccctggttcaagcaattctcataccttagcctcctgagtagctgcagtagctgggattactggcacgtgcaacaatgcctggctaatttttgtatttttagtagaggtggagtttcaccatgttggctgggctggtctgggattcctggcctcaaagtgatccgcccacctctgcctttcaaagtgctgggattacaggcatgaaccactgctactggccccatttgtatatcttattctgttttaaatataggagatgttagcaatcacttgttaaaattaaggaggctttaaattaatgttatctcccatttacaaatgaggttagcaaaacaatttttaactttttaaactgcagttatacttgaaaatatttagttttctttatgaaaactttgataaacagaatctttccaagtgattaagtgattctttaaaataaattaaacttatgaagtcaatatcaagttatcttaaacatctcaacactgtttaagaaacctaacagttctctttgaataactaagatcacaatttcaaaatcaattatgtttcaatttagaatccaaagactcctatgtttaatcaaattatcttaagtatttctaacattttaatacatataggttatttccatttttacataaataattttcatgaacttaacacagttacaatataattgtgggcttgatgtagcctctctgtggtaaattccaatcctttctgtttaaagaatggttgtactatcttgggccagtaaaggctacaaattaatggaatatatggggtctagatgcagttgattctccacatgtcacttacctacaaatcaacgtgctttttataattgctatagcaacagggacctcatgccctttagaagacattgtgccccctcctgcattcagattattgttatataacatttctgtccagtctcatcgagattgtttgtaatttttcttcactgttttgttcggttttgcacttatttgattctcttagtatgttttaatgttttctcatctggctcaaaacacattttctttccattccatcagaagtttcacatgcttatgtaatacttttgaaacttcatttaattttatttgcctgatttgagttgtcaaaatattctagattcttttcatattgttcctgactggcagggcgacaatgaaacagaatgacatgccattggtgttgcatatcccttgggtctttggctccacagatgacactaaagtcaagctaatgaaagtaaggaaaaataaccaactagaatccctccacacagatatttctaccattgactttgagcatgttcacttccagttttctaagcctgcagtgttccagggctcagttcttggactcttttttttcctatttatggttgtatattttcctacttacactggcattctcggtgatcccatttggtcccataactttgaatgccacttgcgtgctgaagatgaccacgcttatatttcctagtatgaacttccctcctagactctagcctattaggatgtaactgtttccttgactgcttcacttgggtgtctagaatctgatgacttcttacatgtcactcccccaccttcatttgcttccctttccagccccccatcctttgccttcatcatctctgcactggatgcaatggcctccctgcttcttcccttgacccccaccagtagccagagtgaggctgttaatgtcagtatgtcataatgtcatcctcttttcaaaactctgcaatgtgcctcccccaccccacccccattttactcagagaacaagccaaaccccttactgtggcctttacgctctttcctcattacctctccaagctcctttcttgttcttactgctgaaaccttcaatcactctgttctagtcacctggattcactatgttcttctagtttaccaggctcattcctatgggtaggtttctcccagaagcagacagactctaagacagggtaaatgcaactagtttatttcaaaggtgatgccaaattaaaactgggagagagactaggagtcaggtatagaaaggaagctgacacaagatagacttaggctgtaggcaggtgggtccaatcccacttaagaaccctgaccttgctacttaaggtgtggtctgtgaaccagcatgatgctatcacctgggagtttgttaaaatgagattcaggccccaccccagacctacttaatcaaaatcttgttaaaattttaacaagggcttcaggtgattcttacaccctaattaatgtttgagaaacactctctaggggacagtgtggaacatgtctctgtgttatcctacacaggctgggaaagctgggggtatttttcaacaactccctagctgtcattggttgagttttgcttccagggctattaacttccagcttgccccaagtactggcttaggatgctctttggcctgaaaataaaggcctgctggaagtgagtcacaggtgtttgcagtaaactgtcttcaggtgtgtagaggtgagcacccagaatatgcctatggtactaacagtgtctgcaactgagcctttgctgtagctgttctctcagcctgaaatgttcttgcctcaggtattcacttggctaaatcctctacctcctcccagtctttactcagatcatactgtctcagtgagacttatctgtatttaactttgcaacctgcatgcaccaacccagcatacccaattcccctcactctgctctgttctctttgtaattgcacttagcctttgaattcactgcataatttatccacttaatatactcattgtttacctgcttccatggaaagttagctacaccagagcagcagactttgtctgttttgcttattaatggataacgtagaggagctctttaatgtttgttaaatgaatacctttctatattttaaaatataagatggtagtatatataaaactttgtatcctgcatttggcttagcatatgtcacaaatatttcccatatcataaaaatccttaaatatcattttaattggtagtcaaatatttcattgtctctacaaattataattaaacactctcataacacttggcatattttctattttctttttgtgattataaataacacttctctgtatataaatctgtttcattttaaatattatttctttagaataaatgcgtagaagtcaaaatattaaagactaaaaatgactgtcaagactcagagagatacataagaaattgtcttttggaaatattgttcccatatacctctaaccagcaatgaatagacatgcctggaacaccatactcttttcatcaacccaaagctacatagcatagtagttaagagcatgattcggagataattgtcttggatttaataccagctctctgatttatgagttgtgtgacattggccaagttgcttatcttttcctcactttgttcatttgtcaaatgagaataatgaaaataatattacctcatggggttgttgtgaagattaaattacttagtatagataaagatggatatctggtacataataaatgctatgtaactgttagctaataccatattgagacattttaaaattgataaagtaataaatagtactttgtttttactttatttgcgttttgaagttgggggtatagtgccgtcagtgatgaagaggattagttgataagatttgtgtaatgtttcacaatccgatcgagtacatctcaacttagcatgatggtgctgaggcttggcattccaggttgagcattcctaatctgaatatttgaaatatgaaacattgtgagcaccaacaagatgctgcgatttttaaatttggggtgcttaactggcatataatgcaaatattctgaaatcggaaaatattagaagtggaaaacacttcttttcccaagataaggaatactcaacctctataaaatatcacaatacttcagaatcaggttttggagccctagatcaaataattgtcagaaaaatcttatttttgacataaagcatgaaatgaaaatacatagggatttatcactgatgaattttgagcttatcattgaaaatgtgagtccgtagggataacttcaatagtgacttttcaaccggaacacacctgcaggtttaggcaaatgggtaaatatactgatactgctaagaacaaaagttatccctatgaaagaggaaagatacaaatacaaaataggggaagtgaagaatcttatattccagtggaggacaactgatagatggtaaccacatgtcacctggttatttgtcattcattaacttagtggcttagaaaccacttactgaggccgggtgtggtgggtcacgcctgtaatcccagcactttgggaggctgaggcgggcggatcacaaggtcaggagatcgagaccatcctggctaacagggtgaaaccccgtctctactaaaaatgcaagaaattagccgggcatggtggtgggtgcctgtggtaccagctactcgggaggctgaagtaggagaatggcgtgaacccgggaggtggaacttgcagtgagccgagatcgtgccactgcactccagcctgggtgacagagcgagactctgtctcagaaaagaaaaagaaaaagaaaaagaaaccacttactgagaatctactgcgcataacattgagcatcaatgttacgaaagtacgacaaaatgagtctatcacacttcttgtccttaagaagcccactagatgctccctattcagcctggaaacatgactgctgctctataaggaaaggcttataacatgttcttgcctcagaacaatgatggcttcatcccaggactctactaaaataagcttatggtaaatttaccttatatgtggatgggttttgaaatcatacatttttaaaaccatatattttttttcacaaagtggctaaaataattctggacatggaaatttattttaatgcatttatgcaataaaggaggcagccttgagcaacatgtcaatttcatcaggagatcactatgcaacagacagagaatttgggcaacatttacactgcaatttctggagatattaagccagcagatacaggaacatgtgtcacttcatgtatgccttgctaattaaatgtacatggactttgaattttgaagcccagtcaaagtttcccagttctcttttagcagccgtttatttttactctggatttggtcagatgtagaaaccacagaaatggaggctgtaggattctgtcttctctaagcaagtttgtgcttttttcctctggctttcctcttaggtaggagcaaagatgtatgacagaggagtttgtaaacatccagccatttggggtgattcatttggttcttgtcaagggaaacaggtttctactcttgccacaatttctatgcaatcttgtattagttaatgtgtagacaaccagaacttgggataccctattttgggatgatgttttgtccctcagtggggtgtcctactcttttcatctattctgtgccatcatatgacttcatttacatactcttgggtcctggtttgatagatggctctattgacaggtggcattattaaagaccatttccctttgggccttgtatcactcacagcttaggctttaatttcagaataagtttttcctattacaactttatcaaaataaatttacgtaatataaaatccacccttttaaagtgtaaataaaattcaataatttttagcatatttagagatgtacaaccatcaccataatctaattttggaacttttgtcaccccaaaaagaaaccccatgtttattgtcgtcactctctttttcccctgcccccagcctctggcaaccactaatctaccttctgtccctgtggagttgccttttctgaacctttcatataaatggaataatgtaagatgtagccttttgcatctgatttcttttacatattataatgttttcaaggtttctctatgttgtagcacataacagtaacttcattcctttttgtgcctgagcagtatttcatattatggatataccacacttgtctatccattcatccctctatatgctgattggaaaaagctatttccactttttggctattgtgaatgcggctatgaatatttgtgtacaggtttttatgataacatatatttaaagtttccttggatgtagatctagaggtaggattacttggttcagtggaactctttgtttaactgtttgaagaatttcccaactgttttccaaagtggctgcacaacctgacaatcccaccagcaatgtggcaggcggggtggggggtgtgggggagttccactttctccacattctcaccaacacttgttattacctgacttttttgttatactcatcctgttcgtggtgaggtggtatctcattgtgatattttttaaaataaattttattgtgcatatttgaggtttacaacatgatgttatcagatacatatagatagtaaaattgttattatagtcaagcagattaacatatccatcatctcgtgtagctgctagtttaaatttgcctttctctaattactaagggtgtttttccgtgtgcttattggccatttgtatatcttctttggagcaaaatatatattcgaattatttgcccagtttttagtttggttattttttctttttattgttgaattgtatgatatttttatatattctagttacaagtcccttatgccatatgtgatttaaaatattttctctcaatctgtgagttgtcttttcattttcttgatggcgtcctttgaaacacaaaaattttaaattttgatggagtgtaaattatcaattttttctttttttgcttgtgtttttggtatcatagctaaccattgccaaatccaaagtcatgaagagctatttatatgttttcttctaagagttttatttagttttcagatttgttttgagttaatttttgcatatggtataaaacaggggtttagtttcattcttttttatgtggatatctagttgtctagcaacatttgttgaaaagatttttctgttccccattgaatttgtttaacaaccctgttaaaaattcagaatacttttaacctacacatttttcttaaaagatatttattggtgaatttccatcttttttttcccctgaataatacaattgctctcttcagtataaattttatatataagcattgatgcccataaatttttcagagcacctgttcttaactggaggtggaattattaccatgtgtggtggggcctctgaccagtgggaggtcgcagtactttttcctgccactctagatgaactgattctgtggtgagtcataccaatggggagagtaggagtagctaatacaacctgactgcctggctgaaatctgtttttcttaaccatacacctgaggtgtttactgaacaaagagtaagttattttagtaaataaataatctctggggaaatacttcgagattctgagaatatcctatttttcatcagtcttctacaaactagctttagcatccattgataattcttgcttgaattgataattaccatcaagtttgcaaaatgatggtttttctaattctatcagtctttttacatgtattaattggcactcttctataaagaagattttatcatctcctttaattctctttttaaaatttattgtagtatcagtatagattccagattcattcggtattcaatattctcatccatttctatcatttctcactttgatattcagttgtctcaagtttgctgtttttttaacccaacaatctatcttagagattacttcagtactttatggagatctttgtcattgtctttattgctacataatacccctttctgtggatgtaacaaagtttaatcctgccaatatcttgtgaattggtgtctaataacttaccacaacaatgaatagcactgtagatgtatttttctatgaggcgtgtcatcagagtaaatacctagggatttctgggtcagtgtatgaataggcttgttaggtttagcaattattctccatagggattacatcattctggattgccattagtaatatatgagtatgcttgtttttccagagtctcatcaacaatgtatattgtcaaacttctatatttttgccactcaattgacatatttcaacgtaattttaatttgcatttattttattgtgaatgaaatcaataatcttttcatatgtttaaagattttatatttgtcttattccaaaccaccagtgtatatagttttgttcatttttctagtgggttttttccttcaaactttaaaaatatttttatattggctattagccttttttgttgttgttctagaacatagacacttttttttacttttttattgtggtaaaatatatataacaaaactcttttaaccattttttaatttttaagcttttcattgaaatataacaatatagaaaatatataaacagtacaacttataagtacactgctcaatcagatttcataaactgagtacaagtacactcttgtacccagtatctgggtcaagagcagaatattccaacattccagaaaagaaaagaaacatgttaaaaataaaagatttctattaaaaaaaaactagacatagtaattcagataggggtaagagacacaatccctttatccctttatacgcatgtaacatatttatatgtaattccatatatacacataaacgcactctataatgtacaatgtccaaaaatgggttcacataagattttctaagcggtatttattttttaaaaagttacgtggtaataatttggagacagatgattaagactagtcaaacaggtttatcatttaagaagattttcacaaattcagacttcagggcctattgcctgaccatctcaagtcaggaaaggagtgaggagaagccttcttacccattttaggtacatttttaaaattatgataaaatatacataacaaaatttaccattttaaccacgtttatgggtacaattcagtggcattaacattcagaatgttgagcaaccatcattaccattcattttcagaatttgttcatcccaagcagaagctatgtacccgttaatcaatagccaacccctacccttccttctccccacctgtctctggtaaacactgttctcctttctatatgatcttgcctatgctagtacctcatataagtggtatcataattgatcttttgtgtctggcttatgtcactaagcataggttttcaaggtttatcctgttgtagcatttatcagaatttcatccctttttaaggctaaataatattccattgtatgtattgtaccacatttgtttatccattcacgatagatatttgagttgtttccgccttttgctattcaagtaatgctgctgtgaactttggcttataagtatctgctttttaaacatttgcgcaaatccatcctcaagtatttttgttctataaataaacttttcgaggcatttcacaatttagaggtcaaatagaaattaataataacatacatttttaaatagttcaatgttttattatcagcattcatattttttcaggctgaagattcagggatgaaataatgggcaaaaaactgaaatataattaacactacacaggcatatcgtaagtataccgtaatattttgctaattattggtttagaaaaatataaaaccaagaagtacataaattactttgtttttcatctttctgaatgtacttttacgttaaatacacagcaagtgcttatacttatttaaaggtaatcctttttttatcagccaaaacatgcttatccttagttaatcagaattcatttcaaaatacaaaacttcttaaatataagcatggcatgtagggctttagacccatactcttactggattggctgcttgatgattgttctccttcttttgtaatttcaatctcaattttggctttgatttttctctcaatctatttggagaccttctgcatactgcaagtattgtttatgtttcctctttaccaaatgtctccaaaaacttttcttttgacagtaagcaacaaccgtatcaacatgtgttttgtattttgcagccaattccagtgcccttttcagttgtagagattaatattgatctggattgcttgataatgaggccagcctgaagaagtgctatttcagcctcctgtatgtttccactaaaccttagtatgtgggccattttttgactctttaaatggaagactttttatagaattgatgtactgaaacttatcaatttcgccaattgctgcatagcctatttctgtcatagtaatattttgattagcaactgccatagcagctagacaagctcacattgtttgctcctcaacaaagcagcaaagtcttacatcatcttcccattttgaactgcctccatattcagggagaataacaggatatggtgatacactgatgtgaaccagagggccgttaactcttgttatagttacctgatttccaacaaaactcacaatttgggaatttttactgaattcgtttgtatccctttcacgtaatgttttaggcaaagtgtcactgtccacataaaccatattggaataataccacactgtaaattgagtatcttgaagcctgcaaaggacattgcatgtatcactccaggccaaagtatgcaccattgttccaagtttgagaattttttcttccttcccaaatcgtttcacagaagtgatatagatatctctatttttatcaatgaaagtgacttttctatcattggtaagtcctttttgatccagagcaattttcaagattgcatccttacgaggaagaagctttccatcatctaatagttttccagttgataccttgaagaaaaagattattttttcatcagctttgtctcattgctatggtatcattactcagagacacagtctgtgcattcagaatatgtgttctcactgcaggaaattttggagatgaaataaagggcccttcatatgaatataaatcgatactactaacatctacaagaagaaaatgtctttctgcctgcaggataaaactaacagttccttctttgagatcaaatataattggtgtattccagttctttgtggagaccacataacattgaagagacattgaaacaactaagtgtgcagagttcaaagatactttagtggccatgatggaattccaataagttcactgcatcattaagaatgttacgaacctgtatggtccttcttttagttaatattacttgaaactttttccactcccagtgtttttccaccacaggtgcaaaaacaacatgcccaattccacacactccagcagtctgagtgccgtcagttgaccacgcaatattaaatatgctaccagtgtttttctaaagcatgtgatcacccagttttattacgtaagtgtaaagtatgaaataatccaatagcaaacaattctccatctggagcccaggcaactaaagtaataggatgctcatgagattgtgaattgtacagtgggtggctgtaactatcccatgccttatatttacagtcttcaccagcagataagattattgactgagttccaatctatttttaaaatgatgccatcataagccttctgtaaaactttagcatttgatcgaagaggtttctttttgtgagacagagtctcactctgtctcccaggcaagagtgcagtggcgtgacctcggctcactgcaacctccgcctcccaggttcaagcaattctcctgcctcagcctcccaagtagctgcgattacaggcgcccgccaccacgcccggctatttttttgtatttttagtagagacaggggtttcaccatgttggccaggctagttttgaactcctgacctcaggtgatccacccacctcagcctcccaaagttctggtattacaggcgtgagccactgtgtcggccactgaagaggtttaatgattagctgcttgcctgctgtataaagaacattttctgaatcaggaccccacactactgaataccattcctcagaaggcactcctcctttttctgtacttgataagtatattttctgggaatattctctgggagtagtcaggagctgacctgggcttgctgagctaaagttgatctaagcatccaagtctttgaccaaatttttatttgtccaccttctccaattgtaactaatgctgttgcttcatcattctatcttcctgcaagtattctccagagtgagctgctacacttttttccactctttctaacttggaaatcaaattaaatttatcatcagaacttatgaggacaaagctttctgcttgaatttgtctcttatactcaaactctttggaaaccggtgaagatctatagggtaaatatcatcaggaagctttactatttgagttgttccactagtgaacaagttcctcttcactatctggtgatcatcactatatgaatacagcccttcagcagtagtccagcctacacagcttactaattcttgatgctttggttctcttaaaagagatatcttcagtctcatgactccacttccagcaaaaatttaaaatgccacttgattgtatttactcaagttccaggaaagcagtggcaattgctttcatatagctggtaccagttaccaagaagcctctcgatctcctggtcaccatagtgacttcttgactattagtcttttaactatgatgtatgttgcaaacattttctcccagatttttatactcttttattgtgattttcttttttgccttatagaaaattcatttttatagagccacatttatcaatcttttattgcatctgtattttagacatagaaaggttttccccacactcaggttataaaggaatggatccaacttttttttctaatatttttataacttcatgtatttcatttgtattcttgatgcatttggagtttattctgacatatggtataaggaatggatgcaatttcatcattttccaaatgattatagagtgtcttgacactcattatttaaaaagtgtactttttttatctggtggattgagttgacatttatataatatacaaacttctatttgtatttgggttttttttcctggacttcctaattttttccccactgcttagtctctctattcaatgtactatatcacagtctttcaaatatagagactttagtacatatttcagtatctggtaacactagctgctgatcagatagctgtggttctatgatggatatgatttttcattttctaacttcattccgtatgtttctgttatacagactttatttatttatttatttatttatttattttaatcaggtgaatttatctgctggcattcgtgttttccagggcctgaagaaagtggattgagctcgtttaaggactatactccattctttctttctttttttttttattatactttaagtttttgggtacatgtgcacattgtgcaggttagttacatatgtatacatgtgccatgctggtgcgctgcacccactaactcgtcatctagcattaggtatatctcccaatgctatccctcccccctccctccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctacatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttgtagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagactttaaatctcacttgctgactttgaaaatttttgttggtattttacagaggttgtaataaacacatggattgaatgataaatgacatgtttatggtgttgaagtgttttatccacgaagaaaggatggctttccagttgttaaaacctatcttaagtttttaatattcaactctttatgtgcttaaatttgttttataagttgtttccttcctgggttgtaaaggttgtgctttaatcatttatgtatttatttagttagttagtttgctttcacttgtcacctcgaacaatgtctttaatatagttgttaatttgattttataagtatccagtgacagaaatagtactcagtgatgtggttactatccagctaaaaggatatagaaaagtattaggttggttgtaatggcaaaaatccacaattactttgcaccaacttaataaatttagaaatccagttgactcttaaattttcttattattgttattatcttttaagatggagtctgactctgttgcccaggctggagtacagtggcagtggtgtgatctcgacccactgcaacttctgccatccatgttcaaataattctcctggctcagcttcctgatagaagggactacaggtgtgcaccactacaggtgtgcgccaccacacctggccaatttattttttattttttattttttatttttagtagacatctggtttcaccatgttgttcaggctggtctcgaactcctgacctcaagtgatacactcacctcagcctccgaaagtgttgggattacaggcataagccaccatgcccagcctaaattttcttattcttaactcagaatgtgttctagaactttgaaactgattttgcaaaaatacgaatgtaaattccacagttaacaaataacctgagtgtcgcattatttataaagctttctgtgacatgcttccctgcctacctatatattttttaatttatggtttttattggctgtatattagatacatatatttatggggtacatggcatattttgatacagacatacgatgtgtaacaattgcatcagggtgaatggggtgtccatcacctcaataatttatcctttctttgtgttacaaacaatccaattatactcttttacttatttttaaatgtacaataagttagtgttgactgtagtccctttgttgtgctatcaaatactagatcttatttattctaagtttatttctggacccattaaccatccccacatcccctttcctacccccaactacccttcctagcttctggtaaccaccgtctactctctatctccatgcgttcaattgtttgaatttttagctcccataaataaatgagaatatgtgaagtttgtttttctgtgcctggcttatttcacttaacatagtgactttcagttctattcatgttgttgcaaatgacaggatctcattcttttttatagctgaatagtgctcccacttttcttcatccattcgtctgatgatagacacttaggttgcttccaaatcttggctattgtgaatagtgctgcagtaaacatgggagtgcagatatctcttaagtatactggtttcctttctttgggcatatacctagcagggggattgctggagtatatcatagctctatttttagctttgaggaacctccaaactgttctccatgatggttgcactaatttatgcctacctatcatttgactgttctttctctgcatctccatgtaccacatagatggttctgtattagtatccatcccactctagtgctcttgtcaatctctccctcttagactgtaagctcattggaggtattgactgtgactgatttgtctatgcatcctgctatcataatacctatcttaaggctgccctcgttaaattgtcacaggatgatttcctgctaacagaattttgtgaatagaattaaatgttatgaatctagaattttatactgtaaaaacatgctgatataccattgcagaatcaagaagataggatcattaagctggatgttcagcatctacttgccatttataatttaaatatgggaatgtgacccaaatttgaaggattttcttcactccttaagaacttcccactttctctactggttttataatgtactatgttgactattttcaactataaaggcatatcacagtatcaattatttgcattaaacctgtattttctgtctataccctgccaagtaaatgagagcccaaatgacattttcacgaacatatttattttttgtttttatttttttttgtttgttttctcttgctgacccttaatgaaggctaggcaaaaatggagtcgactttgatgcagtcaattttaatttttgcttagtgctcatgaagtctgctgcccagtgagttgtatcatctgcattgttgtaacatctgaatcaactgtggcctacactgtttgatcaggatgacaaaattgctttatttattcttcttttacagttatagcctgcagataaataggcattattataggggtcaagcttgatcatgctgcttgttatattacaagattttctctgtgactacaatggcaaattgattagataaaacttattaacatgcaatgccaaataattgatttattatactaaaatacctctcatgcctaaatcagttacaataactcatttttagtatggaaaaatcatgcttatgcattttggggtttccctgaacactaaattagctacttaggaatttgtccttgccaactcaattatcatatcatatcattagtcttgtcttcttttctgtcatttctctagtaaagttacatcagactaataattcaagtatactgtggtgagtgcttaccttgaaaaaatatatttcttgagattctattttttatttaaatattctttttatatgcactgctacaaaacaagcaagtgctattgttgtactgacaacagagatttatttagcccctccagctgatcaactgagggattttagtttgtagccatgtctagacaaaatgcaaatgtgagtatttgatgctttttcttaccatcagtatgcatttggaaagtgttaagcattacttctccgggttgtttcatagaactaattatcaagatttcaaagacatctttgcatagatggtgttttatttttttggaataaatttatccctacatttgttttctagaaagacattgatagagtcattctcataacaggatgggatggaattaaggtaacactaatagggaatgaaaggtcatgaaactaaaatatatgttttgcgtccaatgggtacatttatcattgacagctggaaatttcaggacacctgatgatgaaagaagaaaaatactcaaaatgactgcaagagagttgtgggtactctcttcacatctactggataccttccattagcttctgtgcttctccgcatgatttctctgattacaagagcatgtaagtcccaattgagtacaagcaaaaaaatgtcaagaaattaacatccagctgaggaacgcagctcctcaccagcaacggaacaaagctggacggagaatgactttgacgagttgagagaggaaggcttcagaagctcaaactactccgagctaaaggaggaagtttgaaccaatggcaaagaagttaaaaactttgaaaaaaaattagacgaatggataactagaataaccaatgcagagaagtccttaaaggacctgatggatcagaaaaccatggcacgagacctacgtgacgaatgcacaagcctcagtaaccgatgcgatcaactggaagaaagggtatcagcaatggaagacgaaatgaatgaaatgaagcatgaagagaagtttagagaaaaaagaataaaaagaaatgcacaaagcctccaagaaatatgggactatgtgaaaagaccaaatctacatctaattggtgtacctgaaagtgatggggagaatggaaccaagttggaaaacattctgcaggatattatccaggagaacttccccaatctaacaaggcaggccaacattcaaattcaggaaatacagagaacgccacaaagatactcctcgacaagagcaactccaagacacataattgtcagattcaccaaagttgaaatgaaggaaaaaatgttaagggcagccagagagaaaggtcgggttacccagaaagggaagcccatcagactaacagctgatctctcggcagaaactctacaagccagaagagagtggggcccaatattaaacattcttaaagaaaagaattttcaacccagagtttcatatccagccaaactaagcttcataagtgaaggagaaataaaatcctttacagacaagcaaatgctgagagatttcgtcaccaccaggcctgccctacaagagctcctgaaggaagcactaaatatagaaaggaacaactggtaccagccactgccaaaacatgccaaattgtaaagaccatcaaggctaggaagaaactgcatcaactaatgagcaaaataaccagctaacatcataatgacaggatcaaattcacacataacaatactaatcttaaatgtaaatgggctaaatgctccaattcaaaggcacagactggcaaattgattaaagagtcaagacccatcgatgtgctgtattcaggaaacccatctcacgtgcagagacacacataggctcaaaataaagggatggaggaagatctaccaagcaaatggaaaacaaaaaaaggcagggattgcaatcctagtctcagataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacaagacagaaagttaaccaggatatccaggaattgaactcagctctgcaccaagtggacctaatagacatctacagagctctccaccccaaatcaacagaatatacattcttttcagcaccacaccacacctattccaaaattgaccacacagttggaagtaaagcactcctcagaaaatgtaaaagaatagaaattataacaaactgtctctcagaccacagtgcaatcaaactagagctcaggattaagaaactcactgaaaaccactcaactacatggaaactgaacaacctgctcctgaatgactactgggtacataacgaaacgaaggcagaaataaagatgttctttgaaaccaacaagaacaaagacacaacataccagaatccctgggactcattcagagcagtgtgtagagggaaatttatagcattaaatgcccagaagagaaagcaggaaagatctaaaattgacaccctaacatcagaattaaaagaagtagagaaccaagagcaaacacattcaaaagctagcagaaggcaagaaataactaagatcagagcagaactgaaggaaatagagacacaaaaaacccttcaaaaaatcaatgaatccaggagctgtttttttgaaaagatcaacaaaactgatagacaactagcaagactaataaagaagaaaagagagaagaatcaaatagacacaataaaaaatgacaaaggggatgtcaccaccgatcccacagaaatacaaactaccgtcagagaatactgtaaatacctctatgcaaataaactagaaaagctagaaggaatggataagttcctcgacacatacactctcccaagactaaaccaggaagaaattgaatttctgaatagaccaaaaacaggctctgaaattgaggcaataattaatagcttaccaaccaaaaaagtccaggaccagatggactcacagccgaattctaccagaggtacaaggaggagctggtaccattccttctgaaactattccaatcaatagaaaaagagggaatcctccctaactcattttatgaggccagcatcattctgataccaaagccgggcagagacacaaccaaaatagagaattttagaccaatatccttgatgaactttgatgcaaaaatcctcaataaaatactggcaaacagaatccagcagcacatcaaaaagcttatccaccatgatcatgtgggcttcatccctgggatgcaaggctggttcaacatatgcaaatcaataaacgtaatccagcatataaacagaaccaaagacaaaaaccacatgattatctcgatagatgcagaaaaggcctttgacaaaattcaacaacgcttcatgctaaaaactctcaataaattaggtattgacgggacgtatctcaaaataataagagctatctatgacaaacccacagccaatatcatactgaatggacaaaaactggaagcattccctttgaaaagtggcacaagacagggatgccctctctttacccctcctattcaacatagtgttggaagttctggccagggcaatcaggcaggagaaagaaataaagggtgttcaattgggaaaagaagaagtcaaattgtccctgtttgcagaggacatgattgtttatcgagaaaaccccattagcctcagcccaaaatccccttaagctgataagcagcttcagcaaagcctcaggatacaaaatcagtgtgcaaaaatcacaagcatttttatacaccaataacagacaaacagagagccaaatcatgagtgaactcccattcacaattgcttcaaagagaataaaatacctaggaatccaacttgcaagggatgagaaggacctcttcaaggagaactacaaaccactgctcaatgaaataaaagaggatacaaacaaatggaagaacattccatgctcatgggtaggaagaatcaatatcgtgaaaatggccatactgtccaaggtaatttacagattcaatgccatccccatcaagctaccaatgactttcttcacagaattggaaaaaactactttaaagttatcatatggaaccaaaaaagagcccacattgccaagtcaatcctaagccaaaaaaacaaagctggaggcatcacgttacctgacttcaaactatactgcaaggctacagtaatcaaaacagcatggtactggtaccaaaatagagatatagaccaatggaacagaacagagccctcagaaataatgcctcatatctacaagtatctgatctttgacaaacctgacaaaaacaagcaatggggaaaggattccctatttaataaatggtgctgggaaaactggctagccatatggagaaagctgaaactggatcccttccttataccttatacaaaaattaattcaagatggattaaagacttacatgttagacctaaagccatgtaaaccctagaagaaaacctaggcaataccattcaggacataggcatgggcaaggacttcatgtctaaaacaccaaaagcaatggcaacaaaagccaaaattgacagatgggatctagttaaactaaagagcttctgcacagcaaaagaaaccaccatcagagtgaacaggcaacctacagaatgggagagaatttttgcaacctactcacctgatagagggctaatatccagaatctacaatgaactcaaacaaatttagaagaaaaaaacaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataagaacacttttgcactgttggtgggactgtaaactagttcaaccattgtggaagtcggtgtggtgattcctcagggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccgcagttctcactcataggtgggaattgatcaaagagaacacatggacacaggaaggggaacatcacacaccggggactgttgtggggtagggggagaggggagggagagcattaggagatatacctaatgctaaatgacgagttaatgggtgcagcacaccaacgtggcacatgtatacatatgtaacaaacgtgcacgttgtgcacatgtaccctaaaacttaaagtataataataataaaaaaaaaaggaatctaaatttaaaaaataaaaaagacaaaaaaaaaagaaattaacatcttaggagcaacctttatgtaacaactagaaaggattggtactagaaaggactagagtactagaaaggtactaaaaaggactaggaagtctagtccagtgtctgattcttggtggacctcacctaagacagtgaataatgtctctgctccctcagaatttaggtggctggaagaaaaatggtactctatttagtaaattttagttgtgcaaacaaaagaaacacctctttgctcttggaagcttgcctccttttttccctggaccagagttatttttttgctaattggatcactctctgttgaagttgggttggagcacaaagaccaacttaaaggcctctgaggaagtatacagcccctatgtccaaatccaaaccttggaatcttacctcccttgtcagcataatggtacagcaagcccttttaggcatgcttaagtaagagagagcaaaggaaagaagacagtggagaaaagagggtgagtttctcaacatggtgcaagagaaagtagaaggagggctctcattctataaaaccttttcgtgagcagtgagcttcctcactgtatgcagcctgataatggctctagaatgccttggaggcagaaagaattaaggagaaaagaaggaaaagggagaagattgaaaaccagaaagagactttctttccccttcattcttagcatgggtatgtcagttaaatcagggtcatggatgtttgtaaatttaaaaaatgcccctcagaatttgggcagcccgtatcaatcatataccaagaacttaaattattcattcatgccaagatggggagtgactcaagatgacttcatatatctcttaagaatctccatcctcagtcgggcgtggtggctcacacctgtaatcccagcagtttgggaggcctaggcaggtggatcacctgaggtcaggaattggaaaccagcctggccagcatggtgaaaccccacctttactaaaaatacaaaattagccaggcgtggtggcaggcacctgtaatcccagctactcgggaggctaaggcaggagaatcgcttgaacttgggaggtggaggttgcagtgagccgagatcgcccattgcactgcactccagcctggataacaagagtgaaactcagtctcaaaaaaaaaaaaaaaaaatctccatcctctgtgtgattctcctaacatggcagaggtcgtagtttcctatagaggatgatcccagcaccacattctaaactgacatgattcttcttatcctagccctaaactctctcaattccatttttcttcttcttttcacaaaactcaactttccaggaagcaaaatgaaactggtcctaaacatgtggtgcttttttacatcattatgttgttgagtgtataacttctacttcaggaatgctttttaccttccatgtggaagtacagtttagtgtaaagcagtggtccttagtttgttgtccttagaccagcagtatgagcatcaacaagggagcttgatagtcatgcaaaattttaaccccacccaagcatactgctgttagaaactctactggtagaacccaggaatctgttgttcaataagcccttcaggtgatcctgatcctccataaattttgggacctactcatgtaataattgaccgctgcaaatactgggaactgagacatgaaaatctcactgtagcttggtgtaagtctagatatcccagttattctaccccatcccctttcattgagagacacagttgtaattacgaatgctcattggtcttgatttaggaagttggtgagaggggaaagaaaggctcattagttcccgttagggataggcctggataattgtagtgggaatagatgaagagaaaacctgtggtatttggtttttttccttccaggatgagagaggatgccttcctatttcaaaatatctcctccacattgactgaaatttcacgaattagagctaataagaaaacattccagaatatgttaaagagtatgtgggaagatgattagtcataaacttaatgtgaattagctttcattctaacctggctgatatgctttaagtaaatgagagtttgattttagggaagggtagttccaaagcaagacacacacgaagctgagtaagaggtgtgtggtggggaagggggcgataggcaagaatttaggatgttagagtccttggagagcttggacagggcaccaagtgggaggagagaagtactgaaggtatatgccaaagccaataccaactgtttccttcatttcacatccctcctaggagtcatcagctctcggtaaaggatagtggttatttgattttttttttaacatcctcacttacttctccctcactcatttttattctcctagattcagaacattggagtttatggaagcaaactggtatttttccagcaatagcatggaaaataaactgcaaagaagattctgtcttgaatgaattctagggaccagtaaatgctacaagaatcacttgaccttttaaaaaatgactagtctttgtgctaagtgtgaaagcaatgctatgcttccattgagttccacaaatctttttggtgcaggaaaatgctaatgggatatagcacaaaagcttcaaggtgggagacacagctgccttagagagtctgtcattgagaaggaggggaaagggccattagacaaatctgtgtggaaatacaggatttttggaggcacaaaggacaataggagtttcatggataaaacacatactgttttttgacacccaagaatttctaagatttggcccacaaccaggtgaaaacaggagatggatttatagagctttcttatccctctttgtgtctagctgctcaccatcctcctacctcaatttttcttcttcttttttttttcagatttgtcaggtctgtcacattttgtgtctagcttttggttaaattactctcacgaaagatacttaacctataaaggtcaagtgcagaaaattgttcagagtcactaacttaaggtcatatggctacctagtggcaacagagagatctatggctccatgatcttgccataatttcatttgttatttctgcctgtaaatagacctactggctctgcataaacatggttgatttgttgctaaaaagattacaaaaataattgcaacctcgaagtttgagaacctgtctctagctcacttaaggtctttcctcacacagtgagggctggcaagttgatgcctcagatttccactgtgctccttaggatcagcagagaataaatttgtattgagtctgcacagtttcattcaatatgcacgtggaagcagtgaaacaaatgcagtgtagctgatttcccaagagatgctgctaacgtgaaccagaagctcattcagaataattaaatggacatattccaaatatatatttactcacatcagtcacttccctccccagtttccggtgcttcttgttcctttgcactcaatctatcagcaggaaccactacctataatcttgttaagagcagttaaataggaataactgcaggtactgtttaattcactttcaggaaacaggctttaattgaagagttcccatcactttccatgtacttcccaaaatattagaggttttaatttgcttttactgaccatcatcatgtaagaaagctttcatggaagaaagtcttatatgaagttctcaaaatcagagaaagatgagagtacttgagaagtaaaatatgtaaataaattcactctgcaaggaattctagctgatgaatattacttttgttatagaaaacttcctatgtttaagattcattcaccccaatggtatccttggaattctgagccaatatctagatctccaaattagatatgcaaaccagactgtctttctcagaggtctggactgcagtaggcatttcaaatgatctgactacgcaggagctcactttctagcttggatcagagagataaacaccaggtaaagtcagaaaagtcctcaggggcccacctctctgttggtggcctgccttttgagccctaacaagggagccagctacaggacttctgctattgtttcctttgagttgccaacagccttagtttccctaagttcccaattccactctccgatatgctttttctgcattatacgatctctgctgccagccctcactattcaccgtttcctcactgcacccttttatatctcctgttagtttttgataatgaaccatgctaaggtgacacagaatatcgggcctgagccctttctttgatatctggtttgtattggtaagcccctgtaagaaacatcccccaaatctcagtggcttatcataacaaggatttattttttgcctacatcacagctcaatgcagattaggaagctgtcttccaagtaagaatgcaagatgctgggctctttctttagggtggctttgccatcctggaattcttcacttccagttagtgggagaaagaccagtacctcacaagaacttttggggtccagtccgttccattggcaagagctagttccatggccccaatctaactgcaagtgagactgggaaatacactctttttgtgcatcttggaagaggaacggagttggtgaacaccaacctactctctgctatcctcgttgctgaatgacttactgacttccaatgaagggagcaatattaaggaatcactgtactggctaatggaaaacaaagcaagcacagtttgaatttaattattttctcttccatgattacttaaccatatcccccaattttactatttattagcatgaacacctatgcaaaattctgaagatccaaattactttaattatgactttgatattacttcagcagttttaaacaaatagaaaaagttcaaaacattcttaacccagtcagcagagtcatctccagagaagcttctgggaatagtttatctcacttttgtggtgtcaataaaagatatgcatggatcatctgaattaataagtaaagagttatagattgattaagatgatagctaatgcttttcctgtcttctagcatgatggccagcagcctagcacataataagagctaagaaatacaagctgatttctttttcccttctctgatgagtaatttctctggtgaacctgagaatggtctttgaaatcccttgttaggaagttgaagcttatgtttgttagagttagtccattttgtgtcttcgctgttttcaaacattttgttttttcagacttggaaatccatggtcaaattcaatatcatctgtgcacttatgtgaaaacacagagaggtgctataggccaaggatttcattcagctctcaaccccactgcaaggtggccacagggctctagagagcactcctccgttgaggaaatggagacccactgaagtgagatttgtgagcctcagaggtcacgtgttatgccttcagaagatgatttctaggcagttcatgaagtttctaggcagtgataggctatttccctattttgagtagtggagaccagagatgaggccagtggctacagtatttgggcactgaaaattgaggaaagggaaaaagtgctgtgatgttagtgctaagatgtccatctggttttgtccagcatgatactccagaaggcaaagtcttgtcccacagaaatatctaaatttaatgcctagattccagggatcagtgctgaaggggaaaacagaaaaattgttttcttttttttttaatttaggaagaatagattttgccacaccaatgcaggatgttaccacactcactccatctaagacatggcttgttttgacagtcttttagcttatagccctggctcatgctgatattttttaatgtaaatgagtttcttagattattaaggcaataattcttccctatactcctgtttggttcgatttgatgactgactgtttttttaatcttggttgaagattcctgaaagcgaagttgcctcaagtaattacacttacctcaaggaaaactgtattgtcgtcacataaacatcatcaaatatttaaatccacgccatatttaaaatgtcttttaatcctttattttatctcctgagagaacagtgtatcttttaggttgacttttaggccaacacactccacacctaattttggattttctagtttcatatttaattaacatcttatgttataaaaatgtttaaatatttgacttgtttcaattgatttaagaaaatgtcctttctcccagagaaggagaattcattatttcagtcaataagtcatgctgtgacaggtaaagcttgtctctatgataatgcatttgaatactgttttaggaaatagctgtaaatgttgcactgtatggacaaaatagaagcataactgcagttttgcagtttacagtttcgatagatatatatttatgagtacctattgtacaaagctgtaggtccataatgaactaaatatttgtatctctctgaagatgctaggggatattcagacttacgtcattagccctctgagattagataattcctaagtcctgacacctctactttttcctgattagaatgaagataacgatccctgtgtccaatatgtgggatgctgtgagacctagtgagctcaatacatgtgaaaatacatgtgtaaaagtgtcaacagtctgactcctttttaaaattaaggagttagagtaatattgccaggtaaaatacaggataaccagttaaattatatttcagataaacaacaaataacttacacttgctaaatctgggaatcttaaattggggttattgagaagcagtctctgtcattttcctaaggaaagagaaatttcccatcccttcaatttcattacctacattggtgactgatttttcaggagggccttttgggagctcctgtagtcagtgttaaggaaagccccaaagttttgaatgtagcagcaacgtaacctgaacaattctatagccacaaccatttaagagattttgataactgattcatagacactttgaaactgatgttcaagaaaaatcatctaatttgttccatttagagatgaagactcaaacccaaagttgtgaagtgtttgccattatagaggtagctagaagaacggctgcagctagaacttccttctcctgactcccaggccaatgttcttcccactccaccacactgggtctgggggctaaatccaagcagccacctgcttttgtaaataaagtttaatttggagcacagacacatccatttgtttacatattgtctatggctactgtaactgtacaatggcaaagttgagtggttgccacagagactgcaaggttggcaaagcgtgtatttattatctggtagtttacgaaagaagtctgccaaacactgctaaaggagaatgtgttgattgtcttcacctcatgattataagtatataactggctttgttcttctaattatcacagaaccatactaaatatatgtattttttcaaaaagcataagctgcacaataccatggatgaacacatagattaactgtagtagtcagtttcagaaaagtggactagaaattgtcagaacttttctttttcctcttaacacttttgatcctataatgagggcaaactacaggattagtgagtaatattgacaggtcaccgtgcacagggcattatatctattttaggcattctgaaataagttatggtgtttggatgctgccatcaagataagtagtaagtcatattaaaaagttcattagacttactttgtattacctagcacatcttaaataattctaggaacacaatgtgatactcagtatatattcatacaaatacagatgcttacactttaagctatcctgaatatcttcagagagcagagtaagagacagaaacagatctaagatcttgtcttagtcttattcctctcaatatggcaatgacaaaggttatcactagaaggagtgcgttcctcttctgtctgaaagtgtttaagcagctccaagatgacctttgggaggttgtagagaaaagggctggactacttggctaaatccctttttgtgcaaaggttctatgataccagtctatgacattttggaagcctcgtgtactgtctcctttgtatcacagtgactggagtcttctctcaggcagcctataaggatagacattcataatatcacaagtgtgtttgaatcctgacccactgtccatgttttcctaacaagactgttttagaagtttgttatgtctgcataaaataatcctgaaaaccacatccttaactaaattgctctcatgtatatattgaaaattattcatggctctatgcttggccaagtttgtgtcaaatgttgttttttattttatttctttgaagctaaagataacttgtcatgggccatgtacttggagaggtacttcgattgcttaaaaggagaagaaagaatgttcaggtcagctcagaaaaacataatttgtttgaaatcatacaagttacactgtaacgttagataacgccttgaactatggtgaagtagatatacctgacctccagggattctgcagcagttactggatctgattttctgtagatagtgaagagccatgtgaggagtagtcctcaatcttctgtaagaacctttctctttccttggccacagaagcaatgaagagaataagcagtaaatggcatttatgccattccacatgctttatacattacttcacttaatccacagaataagttgagtattgttaaccttccgttttataatgatccttagacagttatgtaataagctcaaggtcatagagcttgaagcaaaggagctggtattctgatttaggtctgttggattccgaagcccctactggggcgattttaccacaatgtctcccaccggcaatgaagaatccaagtaacacagactttggctttatgatttagccaaagctatttatagcctgtttttacatcaattcaaatgttttcattaagcccttgctgtgtttgaggcactgagctaattgttacagaaattcagaaatacttcatcaccctcaaggaccctcaaggatcttataatctagttaggcataaaagacatgaagatatgaaaagataactgaaaatggaaggcagcccgtgccaacagctgactaagtggaatatgtaagtgctacaggggcttcaaggcaggcaagttaccaccagctgcaagtaaaagcagaaggaatggaatttgagtctgaatgcagtataagatgatgttacagcccatcagtcagatgaggattgcagtctgtacatcacagtttgtctacagacctgttttgttagcttgcataggttttttttaatcctaaaaaatttacatataaatatggttctgttttgtatcaaatttttcaggatacttggaccatgcatgttcatgtgacaaaagacagggcccatgttttccagttagctgtggcctctgctgtcccggaagctacagtttctcggcttccttcatctacatttctcatgtggccttgtggatatttgatcaagataaggaaagtgaaatccagagagtgaagtaaagtttattaagatcccaactcattacttacaagctggatttgacccaaaaatttcaaactattagtccagttttattttaatagaccacactatcattcatgggatttggttcatactttttggtagaagatatataatttattattcaacatctatagggcctgatgtgtttggaaaggcagtttttttaactttataaagataatactattcctatatgaacttttatgaaagagtctagcagagtctggtgtagcatctgataattaatatttttaacgtgaaatgtatgaatgttcaccccaagtggcagaaatatagactaggcatagccaccaattcagatcagatttttatatcaaatttcctttttttaaaaaaaatttgtaaacttgtaggatttcagaattgcagataaattgtggatagctataaatatcaatattcttgtgtctgttgctcaggatttttatctataaatgcagatagcagttcctacttcattaaatatttaatactatatgtaaaaaacagtgcctagagcatagtaaaatctgtagaagtaatgggtattgttactattttctattattggtatttttgtgtaaaatatgcatttcacaaatcagattattgatatttcttctgcaaccaactcataaatgttaactttcaagcatgcagaggtaccatacacaaaaaaatgagactccatatgatcagttctgaatggctgactccaatccagtgtaggcaaacaatggtctatggggcacatgtggcctgctacctctttgtaggaacagcaagataagaatggttcttatattttgaaatggttgaaaaaaacaaaaagaacactatttcatgacatatgaaaattgcatacaatttaaatatcagtgttcatacataaagcttaattgaaacagtcatgccctttttcacgttgtctctggttgctgtaatggcagcgttgagtagttgcaacagagactacatgttcctcaaagcctaaagtatttataatcttgtgcctttaaaggaaaagattcctgacccctggcctgacttactgctggtcacgatgtctcttgatatctctggctcctcacttggttgcccttctgcttccttgtctggccttcccaatcaaactatttcactctacttggtttcctaagatgaccttagatttgcttctactgccatctgggacatccctccttctctgttgcagaatttgatcttctccattcttttattacttttcccatagactttgtgtctctttgttttcctagttctgggagtggaaagcaggactctgatctatggctgacctagaattaatgtgtggaagtacagggtagtgagcaggggtgcatttcctctgggataatgcagtttgtaatttcagatgttatttcaagcttgtctgagatgccaaacgcccagcctaaaataagccttcatttagaaaaatctgtattttcacaccatggggattttgcttcttagtgtatctatagataaaattggtaataaacccaaatccagggcaactgaattttccatcagaatgcccagcaaaaggcctggtagctgaggctgtcctttgcactcttttgcttcttcaatggagccaatagagcatgaagaggggaaaattgcgcacatcacccaaagagtttggaataccccatgttactatgatatgggtcttgacttgcgtagataacacaagacctttttatcccccgtttctttcaagccactacgttttcttttttcatactttaatgattttaaagggaagttcagtataaggtaggcagagataagatgggaaaggaatttgaattatctgggaactcttaggagaattttgtcctcatttgtcttatgtaatacacacttttgagtcctcataatgatctgaataaaagaacattttactacttgtaggtataattatataactgagtaatgaatttactaaccaaaccttgacgttgccaacaattcaaactgcctttcatccacagcctctttcttcttcttctttttttttaaattatagtttaagtactgaggtacatatgcagaacatgtaggtttgttacgtaggtatacacgtgccatggtggtttgctgcacccattaacgcatcatctacattaggtatgtctcctaacactatccctcccctagccctccaccccccgacaggccctggtatgtgatgttcccctccctgtgtccatgggttctcatagttcaactcccacttataagtgagaacatgtggtgttttgttttctgttcttgtgttagtttgctgagaatggtggtttccagcttcgtccatgtccctgtaaaggacatgaacccatccttttttatgtctgcatagtattctgtggtgtatatgtgccacattttctttatctagtttatcattgatgggcatttgggttggttccaagtctttggtattgtgaacagtgctgcaatacatatacatgtgcatgtgtctttatagttgaatgatttataatcctttggttatatacccagtaatgggattgctgggtccaatggtatttctggttctagatccttgaggaatcgccacactgtcttccacaatggttaaactaatttacactcccatcaacagtgtaaaagtgttaccatttctccacatcctctccagcatctgttgtttcctgacttttgaataatcgccattctaactggcatgagatagcatctcattgtggttttcatttgcgttgctctaataaccagtgatgatgagcattttttcatatgtttattggctgcataaatgtcttcttttgacaagtatctgtccacatcctttgcctactttttgatggggttgtttttttcttgtaaatttgtttaagttctttgtagattctggatattagccctttgtcagatggatagattgccaaaattttctcccattctgtaggttgcctgttaactctgatgatagtttcttttgctgtgcagaagctctttcatttaattagatcccatttgtcaattttagcttttgttgccgttgtttttggtgttttagtcatgaagtctttgcccatgcctatgtccagaatggtattgcctaggttttcttctaggatttttatggctttagttgttacatttaagtcttcaatccatcttgagttaatttttgtataaggtgtaaggaaggagtccggtttcagttttctgcatatggctagccagttttcccaacaccatttattgaaaagagaatctttccccattgcttgtttttgtcaggtttgccaaagatccgatggttgtagttgtgtggtattatttctgaggcctctgttctgttccattggtctatatatctgttttggtaccactaccatgctgttttggttactgtagccttgtagtatagtttgaagtcagttagcatgatgcctctagctttgttctttttgtttaggattttcttggctatgtgggctctttttggttccatatgaaatttaaagtagttttttctaattctgtgaataaagtcagtggtagcttaatggggatagcagtgagcctacagattactttggaaagtatggccattttcacgatattgattctttgtattcattagcatgaaatgtttttacatttgtttgtgtcctcctgtctcatttcattgagcagtggtttgtagttctccttgaagaggtctttcacatcccttgtaagttgtattcctaggtattttattctctttgtagcaattatgaatgggagtcactcatggtttggctgtttgtctattattggtgtacaggaatgcttgtgatttttgcacattgatttcatattgcaagacttggctgaagttgcttatgaccttatggagatttgggggtgagacaatggggttttctatatattcaatcatgtcatctgcaaacagagacaatttgacttcctctcttcctatttgaataccctttatttctttatcttgcctgattgccctggccagaacttccaatactatgttgaatagaaagatccacagcctctttctattctcagttcttcaagaattggttaccttaaagcactttcttaactggtgatgtaggtttttagtatcatcaatatcgtgtagttggagtcagtcagacctgtgctccaacatttactatggcctgagctgcaatttctatatctgtaaaatatcttctatcactcaaagaataataacacagtcaaaggaaagggtgtatgtcaatgattcagttggtgccaatgtaattgcagtttttactatcaaaagtcacatccaaggccgggcgcggtggctcatgcctgtaatcccagcactttgagaggccgaggcgggcggatcacgaggtcaggagatggagaccaccctggctaacacggcgaaacaccgtctctactaaaaatacaaaaaattagccaggcctggcggcaggtgcctgtagttccagccactcgggaggctgagtcaggagaatggcgtgaacctgaaggcggagcttgcagtgagccggagcttgcagtgagccggagcttgcagtgagccggagcttgcagtgagccggagcttgcagtgagccgagatggcgccactgcactccagcccgggcgacagagcgagactctgtctcaaaaaaaaaaaaaaaaaaaaaaaaaaaggagtgtccaaaactgcaattgcttttgcagcaactgaatactttgtccagtatgtcagacttcttgagctttccataagtgatggttgttaatactattagcagtattgagcagtgattgtggaatctcagtgtggccaactgcattgcaacttattgaaaataactcatgcataatttgtatatgtattgcatttatgaatatgtgtgtgctcatatttagaaaacattccctgtttaactatcatcttcagatataatgccagagaataattttaaatattaaatgaacatgcaaatcaaaatagttttaaatctgcaagctcaacaggactttagagattatctagataattgccttcattttacagatgaggttacttagtaatttgttcaaagtcacacagctagttgattgcagtgcacttcagaatagggtcttctagagttctaggtcacctctttctgctccttcacttagattctttttttttttttttcactttgtctcccagtattcatatatatatatatttttttttattatactttaagttttagggtacatgtgcacattgtgcaggttagttacatatgtatacatgtgccatgctggtgcgctgcacccactaactcgtcatctagcattaggtatatcgcccaatgctatccctcccccctccccccaccccaccacagtccccagagtgtgatattccccttcctgtgtccatgtgatctcattgttcatttcccacctatgagtgagaatatgcggtgtttggttttttgttcttgcgatagtttactgagaatgatggtttccagtttcatccatgtccctacaaaggacatgaactcatcattttttatggctgcatagtattccatggtgtagattcttatactgaatttaatttccatttaaatgctctccaccatttataaatgtgggaaacattcaggttaattattttttaaagtgtttacagttccctggaaaacaccacatttattgggtagtggaaatagaataggaggttgctggcagagtgatagttagtctctattaccacttgataacgagttggtttctgcataagaaaactagaaattggaattgtcattacccaccacccaacacacaaatacacacctttaccttcatttccatgttcggttttaggtcagatccctgtgggagtattctttgctgttaagtaggaataaagggggaaaaatggacatagctgaacaaatatttctatttgctttctttccaccagagttgaacttaacattatcagattgatttagagaaattattataaaaatcctctttgtaatagtggtctttatgaattgttatatttttctaatctgtggaatggtattttatccacatatttatgtataagaaaatggtatctgagagatgagtagcttatcaaggtcacatggttaattattggttaaactgagtcttgggttttggtctttaggcaacaagtccaggggcctgttatagtgaaggctatgagtctctttcttccctgtatttatgggtctcaaaaaaccttggaagcaaagggaatgagaaaagggaataggccatttcttactgaatatcttgcttggaaaactctaaaaatgcattcttaatacagattattaaacatgtttcttatggtgcattttgatacattttcttatttgcaaattgtatttcttcagcaagattttcattcttaaaacatctatttcttttttatttttccttttcttttcttttcttttcttttttttttttttttttttgagacagagtctctctctgtctcccaggctggagtgctttggcatgatcttggcttactgcaacctctgcctcccaggttcaagggattctcctgcctcagcctcccgagtagctgggactacaggcatgcaccaccacgctcagctaatttttgcatttttagtatagactgcatgttgcccaggctgctctcaaactcttagtctcatgtgatctgcccacctaggcctcccaaagtgctgggattacaggcatgagccaccatgcccggccaactacttctcaaattggcacaaatagatgctgttttattagtcccataacatctaattaaatttaatagcaataataaaaaccagtttgctaaattagaaattgccaactaaaaaaataagcctgtgtaattttcttttcctgtcacctttaaaaaaattttattacagatttagggggtacttgtgcagatttgttacgtgagtatattgcaaaatgctggggtttgggcttctagtgaacccattacccaaatagtaaacgtagtacctaatacgtagtttttcaatctcttcttccctcccagcctcccctacattggagtccccagtgtctattatttccatgtttatgtccatgtgtactcattgtttagctcccacttattagtgagcacgtggtattttttgtttcagaattatttcacttgatataatagcctccagctccatccatgttgctgtaaaatacatgatgaatgaagctggaggctatacatgtggttttatagctgtgtggcattctatagtgtgtatacatatcatattttcttatccattcatccattgatggacacgtaggttgattccataactttgctactgtgagtagtgctgcaataaccataagagtccggctatatttttttatagaatgatttattttcctttaggtagatacctagcattaggattgtttaatcgaattttagttccacttttagttatttgagaaatctctatactcttgttcatagaagatgagctaatttacgtttctgccaatagtgtataagtgttccctttctctgcctctttgccaacaatttttttttaaataacagccattatgactggtgtgagatgggttttcattgtagtttttatttgcatttctctgatgattagtgatgtcgagcattttctcatatgtttgttggctgcttgtatggattcttttgagaattgtctgttcatgtcctttgtccaccttttaatggagttgttttttctttctgatttccttaagtttctcataaattctggatgttagtcctctgttgagtgtgtagtttgcaaatactttctcctattctgtaggctgcttcctctgttaattgtttcttttgctgtgcaggagctctttaagttccatttgtctatttttgtttctgtcgcatttacttttgaagtcttaattataaattttttgcctaggccaatatccagaagagtttctcctagattttattctagaatttttatagtttcaggtcttacatttaagtccttcacccatcttgagttaatttttgtatatggcgagagatggggatctatttttagtcttctgcatgtgtctagccagttttcccagcactatttattgaatacggtgttcctctctctttgtctatttttgttgactttgtagaagatcagttggttataggtgtgtgactttatttctgtgttctctattctgttccattgatctatgtgtgtatttctgtacttgtacgatgttcctttggttaccatagctttgtagtatagtttgaagtcaggtaaggtcatacctctggctttgttcttttttgcgtaggattactttggctattctggcatattttagttccatattaattttaatcatttttttctaatcctgtgaaaattgatgttggtaatttcataggaatttcactgaatttttagttttttttatggacagtatagtcattttaatgatgtgaattcttcctattcataagcatgggatgtttttgcacttgtttgtatcacttatgatttctttcatcattgttttatggttctggtaacggtcttttacctcttggttagatgtattcctgggtattttatttttttgtgtgtggctattataaatgggattgagtttttcatttggttctcagcttgagcactattggtgtatgaaatgcaattgatttttgtgcattaattttgtatcctgaaaactgctgaagttctttatcaggtctaggagtcttttaaaagaatcattaaggctttctagttatagaatcatgtcatcagtaaatagaaataatttgatttcctcttttcctatttagatgctttttctttctttctcttgcttaattattctggctaggacttccggtactatgctgaatagaaatggttagagtagacatccttgtctcgttccaggttttaggaggaagtctttcaacttttccccattcagtataatgttaggtgtgggcttgtcatatatggctttgattattttgaggtacttccttcaaggcctggtttgtcgagcggtttttttttttttttatcataaagtgatgttggattttattgaattctgttttggcatcgattgagaggatcgtatagtttttgttcttagttctgtttatgtagtgaattacacttattgatttacatatgttgaatcatccttgcatccatggaataaaatccacttgattgtgatgaactgactttttgataagcttcttgatttgatttgctagtattttgttgaagattttggggtctacgttcatcaaggatactgacctatagttttctatttttgttgtgtcattgtcacattttggtatcaggatgatactggcttcacagaatgatttaaggaggaatctctctttctcagttttttggaaacatttccgaaagattggtatcagctcttctttgtacatctggtagaatgtggctatgaatccatctgatcttgggttttttttagttggtagattttttattaccgattcatttctataacttgttattagtctgttcaggatttcaatttcttactgttttaatcttgggaagtcatatgtttccaggaatttatccatttcctcttggtttctattttgtacacatagaaatgttcatagtagtctttatggatcttttgtatttttgtggtgtcgggtgtgatgacacctttatcaattctgattgtgcttatttgaatcttctctctttttcttggttaatctagatattgatatgtcagttttgtttatcctttcaaataaccaactttttgttttgttgatcctttgtttgttttttggggtcacaattccatttaatctttgttgtttctttgcttttgctaactttgcatttggttagtttttgtttttctagttcctttaggtgcagcattaggttgttaatttgagaactttctttctttttggtgtaggcatttagcgctataaaatttcctcttaacactgttttgttgtatctccattggttttggtatgttgtgtgtctatttttgtttgtttcaaaattttaaaaacttctgccttaatttagttgcttattcaaaagccattcaggagcaagttgtttagtttccatatatttgtgtggttttgagagttcctcttggtattaatttttaaattttgttttgtggtctgataatatgcttgatatgattttgattttagaacttagtgagatttgccttatgaccattttagaggttgtttcatgcacagatgataaaatgtatattctttggtattgaattgaatgttctgtagatgcctattaagtccatttggacaagagtccaatttaagtcctgagttactttattagcttatgctttgattatctttctagtgctgtcagtggagtgttgaagcccttcactattattgtatggctgtctgcctcttttcttagatacagtagtatttgtttgtgaatcttggtactctgatactgggtttgtatatacttaggatagttaaattttcttgttgaattgaatcctttatcattatataatactcttttatttatttttactgttgttttaaagtatgtttcatcagatacaagaatagcaatccctgcttttttttttccttcgctttccatttgcatgagagatctttcttcatctctttactttgagtctgtgggtatcattacacataatatgggactcttgaaggcaacagcaggttgagtattgttttttaatccaattttccactctatgtcttttaaatagagcatttaagctacttactttcaaggttaatattgatatgtgaggttttgttcctctcctagcattgttagctagttgctttgtacaattgtgtagctgctttatgggatctgtgaactttgtacttacctgtccttttacggtagcaagtatcatcctttcatttccatgtttagaaatcctttgatcatttcttatagggctggtctggtggttatgaattcccttagcatttgcttgcctgggaaaagttttatttctttttcacttatggagtttagtttgtcaggatataaaatgcatgaatgtcatttattttcctttaagaaggctaaaagtaggcccctaatttcttctggtttagaagaccgctgttagcctaatgggatttcctttataggtaattttgccctttactctatgccttcaagttgttttcattagcattgaccttggatagcctgatgatcatatatcttggtgatggtcatcttgtatagtatctcgcaggtgttctctgaatttcttgtatctgggtcttgagctctagcaatattagggcaattttcctgaactattctttcaaatatgttttccaagttgcctactttttcttcttctctatcataatgccgattagtcatagatttggttgctttacatagccccatgtttcttatgtgctttgttcattaattttttttaaattttgtctgactgggttgctttgtgttcatttcaactttctcttggatctcattgagtttccttgcaatctatactttaaattctttatctgtcattttagacttttgactctggttgggatccattgccagagagctaatgtaatcttttggagttgtcaaaacactgtctttttgtactgctggagttctcctcttgatttctactcatcttaaggaaccgtcgcttcttatttttgagttttctatcattttgatgggactgtttttaattttttatcttttcccttgagggtatgactatggtatatgttgtgtataatcatccggttttgtttctgggtgcttttgtgggggccaaggctctgaatgggttccttggttgtggataggttctgtgtgatagctttctaagatgctgcttgttgtagggatatattggacatatgagcccatacaccatctcctgctgtgctccgggtgtggaggtctcagggagcacatcttgtgtactagcagtaagaccctccggaagatttttaatttggtggtgcaattcaggctgcattccagtaggtggcaatgaagagtaagagccggctcattctcagctcagggggaagtgcccaccctgatggggagagactgtgttggggtgttctaggtccctggggtagggagtgggagtgaagccttgtcctgagcagccaggaacacgattcccttccctatcatggccctgttgcagggctcaaaacctccagttcatttagactttgttctttggctcccagctgcagtgtggctgtggacctttggatgtggctatggccctctggcagcgaccaccaaactggactcagggcacagcctcttccctcagtctggagcagacaactgtatggcttgtctggcctccgttgtcagggtgctgctgctctgtgtagggagagggagttgggccccaaccttcatgcaagtccaagcagcacaggctcactttctgcgccaagaaaaagcactttctccaagtgtacatgtgtcagcccccagtggggagaacctctgctgtatccacaatagtagatggggtgggggtcgggaaataacgccctctctatccctcttcccagctgctgggtgctgccccttccagagattggtgatgcgccttcatttcctttgtcccaaaaagagctttgatgggctgcactccctcctcccttggggcagcctacaccaagggttagatctctagggaccccacagctccccagggacttgattgctgtgcttgtgaaagtctgaggggattataaggtatgtttgctggggatctgctggtgcatcgtcttgggggcagagatttcccaggcaggacagtggccaatgataggtacataaccagtatggtactcaccatctcagtttgggtctgagtgggatgggggaacctctgcgcgaactcgctacctggtcctctgtcctcatgaagtttccaaatcgccacggacagtgttgtccagggctgtgagtgcagggggtcttcccaacagtttggcaggcagcagattgccacagaggtgaggggagcagagaggactcccactaccctttcttcggggctccacgttgctctggggtcggtctcagccagactcttgctactttccttttctgcaccccagctgtcctggctctcttccctcagttttctcttgagagcccgtccattcacagtaactgtgatccacgtccccttttttcttcagttctgtactctttctactctctttctattggtcagttggatttaagttcctcgtgtataacggagtgggtgggttggattctagcaaagttcattttttgcagttgtgttttgtgagtatatgagttgtctttataactcagaaataatggtcgtgaagacatatctaccttgtttccttcttaaataaatttcacttatttctggctttataaattcccagccttgtgtttgaattattttccacgtaattttcaaaagtcaggggtcctgggtctgaatgtgtcccctttatggccattgccattttttggtatgtatcctttaatgggtcatttcacttctttgagctttagttttctcgttagtaaatgagagctattaatatttactttagttgtatattataaatattcaataagaaagtatacataaaaacatgcagaatattcaggtcatatgctaagggatccacaaatattactgctagttgagtgacttgaaaaaaattatcttctctgtcagaagaaatactctcttctcatatagatgagatcctaatgccatttggtcactcttttttgtcactatgaatcagggcccctcagcctcaagatcacaattgcaagaattaagaaaaatgatctttattttgcattcaaaagtagtggtgtgtttcaataatagtgtattatgattatttataagtagttttgatatgtggcaggtacatccttattttagataatgtataaaaatttatttttatagaataaatggttcaatttgtccaaattattatgataagaagacttctgaatgttaattatgacttctgctaacagtattggtagaagagtaatttggaataaccctccttatggagggagattagaaaatctaggtaaataatttacagatatcagagaactaagaagctagtagagagttatagggctaagatcctagaggagacaaaaatatacaaagatatgctcaaaatttagggctactttctcctggtacatttaccgattctagaagtgtcagccggaagtttagttgcacttttgacaggcccttaaagcaaaagatacaaaacattagagtccagagtcttacaaagaaggatcccaagtaatccctatactcaaccttttagtttggggttcctcagaatttgctccaggccagacttctaagaagctatagctttcagtcatctcagtcattgaatttgcataaaggagactctgtattgtcagtgcccagaagcctagtagaaacaaataaatatcttctcttgaagaagatacaccaacctttgcctcgaagtatttatacttttttccaataaaattttatttatttatttattatttatagagatagggtctcctttgtcacccaggctgttctcaaatccctgccctcaagtgatcctcttgccttggcctcccaaagtgccttttaaaaaatcttaccacacaataaaagaaaactaggcacaagacaagggtcggggtgctggctgatgcttcatgacatttgtgggggtgtgatcaattttaagctctgtattttattttgtgcaatgcacttttctgtctgcgtatttaaaaatgtttaaaaaaacaaacaattatgaaacgattgttggagcaccctggagacatgtttggcccctccttttattttagttgacatgtaatatacatatttatgtgatacagagtgatatttcaatacatgtgtacatgtggaatgatcaaatttggatcatctgggtatttatcacctcaaacatagcatgtctttgtgttgtaaacactcacaatcctctcttttagctttttgaggatatacaataagttagttaaccatattcaccttatagtgctgcagaacatcagacacatttggtctatctagctgtaacagtgtgtctgttaaccagtctctcctcctccctatacttctcagcctctaatgcacacacttctattctctatttccgtgtagccactcctatattttgcattccagttttaagagactcggagtggagaaagatatgggaatactataggacattcaaaaaagttttttttcctttgcaaaagggatttatttctaagatctcagaaattatgttccttatctccttaagagtcacatggcataaccaaaaatttttcagcaaaatgataaaattgaggctgctcagtctctcaaaataaaatgttcatcagaaggcttagaaagtaggcaggtttgatactcctttaacaaaggaagaacataaatcccttctcatttgtgtttgttttgtaatcttaagatgaaagttcaaaagagggagagtgaaatggcgaaaaacaggaattataaatctgttgaaatgcagcaatgtgctaccatggaaattgtcttatttgtttgtaacattaccatttatttcacatgtactatgtgttgcttattttctttcttttttttttttttttttgagatggactctcacagtcgcccaggctggagtgcagtggcgagatctcagctcactgcagcctccgccctccaagttcaatggattctcctgcctcagcctccagagaagctgggattacgggcacctgccactgacccagctaattttttgtatttttagtagagacggggtttcaccatcttggtcaggctggtcttgaactcctgacctcatgatccacccacctcagcctcccaaagtgctgggattacagacgtgagccactgcacctggccttttgcttattttccacctcagtacttgtcagttactggaagcactattttcctgtcttctagcactggacattgaacatacatgatttagatgtgtcattcacctcctgtgatgtatttttcttattgttttcacttgaagcattattttcaaataatttccactctagaaagtagagtgcagtttttttaaaaaaaataaatcaaagagtcttaaaatttagagagcccttggaaatcactagttcatcatcagtacaggtatactttctatcatatcagtggcagatggatttctagcctgtacttaaacactactggcatcagggagcccattatctgacaggacagctctgcatttttgcaaaacctaactactgagaaagttcttttctgcatgaggttcaaatgtggaaccctgtatatttcactcatctttacccacttctatctttattatgatgtgattatttttatttcaattttctcagtaatcagcatctgctaattagcatatgcattgccaaagattccctcatgtccacagatgggcatattacaggcttaaattagtgtgatgtgggtgactaccacaggtagatctcctatgccaaaactactccagttaccactgagaggggcctagagaacagttgctttaggcagagccttgtctatgatgcaaaagaggattgttactgattagctcttgtaactacgaagctggattaaatatagctttctgtattatgttcttcaagctcattttcaacagttaccaaagtttttgtctgtgccagagactttcctgattgaggaaattatcaataatttccacttctaaccaattctggttaacttggatattgggagaaaaggcactttaaggcaacttttgctattgtttagaacaaaactagtcaacatgtagaccaaaatggaaagaatgtaattttacttacatttgtctgttcttattgaaatgcctacaagtaacacctatatagcctacaaatcctgaatattatatatatatatatcttgattttaaaatgccttaaaattcctattaaaattgcctcctatattttttgtatcaactgaatagtccctcttttttcctaatacattggcaaaaatgtagaagcagccatgggcttccttttccttttttttttttttttttttttttttaccccctcatccaatcagccagttcatctcctttcatggccgtaatttgtcaggattcaggccccatggatcactcccccgacatccttgtgtatcctcttccagtttgaggcaagtcagtcttggcctcttaggaaaagttgggcagagaggggacatgctatttggaccatgaagggagagaaatgtttttaatccacatcggtgacaatgtgattatagatgcacttccagacaagagatgctttacatcggatggcggttctgctgatccataggacatttcattgtttttcaccaagtcattattgttattgttgttggtacttttgaaatcagaggttgattacagacaggtttatctacttctggactgtagctctgatcagagcatgttacttcctttctctacactgttcccctgagggtaaatttggtgtgggagttaggattgcaggtgaagaagaacatgagtgctctctgtctgtttcatttctaagtctatagacagtggagacaatgtgatgtacagtttgatgcagcgttcactttggaagtaataaatggggatttaaacattttctgccttttcttgcatagtttactgttctttcttccagtgatgcaggatgtagaatttgaggaggaggaaaacctaattttacactattgaaacagaagaaatcttggattggtccctacctggctttggggtcagataacttggcgggggggaacatccacatgaagttccagaaacttgatgctggccttggcaatgtcatagtcctgtcacataccacaggctcatgccctgaacattcttagcgtcccttttccacccttctcctgtgcttacccctctgcctctttcatgcctcctgcatgctcctgctttgatagtccaaattcttttccatgtggttcaggaacctgccaggttatcttccctgtgtgtgtaacatggagttaatggtatcttccttgcttgactctcatgaaaactaaaagcaaggtatgcctagtactagtgcagtgcctagaacaaagaaagctctctgtagtcagcaattcattatttggaagaatgtgtctacaattaccattacttcttttagcttaatgaggaggacttgggagacttaatcggggtttcctgggtttgcgcttgagatggaacagaatggccagagaagcaaaatttcaattactcgtgtgtagatttcagataagagcagtattcaggctgtatcctcttcaaggttagaggagaaaacctgtgagtatgtgtctgtcatcgtatgtgcatgtgtgttcactggggtagagagtgctgagtggaggagaaaaatatggccttcccatgttattttctatttcctaaattttcaattaatccagtgaaagcacttatggttattgcttccaatatctttttttttttttttttcccacaacatgcatcccttgctggttgtgtgtttgatgcacttcacctttggattcagaatgggacattcatttttactctctggagagaaattttaaagatacacatgtaaagtaactcagaaattcaactcatcataaaggtgttacaaggtgtcaatacaattcctgaatgtgaggtttggttccatgttcccctgctgacttgtgggagtgggagtggaacaagcggtaggacttccaatgtgctgcttcggtcctcagtggactgtatgagagagaatgcagattgcagcagagctctgacccattttactgggaaggactctggcacaaacagcctggggctcacatgtgtttcctttgctgatgtacaggagaactctgacattgcttacatttctttctccgaagacatgcatcacctgcaaatgtcaaatgataattttgtgcttgccaaagggaatcagcttcctgaaaatggaaccacttcaggattgcaaaaggaggatgtattctgtatagacctcctctttgggtccttttagactctgctggggaattttttcaggtactgtttgagaaaaaagtatcagttatgactctgttgttactatagaaaacaaaaaaaaaaagctggtaaaaaggcttaaggatgaagggacaagaagtcttctctatctactactaaatgtctaatttaaaataagagcaaatgctttgtagtacaatgaaataatcatgctactaaatacttagtatatttgctcataatcctcacaaccatcttatgacatattaaccccagcttaccaaagatagatcaagaaaagttaagtgactacttacatttagaaagtggcaacgtcaagattcaaatccatacattctggctcaagtttatgctcttaaccaattatgttgtatttagccaatcaccaggaagttattctgtacactcccaaacattgtaatatttcaaaatatctgaaggataggggttactcatccctttttccatctgaatgtcaatatcctatagagatggtagttgttacagcatttaatggctctttctggagagactctcagcctgaaagctcccacgcccccattgatgggctaagttgcctgagactttggcaggtgcatcagttctgggaagcattaatgtggctctgtccctctatgactgagaatgtgtggtgtaactggcacatgtcagtaggtacttgatgatcttatgactgagaaggactaagaagaatttgaggcctctgtgcagagagatgagatgctcttggtgcacacttagcctcaattctgtaagctctgaatgtcatcccaaaaagcctgtaagtcacataccttccacagaagctgggcggggtggggggaggggggttgcctcagtatccaaccatgaccttcctcagtggggttcccctgccttctggctgacactgaactgctttttgaggctagtttgatccttctgcctctgaccttttcagtttaagacctgtaattgtctctcctgcacttaaaacctcctctttcgttaaatgatcctctcttgacatgttcctcagctctgtttaacttgtgctgtttcagctaataacctctattttgttctcaccttgcagagcttcaattccattcttttcttgactcttttccccatttattctcgcagatggattttatagtcctttcttaggttcaacatcatcatttgaaatttgtattgaagctgctttaaattcctgtgttgatttaggaagagttgatttgtttataatgataagtcctttcgtatctactattgtatggttttctatttatttgagatttattttccatctttgtaaatttttatatgctttaaatttagttcctatttgttgatgtgtttatttctatagattttatatttttattccttctttgaatgggaatattttattgtattttctaacaggatattgctagtatataaagccactatcaatgtctgaatatttattttataactagtgttctttctaaaaattttgttatctcttatagtttttcaattgatacttttttttaagagaaatcattttattgaatttttgctgcacaggacttcatgttttccatttggcttgattcctgcttccagcattttctcgttgagatttattccttaagtcttagtgttctcattgttggcaaactttgcttattatgcatcaaccatatttcttttcttagtattttttcaagaacatgaaaacagttactcacaagtttgatatcaatatttacttgtattggattcaaatttactacacctcttagacttagccatttgaacacggatcccctctcttaggagcagaggattgttactatcttcttaattttattctccacattttgacccttcaaggcttcggctgtgttccaccttcctcactggtgggatgtgagatcccagaaggctccttagctggggctgcacagtgtagaattatatatgaccaaataattcaaaaatgacaaggtatagcattatggagtcaagtatttaacatgatttatttttactgtgagcttccataatctttgaattttgagtttgtttttgggctgatagggtcacaaagcatattcattacccaagtctttacagaggatctgctataatttaaaaaaatcataaccatgatagtgataacaatactagcaacattttatgattactgtatcttgtattaaggctttacattccatttcttctcataacacagtgaggtaagtgttataatccctcttttaaatcatgtcttgaagaggtttactaagttgctcaaggaaacacatttagtgttggagccaaggtctgaacctgacaaaatctgtccccttaatccccaagaacactcttagttgctagtgatgcaaatagtttgaagagaaatacttaatatctttaatatgtttagaagtccattggggaaggtagacattcaaataatgaactcatagtatcaaaactataaatatactataaatggagatatatgtgagttgtaatgggaatatagggagaataattccctatgacattacttatttgtcttttagtgtggattttgatattacctcattggccacctcaaccaaaaatggtttttaaactttcatttattgtatgacatagataggggaaatttttttactgcttagagaataaaaagctgacatatacctgacacaaaatcttcctctgagagaaaggtgaataatgattagaatctggaaggaatcccttagctttcaagattaaggtattccagtcccctttagcctccactcattcatgtcctgtgatgctaggttccttagggtcctatccttatttgtcatctattcttgcttataagtcctacttcagcttatatttatgctgctattattcatccccaaggatgtgttcacagggtgctaaaaaatgtaaattacaaaaaaaaaaaagccaaaatcaatcttgtctattttgttccccaataaaacttgagtcagccaaatatgtttaacgggcttaatcaatattgcatagataaaataactgatggaattaactttttgcttttctcagcatgcttagttttatgttgacttaagtaggtatggctgaacagttaaattagttgtgtttgttgaacgttagtattactccttaaattgtcctttgcttttatgtaaatgtataatttgatgattaacaactaatgaaaagcctgaattataatctttgtcaaactgaatattaatgttgctttcttgagcagtttaatgagaacatcttttatttttaaatgaatttttatgttaaaatgttcatatcagtggataattaccaaatgcacgtgggtgctgcaatggtcttgacttagcatgatctgagagcccttggaaagtcacatttgggttcttctacaataatttagtgagttctggatctggtgtgactgttgcttgctgttgagcatatgtctatatcaataacaccttttcaattccgatggagaaaagtcacattcagctttttatcaatacattctataacacctgaaaatatgacagcatgagccatgatttatcctcaaaatggtcttttctcagttcaaggtcccatggcaaaaataagtaagtaaatatattaaaaatctgaattacttctgtggcagttatgagagcgcactccttggactgtggggagcataattgacttatagcaccaactggtgtgcattgaaacctttacttcatttccaagaaggtgtgcattgaaacctttacttcatttccaagaagacaggcttcccacgggctacactcatcaatgactgagtggaggcagcaatgcaaaggcagacctgtttcttggtgacatggagctcctgataataaactttggcttaaggactccgaaggccttactgacctcacctagaattgcactgctgtctgagacgtctccgctaaactttccttccgtgtgtccttcacccagggtacaagtcaattctacatggtagtttgacagcactcccagcctctcctgactcccttcttattttcccttatggatgttacctctaataaatctctgtgcagctgatctctctcatcttgatatctgcttcttggaggacctgttttaatactagcaccttcaaagctaagacagtattatgggcttagtttaaggctaactggtactcatgagtgtgcattttatattgtgctttgagctaactatgtaattgtgtctttcaacaagctagactcaaagtgtagaactttaaaacaactgtttgtcttctactgccccttcaaaattgtttttagaatttgttcttcccaccatcttagatgacaacttgagcagatcccactgacttttattctcagatagcaaaaatgtcctttgaacacttccctaaagtcttagttcatcaattaaagcgctcactcctataaaataaacaaaaatctattaaagttttgttacaattctctctctcccccagttaaggcctgtgcagctatctctgagttttggcaagtgttatagctgagccattctctttggggttgttggggaaacctgtcatcacagggggtctctcacacctgttccactgatatggccaagtacaaagtgattcagacattttaactgcaattctcccttatccctgaggtatctatcctaatagcttcagcatctttctggtgaggtatccaaacccattctggtggcctctctgtgcaacatctaagacaaccccacacagattctcacacaggtatggtccacatttcttccatggaaaataatgcacatcatttgtccaatgaactctgggcatgcaggctctcccaacatggaagcctcactacagaacaccatccaccccagcaggcagacagttacagtctctttttctttagatttctcaggcatcgtgcctctcaaactctaggacatacaacatacaaatcaaattctgtatcagtccatttcatgacattctccctaggcttaatggttgaaaaaggatctcctatttcccatagatcgggttgtagtggggtaagcaggaccatcattacacagcattctctccaaaattcctctaaactccaggatccttcttggttactccaaccttacaaaagctggagttgaattttctgttccatgtccatgtcaccaaactaatgttaagcaaccttctctacttttgtggtcccactttgcagcatgaaaatagttggcacctattcagtagattgatattcagtttgtggtcttagtaccagcagcagcttcacctggtagcttgaagaaatgctgaatcttaggtctcatcccagacctactgaatgggaatctgcgtttttacctggtgcccaggcgatttatattcacagtcacttttgagaagcactagcttagagtactcggacgaaacagaaataagaagtaacccattttaacattctgttacaacagtattattcaacaaatttatcgaccactattaggttcaagacatattcaaaaggcttacttagtgtctcatagaaaggattagtatatattagtagttccatgggattttagaggggaaagattattttatgaccagagattcagaaagggaatgatttgactggagtcttgaaagacacacagcacgtgtccatgtcgaattgaggaaactggtcattttatgtaaagggattagagtaagcaaaggtgcagaccttagctatatttgactagaaagagagcatgtgaaggcaacaatgggggcaataccaaggaagatatgtaggtatgtgtgagccttgaatgctgaattggagtttgaacttcatttagaatgaaatgagggggtcactttggtggggtgtggagtgattctccttagctgctgctgttgagtgacagcttgagactttcattcagatctgaagcttaaaatatggctggtgcagaaagcatcggtctggagatgagggctggtttgtgctaggtcagggattccacgtttcatcacatggtcttttgatgctgctcatttctctatttggaaaaaaaaagtctgtgatagaccaagaactatggcctcaagaactctcagcaaattttaagagaggaacatgctggatatagtattctggagcctgttctggagaagtgccaattttcttttccccttaacagcaaaacttatctagttgtctgtatttactgtctctaattctccaactctcacgctttcttcaatatggattatgccccattctgatagtgtctcctccccagctgccagagtaccctttagaaataatcagattataacaattccctgtttttgcatgtaaacaacttagaatccacactaactttcttaccattgcctgacatttagaatggtctggctccgacctttctctccaaccctgtcttgtactcgtcttcctcctttaactatacggtagacttccaggccagcagcagaataaagcttgaagtaagagagatctagggaaaaataaaaagaaaaatttgcctatttctctctctatatgtatgtatgtaaatatgtttttaatattcaaaaggatatatgataaaaataacaattatagctattttaggtgagagagaggatatcgaccttaaatgggaaacttttgtctatactatttgaatgcaattctctgcaataaaaatatattcccatatatttctgaagtatatgcctgaaatttctgaagtcagagacttaacaaaaagtctcaggatacagcctttcccttctccaaatgcctcaaataaagacaatttgatcatacctatttagtgttctcatagtagtgtggttatagctctactctaacattgctttgtccttcaaatatttatggaacacccagtcttttgtatttgtctaagacagtcactgctccttctttcaagtttactttgcataattgttttggtgtccatctctccttcaaaattattatctattttaccacatgtactatttgttagttggctttgtccattttaacaacttgtctcagaggttttttttctgacaggagatatggatctacctcaatctccccaatgtgtaagaaaattaggtgttttaatggagaacttgagacagctctttctaaggagattatgcggtactgatgaattacaatgcctggtattctatgtagcttgatgaatatcaggcactttttaatttatttctcctttaacttgtaatggaatctgggccccaagtgaaatgagttattttctagaaagaaaatatcagaggcacagaagtttaaataacttaattatctttgtagcaacttctaggagtggatccagaaggagttgtgacctcaagtcctcatgtaattcatctagtagtaattcatccatttgttcacctgtccatctctcttggtctgcaaaggatttgaaatggttaactgtgtgtagttatgtgactgatattcttagatgattgatcgctaagaggaattcatcaaaataatattcagatcattgttagaataacttgcttgtaaaataagtattgtgatgggaacaacactcatttatacatagactctggggtttttagaaaagagtaagccttcctcttgaagagacatttcatgtatgcgaaatgactgtgaacgtttctttgctttatcagtttaaatgtgcactgactgttggaaaagaatacaattaggtgtgattttgccagtccagaggttagtaacaagtcatagaagattcagtagtctcagctggacagagtggccaggacaggccattctggggatgggatagctgggctaaagcacatcctccactttggtgactccctctatagcgtttttattttattttattttattttgagatggagtcttgctgtgttgcccaggctggaatgctctgtggtgatgttggctcactgcaacctctgcctgctgggttcaagcaattccactgcctcagtctcctgagtagctgggattacaggcaagtgccaccacgcctggctaatttttgtatttttagtagagacgaggtttcaccatgttggccaggctggtctcaaactcctgaccccaggtgatccgcccaccttggcctcccaaagtgctgggattataggcgtgagctaccctatccggcccctccatagcttcttctccttcctcccaacttccaggaattgtaagaagcaccagattcccaatccacttttacacacatgcctaaatgttctttctaagaataaacatgttgtttcacttcatgtttttttttcttagtagattataaaagaaacaccagcataagataaacaggtctgtatcataataaattacatttttctaagttataatacagctgataaatgtgtactgttgaactttttaccataggtacactttaaaacatttcaccagtaaaacattttgaccaagaaagtcagtgttttctttctgatagtttgcaaatgatgatctttctaatcgagatttccatcttcatcaaatgtcagcgaatctctaaaggacattttcattccctaatatactgctaaggagggttggctgagtttgaaataggtgaggatggaaagtctgaccacaactgcctctttaagtcagagccggtacatggattgttaattctgcggcttgcaatgtgttgccttatgtattttatctaccaaataattctcctgagagaaaacttatcagaggcttagcagtcccttggttttaatcaaatatgtccaaagatgttgatatcacttgatgagctagtaaagttctttacttgacaaagggcagttttgtcaagagtagaaccaaaagtgatagcaacttcagggtgatccccagcttctctgtgcctaagagtgacagagctttccagtgttcagtgtaagaggctatagcatttaagttggatgaaatgctcccctttctatctttctcccatggaaaaagccaggtcagggttaaatctaattttcctctggctccaagactctgctgcaaatcgtattactgaactttgcttgggaatatagcaaaccccagtaagtggtctcactataaatagctggccatgcatctcaaggtgaccctctccagcaaccctgctgtatttcttcaatacatttgcttcctaataccccaagatggtcacttaattatcttttcctttttcctttcctcctcaccattcatgttcacattctgatgaaatttttcaaactgtaaaaggaaactggaagcattcagaggagaagcccatcatcatctcaccatcactgaattcctaaacctaagtgcatctgtactcgaatattccccctttgattaaaatgaaagaaaatctcttgcacttcatctgcttgcaaatttagagtgcaacccatccactctaagtttttcaagcattttctcctataaagtagaagtgcgcttcaatatatcccacatttaaaaaaatacttggctgggcacagtggctcatgcctgtaatcccagcactttgggaggctgaggcgggtggatcacttgaagtcaggagttcgaaatcagcctggccagcatggtgaaaccctgtctccactaaatatataatacaaaaattagccaggtgtggtggtgggcacctataatcccagctattcaggaggctggggtatgagaattacttgaacctgggaggcagaggttgcagtcagcaaagatcctgctactgctaccgcactccagcatgggcaaaagagtgatactctgtctcaaaaaaaaaaaaaaaaaaaaaaaattaaattctccttgcactcctccaagtaccttatttcttttctccccttcacaaaatgtaacagttttctctatttgttgtctctacttcttcacttcttgttctcctttaaatttacttctttgagagtttttccacctataccttggaatgcttccatcaaagccaaaaataaaatccacactgtcaaatctcattttcacagcataactggttactctctgcttattgacatgttctccactcatggcttctttgacaccacattcatttagctttcctcctacctcacgggccattccttttcagaagtgtctccaactcctgcatacaaattctaaattttggggcatttcaggcctttgacctgggcccctttctcttctccatttacactctctatgtgattccattcagccttatacttttctttaaattgcatttttatgctgagaatttagtttgtatctttagcccagatctccactctgagcttagtacgtctatatccagttacctacgtgagaggtgttgcatacacttctccaactcagtatctcaaaaaaaaaaatagctgttgaaaccaaaaaattcattagcaatccaattaacattatttcaaaacctttctttctacctgctccatcactgccacctaatccatgccatcatctcttttggtgactgaccacatggattttttaagcttctccctgcttcattcttgctcactcctcttctcactccccagcccattttcacaagcagaaggaatgaattacaaatacattgactgaggtataatatataatacacatatagtaaagtgcataaatctgaagtgtacaccaagtaattaacatccagatcaatacctgttgttaagcccatttcaattttttaataatttttatttctaagatttcattggatttgtttaatttagatttctgttttatggagaaattctccatcttattacatatttccttcaatatatttatgatgagttttttttaaagcctgcctttgataactctaatatctggataacctgttaatctgcttctatcatggttccttttttttcttgatttttagttatttggctggtagcacagagacagaataaaatccaaatttcttgattcacaggctattactatttttactgccgctctgctgctatttctctgcctctgtcttttattgccatattgagttattttacaatagagatgtttccttttgttctcatctctcatagttcctattcctttctccattgtttatagctacactttctaaatacttttaaaggaaaagaacctagttttttactaaataaaattgtatttataattcccaaaataaacgaggtaaaagtggagttacttcaggtcaagtgttggagagacatggagttcattctatttgctcctcctcattatcctcccccttttttttttgacaaggaatcttgctccattgcccaggcaggagtgcagtggcactatctctgctcaccgcaacctctgtgtcccaagttcaagcgattctcctgcttcagcctcctgagtagctgggattacaggcaaggcacgcaccaccgcacccagctagtttttgtatttttagtagagatggggtttcaccatattggtcaggctggtctcgaactcctgacctcatgatccgctcgccttggcctcccaaagtgctgggatcacaggtgtgagccaccgtgcccggccatcctccccattcttatacttgggtaacctagagagccaaagaacagatttcaaaaaacactggcatgtgaatcagttcagattattaaactgcttgcctttgttcagtgctctttgcattacagcattcttgcatatgtattatctcatttgacgcctgcctactagatcctgtgtgaagtatctaagacgtggaatttgaccatagtcatattataagtgactcacttataatatgaaaactgagactcacacagattaggcaaattcccataagtcatacaaataaacaaatgaaccaaagtattatagcttggagtctagtaggttttctttcatgtgcatgcatataaacttctgccagatccttcttaatacagtggactgagagctagacacacagtctagcctgagaatgtactggcataaagtatttttattaaaattcagtttttcaactttcaaagatgtcaaagggtgttcagaagtaccttgagaacctcctgtcctgcctgaaggattttcaagtgcaaagcagacttgctgctgtacgacatgcttgtgtatgtcacactctggatacacagagctgtcacctacacacatctttccctaaactcttaaggcaggtctgcagaactgggaatgtgctgctccagtagaggtgttctatccgtgttttataggatgcaagaaaaacaacaactaaattatagtaaataccttttctgtatgtagctactattttctactttctcaatgtggagcacttttaaaaagcatattcttttaaatgtttaaatgtgtctgagtgttcattctagtgttgatgaaatgctgtctttcttcctctgcgtctctctttagccatatttccctgatatgctcagaagatgcaccccaggggtgttcacccagttctggtgactcttgtctcatggggataaaaagaagaacatttgattggtcctcctggacagtagcattctttgctaatgctgttgccatagttctggtgtcactgtcaaaaataagtgatcccttggccagctgcagtacttgcatcttgctggaagcctgttggtggctgtcgtaggttaatacttctagtcatgacagtcatttttctggaaggaaggtagattttgtcctctgtgactgaagttcattgtctggcagttgctgagggtacaaatcggggagagaaagccctctttctgcagtatttttctcagaagtatttgtttcattccgatcacagacttgtggtccaatcattataactgtgatacacaaacacacacacactctctcacagtacatacacatgctctcttacacatagacatacatctcgccattcttttacacacatagaaacacctgttctctcacacttattttaaggagttcgccagggtaactaagcacagcctgtcttccttaccttatgttcaggcctttgggagctgagatcttacattcttatacccaaagcactttctgtttcctggaacaggatgaataatatttcttctaagacaaatgcatagctggtcatatgtacaaagcaaattatagtttaccaaccgtgttcaaattaacttttctgaaaacacaatagtattacttcacttttgtagattaaaaatatttttgtcagtgcaaacccaacacaatccttctactaaattgtcttagctgactatcttgtttccctatcattattgattgccttgttctttcatttaattcatttctgtgaccctgtcattatttttttttctacctgtgccatcaccatcagacctatcagacaactctcaatactgttttccaaacacatagatctttttattttatttatttatttttttatgagacagagtctcactctgtagctcaggctggagtgcagtggcgccatcttggctcactgcaactccacagtcccggggtcaaatgattctcctgcctcagcctcctgagtagctggaactacaggcatgtgccaccatgcccagctaatttttgtatttttagtagagacagggtttcaccgtgttggccaggatggtctcaatctcttgacctcgtgatctgcccgcctcggcctcccaaagtgctgggattacaggcgtgagccaccatgcccggccacacgtagacctgttaagatattgtgtcgagtccttttctttctttcatggtccttgggcctctcgcctcagcgagcccatgtttggacccattgctctggatacttgctgtacctgcttcattgctcttcctgggacttctgttagcactcattctaggaattcccttcattgtccttaaacgatgcctggattctatatcttttccggtttatctttttgttttcatggaagtcagtaacttccagagaaataatcaataagaaaaccactttttcatcctttttttcccttggagaatattcatgtttggaaatgtttttgtctatgctaacttaaaaaaatatattcttagatttttttccccctggccacacacaaatttcttgattctttttctttggatttcctttaagattttcatgactgacctctaatattcttatctgttttattttccttccctttttttgtattctaacttcaagtgattttctgaactccttttctcagtacttaatagttatatttcagctatcagatttctaacagtcaagagttctttcttattttctgatagttaaattttagtagtgtcttatgatgcagtataatttttagtttctctaaataattatatttacagttttttttttaaattctgcttcttaattgtttcatatgctgattgtggttcatctgggttttgattttccagtttgattgtatccacctttcatattagtggtttgtctttcattgttttgtaatccttatctcttggttcatattgtaacaataagacactgagaaggtggctggtgctctgtattctctgctgggctttggtaactggagagttacactctggggtattaatgtggcaaggctgaatttgcattggtgtatatgtgtttgtttgaaagtgctgccaatgtcactttctggaaatctcatctctaaggctcttcactttgtctggaggaaaagccccagtttttctacctgagggatatacacctgctcctatggtttctgggagcaggatggacaagagaactgatagttcaatagttcttatacaggattttatttaactttttaatttttatctcagtctcactttttgcctagagtttctgggtctatagcttctcagagttaatttctcatgagaataaaccttgggtattcttcccgaggcagtaacagtctaactgcccgtgatggtgaacaggacatgggggggtctcagcagtgttttcagatggtcaattattctcttgctttcagctcctttctctaggcccacaattcttcccacctgctgcatctcaatgtggagcctgtcagggttcttctgataagaataaatggaataactgcccacattagaccctttcccattctctttccttcattctgaaggttttcatatattttttattattatcctttgtgtaaagtcacaacaggcagaagaaattcatgtgtttggccaattcgtgaagtttaaacagaagtcacatgttgcattttaaggtctcaggtgactaaggaatagaaagctgtaaacactattaactacacatgaaaaaaacatttctactacggtgatgaaaatatagagacagaaaaactacacagactattgcagaaatcatgaaaatctgaactatgtcctaaggtagtaggaatgaatagaagaatgtgaaagtgaagagtatgtaagtggtggtttcaaccagatttcgtgactggctgaataggacagtaaacagaataattggaataaacaagtaggataaaaagtataagattattttatggcttttgactagaggactagctagaagccatcaccatcctttgaacaaagggaatgcaggaggaagattggcagagttgcagttcagttctattttaaacttactagagtggaaatgatcactaggtagatactttcttcttggagtttgaaagacagtgactccaatgagtgctggagtcttcttcagtgaagtagttgtagtgagtcctgataattctgtgttggtacagcagtctctctagatcccttaacttattaagcagattttagtaataaagtaattcatattcagaagcatctacctttatttgaaataaagaattgtaagacctcatgagttgtaaaaactcatgtttatagaaataggaaataatatatgtagaaccagctctgaagcctacagtttgggattgtcaaagtgataatttcctttcttataaaaatgaatcattactgatgttcaagtcttgaagagaataaatattaaaacaagaacttgaaattctccaatgaccacttaaaacttctcttgttcttaaaaaacacatcaagcaaaaatattttcaggtttgctcttaaaaagtgattcagatttgagaggttacacaaaatgacttgcagtgagttttctcagtaacacttaagtatcatttcatacacatccttgttctcttattgctcttctttagtttcagcagaaaaaaaattatctcccatcttttctttaagtgaagttaatccttcattttctgttccatgtgccatctcttcttatcatttcccccaccaaatttatttctccttcctcagtcattctatccttccatccctcatctgaaataaacatttaatagatacctactatatgactcagtttaaaaccgaccaaaatatcaaaccagcccatgtgattaatggcaactagacaatagtgaacactgaattgaaggtggcagtagcagctggtagtgaggcaaggaagaaaagaagtgcttttcttgtttcagagttttcagactaacagccacatggcagaatactggctcaggggcactcttgctcttatatgttccctgctgtgtagaatgaaagatactttcaaagtgaagttacattcctgaaaacatacattatccaaattagtttgtttcataggttattatacagtaggtatcatgtgaccatattgaaattaaatatatttttgtgtagaaccatatcagaaagttagaaaatacattattacaactccttaaaagaaaattgcgactaatatttttgactgttttatttatttcaaatcttaattccatattgcaattatgcctgagcctttgtctaaatttttaatttttaatacaccaataattgagctaaatacagctgaaaaaatgagggctacctaggtatgaggggaaagaaacatctataacaaaaaaatgtattttaaatgataatcattcaaatattaacaagcattataagcatataattaaaaagcatttataagccagtgtgttggtttagtttttgatgcacttgaagtactttgatgcattgcttgataaacataaggaggtgcccggcattgagttagaatatagagtctaatataaagatgatgacctggttcccatttttcaaggagcttgcagtctacaggagaggaagtgaagtaacgcagtttttaaagtttatgatattaattcagctttggaacccagctgagaacaggagaagaaatggacttcaattgatgctgcttcttttatgcagaatgagaactcacctgttagtttaaagggaattattattgtgatatgtaacacagagtagagtcctttctcaagcttttgtactaaatagcatgattcccattactttagggtggttttgctgtttactttagaggaagcatgagaatagattaggtcatctctcaaagtctctttatatttattctatgattatgtaagaactataaaaacatcctttggaaagaaattttccattaaaacacatgagttgagtcttgagaggattgaaattttgtcctttattctaaaagttattgaaaactggtatgagcaaaggcaaaagagtgacggtttctgtgactttgaggccacagtttgtaaaagagaaaaaaacatactttagagagaaaagttttcaagtgtctaacaatatacaaggattatctgggttttattctgtttcgcaggaatcaatgctttggatctgtagacagcatttagagataatggttggatgatagttttctattatttcaatggaaatgtagtttgctaaataatactttttttttttgaaacagagtctcgctctgtcgcccaggctggagtgcagtggcgcgatcttggctcgctgcaatctccgcctccagggttcaagctattctcctgcctcagcctccccagtagctgggactacaggcgcccgccaccacgcctggctaatttttttgtatttttagtagagacggggtttcaccgtgttagccaggatggtctcagtctcctgacctcatgatccgcccgctttggcctctcaaagtgctgggattacaggcttgagccaccgtgcctggcctttgctaaataatactttttaaacatctcaataaaacgtgtaggccaagaaaaaaaatagcttgtaaaataatcatagtattatagtagatttgaatttccagtgtcaaattatagcaagttttcttaacttttatttttcccatagcacatagatttacctccagtgctagataaggaccaatgacaatcaaataaaaaggcttgtcctattctgagctataatgtgactttctctgcttcattcttattactttgtttggaaaataggggagataaaaagaggtggaggcatacagtaagccaaatttctctctcttggttgatttcatgatgacaaaaaggaacctgctatgggagatattacagattcaggcaactcttcagatataagcactcagaggaggaagcattccttgtagttgttccatcttagtgtggtttgcttttctacatttagcctggcggaattctgatgtatggagtgagagtcagaatctggaacataggtgcaaactttcagtcctttaatctagagtgggattcctgtactcactacctgcccaaggggaaagtttactcactttctctctattatgcacctcctgtaatgacagacgtttcctatttgggatcacaaatgtttttcatctgtgctgtcttagcctccaactagtgctttacaaagctgaaggacaaaaatagttagcaacctctctgctatcagaagtgagctttttacaaactatattttattttcctttctttcctttcctttccctctcctcccctcccctcccctcccctcccttcccctcccctcccctcccctccctttcctttcctttttttctttctttccttttttttttttttttgacagtcttgctctgtcgcccaggctagagtgcagtagtgtgatcttggctcaccacagcctccacctcccaggttcatgccattctcctgcctcagcctcccaagtagctgagattacaggcatgcaccaccacgcccagctaatttttgtatttttagtagagatggagttttgccaagttagcaaggctggcctggaagtcctgatctcaggtgatccatccacctcggcctcccaaagtactgggattacaagcatgagccactgtacctggcctacaaactatattttctaatacaattgctattttacttcacaactttattcagaataatccacacctcataaaccctatacacatggtaatccggtaatccttaatatgaggtagggtcattatgaaactggattgtgagttgctggggtagggatggagatattataggtggatatctccctcctcccaacataatctgttcagacagactctgtgacaaccttttctccatgaaactcactctgcttggtggctatcccatctgtcttggacatcagcaaggaagaagaggcctattttcaatatcatttccagctattgttgcaggtccttctgtttaaagtataaatattggccgggtgtggtggctcatgcctgtaatcccagcactttggaaggctgaagcagacagatcacttgaggccaggagtttaagaacagcctggccgatatagtggaacccagtctctactaaaaatataaaaaaattagccaggcctggtagcacacacctataatcatagctactcaggaggctgaggcatgagaattgcatgaacccaggaggcagaggttgcagtgagccaagattgtgccaactgcactccagcctgggtgacagagtgagacgctgcctcaaaaaaaaaaaaaagtataaatattaatagatacttcttaacctaatctgggaagtcccacagaagacaaacagtacttttcaaatattctataccatatagcaataccaatagagaaaaatattatcattctgtttgttaggtcaaatgagatctgaatgtaaaatcaaattctgtcttcagtgtataaccttggaaatgagatcgctttctatgttgaaaagacttgtggaaaaatattacaggaataaaacaatgcattttgtggttgttggtttcaaaatgattaaaagaggattacacttattaagaaaaaataagattgcatgttatttgaacattatagctctagctatatgatgtctttttgagaaaattaattattagttttccaaaccattaaaccagaggctggagtacagatcaaagttggttttttttgtgtgaattttctttggtaccaaatataattttttccctttctagtgacttccttgaacagaactgattggcctcataagtgacccttaatagaaatcaccaaacagaggcagaaatggaagcttgatgacttagtccttcctcttgtaactgcagataagagtaaacaattgttttccaaaagtttgcatataccattgcacttcctttaatgagaaatacttgttcacagggttacagctagattaaatgatccaaaagttagccccataccagtcgattactcttattcttccaactgttagagcagggcataatgcacactacaaaatttgagagagaaaatacttttccttcttccctgactttataccagaattgctatgttggtaaattaaacataattattctttcacttctgactttactcttggagaaacatcctcctgtttatgtagtacaataagatggacaatagacatcaaaggctcccatatgtcttccttagtggcttcccataatgctgagaattcttctgtaaacatcaaatcatttaaacctagaactatgtgaccttggtagaaaatgactttaacttacttaacttttcatttcctcataaaaataaagttaatgccaaaactcaattgttcatccttcttttttagagagaaactatttttgtaaatgaagtcctatttggaatcccaattataaagcaaataacatcataactgttctacttgattggaggcagtggaggcagaatcctagatgtgaagaccttgcctcagcccctgaagcctctctgggaaaccacagggcctctcagaaaacagtttgaaaatcgatgggcaatatgatcaccacaagaccttttagttctgagacactttgattccaataagtaattactgaatgtttccatgttatttgctctatactctggtatagttcatgggaatcaacaggagaggtcccgctcatcaaaggattgcatgatttgggtaaatggaaagcctaagaattttttagggtaagcaggaccactccaagggggcagagaggagtgctgtgtttggtggtgaacagtgagacatgaagggagatactgcccttccccaaaaggtgggggaagaatcatcaacctttcaaagttggcatgcaaagtctttgatatatagaaatggtggcatgcaaagtctttgatttatagagaaccttttgccacagaggttgaggctaggatgcaacaatggtggaaactgccattaccacttggccttccacccaagccactgtgtgatataaagccttctgcttaaagccaggggcacaggtatagttagggaacctgtgaaaattttcttgttaaaattctactttctaaaagaaggaagaaagttactatccccaacatttcctcttcacaacttatgaagcaacatcattcatctgggataatacctgaggttcgttgcctcatgccaaggaaatcaaggacatgaacacttgtggagtgaggttaagagccgaggtttaatatgcaaagaaagagaaaagagagtagctctctttcctgcagagagagaggggctcctgagtgggtcttccagtcccatcgtgaagtgcatgggtttttatagactggattgaggaagtggtgtctgatttacatagggcccaaagattggcccaggcatgatgtttacatagtgcctgaaggagctggccacccaccttaatctattatgcaaatgaggtttctacctggccagcgccatgttgtctgcttcttactgtacacatggttgataaaaggaaagatggaactgtcatgttgaatatgtctagcccccaggtagtcttttactattgtcacatctgccgacattcactcgtgcaagcttccagcttgcttatctatgtttgcagctcaattttacaggctgctttttgttagaaaagaaataattttggtgctgctttttataaaaagggaaaccttactgaggactttcttaccctcactatctgccaaaataatttctttttaacgctcatgtcagttggacctctctgctcagagccaacccaagttacaggttgaggcccatggacagtactacccctaaacattgctttcccctaatgccaaaagtccacattaaaatgaaaatacttctgagagagtgagttatgccttgatcaaacattatcttgcatgtaatagtaggtgaaaccagagtatgaagcaacagggttgcaaataggtacagtaaatagtgtttttcaggttaaatggatatgcagatgtatcttgataaattgtgtcatattttactctttatcatgttaggcgagattttttttttccacctctcctccacactcaacccaacctacatcttaccccttaaattgcaaactcgttgggagaagagattattgcatgtaaagtctgtcaataaatgttggttaagcaaaagagagatagagaaaaggagggagggaaggagagagaaaagaaagaatgctactgcatcccctctgtgtagctttatggcattcatgatctactaaactctgggattattttagagatagtaggaagacaagtagtgggaaaatcagcatattttaacagttggttaaagaagaatataagcagaaaaatcagagtggcaactggaacaaagaagaaagtcaggtcagatatctgcagctgtagtaggaaagaatggagtattagaagctggttaggtccggggaagtctttccgggggtaatcacacaaagcaagctgttaagttctgcaggttgcttgttaaaacattataagatgctgtaatcccagcactttgggaggccgaggcgggtggatcatgaagtcaggagatcaagatcatcgtacctaatactgtgaaaccccgtctctactaaaaatacgaaaaattagctgggcgtggtggcacaagcctgttgtcccagttactcgggaggctgaggcaggagaattgcttgaacctggaaggcagaggttgcagtgagccgagatcgcaccactgcactccagcctgggcaacagagtgagactctccctcaaaaaaataaagaaaaatttaaaaacctttaagtttacatagtttaaaaataatctgtaataattaaaaatgtacctgtgtacgttttgctggaagtggctcctataaaggttatctttagcttgtctattacaacagtctagtagattccttcacacctctgaaaggcttactttgtgcatttactcagggtcttccacctgaacatacagctctgcctcaccagtgtgcactcacactatgactggcagctccttttttatccccaaaccactgccaaaaacactagtatgtaaattttgtagaaagcatgatgttacctccttaatgtatgcatcctctttctatagattattttctgcagtcttaaggacaccctatgatcccaatagcctgccactggaatacttttcttttcattgacacttttaattaaaagaataaagcactaaggatgaaattggagtctccttatttggctctcttgtcctatatccttccttccttaggggcaatcactataaaaaatttaatgtccatccttccaggttatgttgcattattttactattcataaatatagtagaagtggggctttgtgattttaaattttttatacaaatgatgctataccggttgatctacaacttgcttttttcactccattttagatttttgaaaactactcacatggatgcctatcagtctaattcattcattttaacatattctactatataaacatagcaaaacttatccattccctatcaataggcatttataccacatcatatttttttttgctactgcaaataatgcagtaaacatatttctacatataaccttttacctctatgtaagagtttatgtcgtgtacctagaggaagaattttggggcaaagagattagcaagtttaaaacttattagatattgctatttatttcttcagaatctttgtataaatttttattattggcagcattacatgaatgtttccatgcataagaatgtggtagtctcaggtatttaattattttccgttccagtggctgtgaaataatatatcactactatagtgactgcacaatcttcatggctgaagatttgagcatcttttcctttgtttttaattcagatttccacttaatgaattggaatttaaaatgcattccccacttttctactggattgtttttcaagttcttttattatagatgccaatcctccatttgctctatgttctggaaatatatactgttcttttattttttaattttatgatatatttttacttgtaatgtgcttaagttgatcattcttatccttcatgacttatgctttcagagtcctaaaatatttttagctcactgttatacatatacttacatatttcctacattttcaaatgaattttagaagactacattgatgttttaatgtacaaaaatgtatttgggtatatgctttgagaaaggaagctaatattttttaaattcttttttccatatggaaaccagttgtgccaacattatcaattgcatccttcactgtggttttgtgctgctgtttctttattttataataagtcagttcccatgtacaggcatatcttgttttattgtagtttgctttattttgcttcacacttcacaggtaccattttatttttctttttaaaattgatacataatcgaggtacatattttgggggtacatgtaataatttgatattcatataatgtgtaaagatcaaatcagggtaattgggacatccatcatcttaaatattttaaaaataattttattttaattttttctttaaagttgtatctgctttcatttggttaaaacttaaaaggcagtatcaatcatagtttgctcaaggatgtggaaattcaaagaattcattttcagaaatattcattgattactatattcctagccctggggatactgaggacagtagggatactgagatgaatgacatgatttccctcaaggctctcaatctattaggagatgaaggcatgtgatttataaattatggtatgactttgatgacctggtaaggcagcaatagacgcatagaagaaggagacagtaacagtatcaaggaccgctttccaaagaagatgccacctcattgggttatttttatagtcattttaaatttttttaattgagataaaatatacatataaaatttaccatccacatcattttaattatatagttcagtggtaataaatacatttatattcttttttctccttgcccgccccctcacctacccttcccagaattttattggtttaattgaaacataatagatgtacatattttcaaggtacatgtgataatctagcacttttctttaatgtgtatatatcaaaccagtgtaattagaatattcatcatcttaattatttgtcttttctttatgctacaaacatttgaaatatccccttctagctattttgaaatatacaatagataatcataaagtatagtcacacttctgttctattgaacatgatgtcttattttttgtctatctaactctatatttgtgcccactaatcagcctatctttataacctcttcccccatacccttcccagcctctggtaaccaccaatgtactggctaccttcaagaggtccactttcttagctctcatagatgagtgagaacatgcaatatttgtctttctgtgcttagcatatttcagtaatcataataacttccagtttcatccatattgttgcaaataacaatattttattcattttcatgactgaataattttccattgtgtatatatgccacgttgtctctatgcattcatccactgatgggaacttaggttgattccacatgttggctattgtaaatagtgctgcgataaacatgagaatgcagacatttctttaatatattgattttctttcttttgagtttatatctagtaatggaattgctgaaccatatggtagttttaagttttttgaggaacctccgtatagttttccatagtggctgtactaattcacattcttaccagcagtgtatgatggttcccctttctccatatccttgccagcatcattattactgatctttttgataaaaaactgttttagctagggtaagatgatatcacattatggttttgatatgcatttccctgatgattggagatgttgagtttttttcatataccatttgtatgtcttattttgataaatggctattcagatattttgcccatttttgcttccgattagtttttgttgttgttgttgttgttattgagttatttgagctccttatatattctgattattaattcctggtcagatggatagtttgcaaatattttcttccattccgtgggatatctcttcacttttttgattgttttctttgctgtgccaggaccttttaccttgatgtaacccaatttttttatttttgcttttgttttctgttcttttgaggtcttacacaaaaatcctttgcccagtctgatgttctcaagtgtttttccaatattatcttctagtagttttatagtttcaggccttagattaaagcctttatccattttgatatgattgttgtatatgatgtgaggtagaggtctagtttcattcttctgcatatggtaatagagttttctcagaactattatgtttctctctctctctctctctctctctctctctctctctctctctcattttctctatctctagctctctctctatttacagacagggtctcactctgttgcccaagctggagtgcattgggacaatcttgactcactgcagcctcaacctctgggcacaagtgagtctcctgcctctgcctcctgagtacttggggctaccggcacatgccactagtgcagctattttttgcatttttttgtagagatgggattttgccatgttgcccaggctggtctcaaactcctgagctcaagtgatttccccgccttggcctcccaaagtgctgaggttacaaacatgtactaccacgcctggccccaaaccatatattgagaagagtgtcttttccctattatatgttcttggcatctttgttgaaaatgtgttggctgtaaatgtgcagatttacatctggcttctctcttctgttcctttggtctgtgtgtctgtttttatgccaataccatgctgatttggttactatagttttatagtatattttgaagttcagataatgtgatgcttcagctttttctttattttcagaaaaaaaaaagattgctttggccttttgagttcttacgtggttccatataaattttagaattgttttttctatttttgtgaaaatagtattggcattttcatagtgagtatatttaatctgtggatttctttgggtactatattcattttaacaatattacttcttctaattcatgaacatggaatatccactttcttgtgtcctcttcaattttttttcatcagtgttttttagtttttcttgtatagatattttacttctttggttaaattgatccctaagtattttcttcttgtagctattttaattggattgctttcttgattttttattcagattgtttgctgttgatatatagaaatgatactgatttttgcatgttgattttctaacctgcaactgtactgaattcgtttatcccttcttataattttttggtggagtctaggtttttctaatataatatcatgtcatctgtgaatagggataattcaactcattaccttccagtttgaatgtcctttgttttgctgccctacttactctggccaggacttccagtattatattggataaaagtggtaaaagtgggcatcattgtcttgttctaggtttttgaggaaacgcttttaatttttccctgttctgtatgttagctatgtgtttgtcatttatggcctttattattttgaggtatgttttttctatactctgtttgttgcggtttttatcatgaagggacgttaaattttatcaaatgctttttcagcatctattgaaatgatcttacggtttttttttttttggttctgttaatgtgatgtatcacattgattgacatgagtatcttgaaccatactacttgcatcctaggaataaatcccacttgatcatggtgaatgagtttggaagtattccctcctctccagttttttgtttttttttttaaagaatttgtgtagaattgctgttagtagttcttaaatatttagtagaattcagtggtgaagccatcaggtcctgggcttttctttgatcggagactttttattatagcttctatcttattactcagtaaaggaaagctgaaagatattgcgtttttttacaaatcaaaggtctgtggcaatcctgcattgagcaagtggttaggcaacattctttcaagaacagtctcacttcatgtctctgtatcacatttggtaattcttgaaatattttaatttttttcatgattattatgtgtattatagtgatctgtgatcagtgacctttgatattactattgtaattgttttggaacaccgcatactgtgcccatttataatggtgaacttaaaaaacgttgtgtgtattctgagtactccacatataggccattagttctctttctctcttttttggcatcctgatttctgcagacacaacaatattgaaattaggccaattagtaaccctacattggcctctgagtgtttaagtgagctgaagagtcacacatctctcactttaaattgaaaactagaaatgattaagcttagcggggaaggcatgtcgaaagtcaataggctgaaaggtaggcctgttgtgcctgttagccaagttgtataaggaaaagttcttgaaggaaattaaaaatactacttcagtgaatacacaaatgataaaaaagcaaaacaactttattgctcatataaagaaagttttagtgatctggatagatcatatcagccacaacattctcttccttaagccaaagcctaattcacaacaaggccctaaggctccacaattctatgaagggtaagaggagtgaggaagccacagaagaaaagtttgaagttggaagaggtcagttcatggagttaaaggaaaaagctctctccataacataaaagtacaaggcaaagcaaagaaacaagtgcttatgcagaagctgctgcaagttatccagaagacctagttaagataattgatgaaggtgactacactaaacaacagattttcaatatagacaaaacagccttctattggacgaaaacgacaccaggacttttaaagctggagaacagaagtcagtgcctggcttccaagcttcaaagaacaagctgattctcttattaggagttaatgcagctggtgactctaagctgaagccagtgctccattttgcattctgaaaatcctagagcctttgggaattatgctgagtctactctacttgtgctctgttaatggagccacaaacctggatgatagcacatttatttgcaacgtggtttactgaatacttacactgctcagaagaaaaagaaagattgctttcaaagtgttacagctcatttacaatgtacttggtcactcaagagctctgaaggagatgtacaaagagattaatgtgttcacacctacaaacacaacatctattctgcagcccatggatcagggagtaattttgactctcaagtctcattatttaagaaatacattttgtaaggctatagctgccaaacatagtgatttatcagatgaatctaggaaaaagtcaattgaaaaccttctggaaaggattcgccattctagatgtcattaaggccatttgtgattcatgggaggaggtcaaaataccaacattaataggagttggaaaaagttgattccaaccctcatggatgactttgaggggttcaagacttcagtgaaggaagtaactacagatgtggtagaactaaaaagagaactggaattagatatgaagcctgaaagtgggagtgaattcctgcaaactcatgattaaacttcagtgagtgaggagttgcttcttatggatgagcaaagtaaatgggtttctgagatggcatctactcctggtgaagatgttattgaacatcgttgaaatgacaaaggatttagaatattactacgtaaatttagttgataaagcagcagcagcgtttgagaggatggagtccaattttgaaagaattcctgctgtgggtgaaatgctatcaaacagtgtcacaaggtacaggcaaatctttcccagaaggaagagtcaatgaatgtgccaagcttcactgttgtcttatttcaataaattgccacagtcacctcacacttcaacaaccaccaccctgattagtcagcattcatcacaatggaggcaataaccttcatcagcaaaaagattacaatttgcggaaggctcagacgattgttagtatttttagcaataaagtatttttaattaaggcatgcacattattttttagacctaatgctattaaactaggaaaccaaaaaaagtgtgtgactcacttcattccaatatttgctttattatggtggtctggaactaagtctgctatgtttctgtggtatgcctgtgtgtgtgtgttttgtggccctctgttttgttgcaataattattttttaaatgtgttgtatgacaatatcatagtttctcaattatcacagctttttaatttcccttgatatttaatagggcaatgatgctcttctttttcttcttttttcagtgtttgcttgactatttttgtagaagtctttcaaaaaaatcttatcgtgttattgattctgagtgtattgtctttatatattaatttttagaagactgtatctttatatactaagctttttacctataaaattttgtcagtttattcatgtattcttttatctctttcaaaaatgctttatatttttctctgtaaaggtattgcactgcttttgtcagatttatcttatggacataatataatcattatgttattgtgaatgaattatttttgtattgtattacctatttttatcattaaaatatgggcatagtgttaagttttttatgttgatcttatatggagtgaacttaacaagtattcttattgattttaataggctgtctataggttgctttggactttttaatgtagccagtaatatttgctaatatggcagctagtctgtaaattatgattttgttgcaatcttgttccattttttttttcttatttcattagttagggctttggggcactttgttaaattgtagaaatgataacagtcctatgtgtctgatttctgatcttacacttaataatttctaaatggtgtaccatgtttttaataaatacatttcatcagatcaaggaaatttctggagattttcttagtttcttaaaatgcttgtgctttgttttggttctttagttagtttttggtagttgtgaataaatgtttaattttattaaaaatagtttactgtatataatgagataattttaggtttcttttttcaatcctttaacatggtgaattgtaccaatagatttttaaaattgacttatttgaggtataatctctctgtatgtataacgcatccattgtatgtgtgcagtttgatacatttttggctaccgtacgaatccttgtagccaatttcacaatcaagatagaaaaaaaaattaatcaccacagaatgttctgtcatgcccccttgtagtcaattatctttgctgtgaaggcaactgctgatctgattttcatcaagatcaagttttgcttgatcttgaatttcaaataatggaataatgcagtgtgtacaattttgcatctagcttctttcagttagcacaatggtgttgagagctatccatatttgtatgtgtatcagcaatatatttcttgttgtttggatagagcaaaatttgtttatacattcatgtgttgattgacatttatgttatttccagtatttgggtattattaataaagctgctatgaaatttcacatttaagtattcatgtgaacatgtattttaatttttctttctagtagtggaataccttggttatatggcaaacgtatgtttaaatttttaagtaatagctaccctgtttctaaagtgattgtagttttttacattcttccctgaagtgtagcagagtttgtgttgcttcacatcttatcaactcttattattgtcagtctttttaattgcagctattttaaagtatttgtcatggtatcttatggtttcaaatttcattaccccaagactaatgatattgagtatctttaggtgtacttttccctattcatatattctcttgtacagtctccattcaactcttttgtccacttgtaaattggtttgttatcttgatatagtattctagatataactagagagagatgtaatgaatatctatgtgtgtttatatatacttatatatacatttatatggatatataaatgatatggataatataaattattttcatatgtatttttttcttagtatatttcttagtatgttttcttagtatttcattttcttaaagatatcttgcaaagagcataactttaaatcttgattaaatcaaattcaaaagtaataaatcaaagtaatttatttttcttttaacactgatttttaaaactgcttatttgaaaaaaattatggattcataggaagttatagagatagtagagaggtgacagttatccttcaccagtttctcccagcagttacatctcattacgtagagtacaatatcaaaaacaggaatttggcattggtataatgtgcaagtatggttctacgtcattttatcacacgtgtaaattgtataagcaccattgcaatcaaactatagacatgttccttcaccacaaagctctctccctggttctgtctctttataatcactcgcactattctccttaaccattcagagctcctggcaactgctaatgtgttttttatctttataattttgtcattccatgactattatataaatgaaattatagaacttctgacctttggagactggcttttttcacttagcataatgccctgagatctattcaaattattgcatgtatcaatagttcatttatttttactgctgactagcgtcctatgacatggatgtgccacagtttgtttaactattgatctgttaatgaaaattttggatatttccagtttgggttattaaaataaagctgctatgattaatcatatgtagatttttgtgtagacatattttcatttcgctaggataaatgcctaaatgtgtaatggcttgttgaattatgagtgtatgtttagctttatgacatcgtacacgagacccagtttcacagcatcctctccaccatttggtattgtcactgctttttgttttatttgttctattaaatgtgtagagacatttcactatggtttttatttgcattttctaaatagctactaatattgattatcctttcataagcttgtcatccatatgtcctctttagtgaaataactgtctgtatcttttgccagtttccatattagattttttctgttgaattttgagagaattctttacatattacagaaactagtcctttggtggatttgtgatttacaatttttttcttccagttcattgcttgtctttttatcctcctaacaaggtctttctaagaacaattttttaaatgttgaagtccaaataattgattctttcatattatgctattggtatcattattaagaattaatccccaagccctatgtcttgaaattttctcctaagttaactaagagttttacatttttatattttacctttaaatctatggttcattttgagataatttttgcaaaaaatgtgaagtttaggtaaagtttcctctttttaaaatttatttttatttttgcctatgaatatccaattgctcaagcactagttgttgaaaagtttatcttccattgaattgcttttgaatctttgccaaaaaaaatcagttgaccagaaatgtgtgggtctttttctgggctctctattcggtttcataaatctaaatgccattccatttaccagtacaacacagtcttggttgctataaatataaagtaatcttaattgaataaagtaatccctcccattttattcttttctatcagagttgtttttagctattgtagttcccttatctttccatataagtttcggagaactcttgtccttaaatataaaaataattctagggccgggcacagtggctcacatctgtaattctagcactttgagaggccatggcaggtggatcgtgaggtcaggcatttgagaccagcctggtcaacatagtgaaaacttgtctctaataaaaatacaaaaaattagcctggcatggtggtgggtgcctgtaattccagctactcaggaggctgaggcaggagaatcacttgaatctgggagacggaggttgcggtgaactgagactgcgccactgcactccagcccgggcgacagtgtgagattccatctaaaaagataataataataataattctaggttttggtaaaaattgtgttaagcctttatataaatttggggattatctgtatcttgctatggtaacttttccaattcacaaacgtggtacatctcttcatctattgagatagtctttgaataatttcatcagtgtaatagggagtgtaatagggaaatttaagtctcaaacaatatttgtgtatttgtttatttttccttagtgtcagattttgctttatctattttgcagctttttatttggtacatgttcatttttgattgctttgtcttctaagtagattgacttctatatcattatgtgcctctctgatagttttctttgctttgaagtctgctttatctaatattagcacagatactattgctttattagattaatgtttgtatggtctttttccattgattactttcaactgccaatatcatgaattaaagtctgtggtaatttttatgcaaaagaaaacttatacacaatacaatacgtacagtaacctctagaaaaacaatacaaagaaatattctaaaaactaaaaaatgttcaagtaatccaaagcaatgcaagaaaaaagaaaatacagaaatgaaaatcagggagaacaaacagatgacaaaaaataaaaggataaacttaagccttaacatatcaataattacattaaatggtgtaaatgcaccaaataaaagttacagcataataaagtggattaaaaaacatgcctcaactatatgctctccataaggaacttaatccaaatgtaatggtattgggagtttgaaagtaaagcatggaaaaagataggccatacaaacattaatctaataaagcaacagtagccatgctaatattagataaagtagacttcaaagcaaagaaaactaacaaagaggcacattatataatgatatagaggccaatctacttagaagacatcgcaacaaaaatgaatatgcaccaaataaaaagctgcaaaataaataaagcaaaagctgacacaaaggaaaaacaaacaaatccacaaatattgtttgagacttaaactcccatactacactgatgaaattaactcaagatggattaaagacttaaacctaagacctaaaaccataaaaatcctagaagaaaatgtaggcaataccattcaggatataagcatgggcaaagacttcaggactaaaacaccaaaagcgatggcaacaaaagccaaaattgacaaataggatctaatgaaactaaagagcttctgcacagaaaaagaaactatcttcagagtgaacaggcaatctgcaaaatgggagaaaatttttgcaatctatccatctgacaaagggctaatacacagaatctacaaggaacttaaacaaatttacaagaaaaaaacaaccccatcaaagagtgggtgaaggatatgaacagacacttctcaaaagaagacatttatgcggccaatagttatatgaaaaaagctcataatcactagtcattagagaaatgcaaatcaaaaccacaatgagataccatctcacaccagttagaatggcgatcattaaaaagtcaggaaacaataggtggtggagaagctgtagagaaataggagtgcttttacactgttggtgggaaagtaaattaattcggtcattgtggaaaacagtgcggcgattcctcagtgatctagaaccagaaataccatttgacccagcaatcccattactgggtatatacccaaaggattataaatcattctacgataaagacacatgcacacatatgtttattgtagcactgttcatgataccaaagacttggaaccaacccacatgcccaacaatgatagactggataaagaaaatgtgacacatatacacgatggaatactatgtagccataaaaaaggatgagttcatgacctttgcagggacatggatgaagttggaaaccatcattctcagcaaactaacacaggaacagaaaaccaaacaccgcatgttctcactcataaatgggagttgaacaatgagaacacatggacacagagaggggaacatcacacactggggagttgttggggagtgggggactagggaagggatagcattaagagaaatagctaatgtacatgacgggttaatgggtacagcaaaccaccatgacacatgtatacctatgtaacaaacctgcacattctgcacatgtatcccagaacttcaagtgtgtgtgtgtgtatatatatatataaaatatatattaaatatatatttcatatatatttatgtataatataaaataatatatttaatataatatataatatttaatatatatatatttttaaaagcttgaaccttcctccttgggaactggagctgggacaagacaagaatactcactctcatcactcctgttcaacatgtactagaagtcctagccagagcagtcaggcaagaggaggaaatgaaaggcatctaaataaaaaaagaagtcgaaatatctctctcctctgaagatacgattctatacctaggatatcctaaagactcttccaaaagactcctggcactgataaataactttaataaagtctcaggatataaaatcagtaaaaatgtcagcagcatttctatacaccaacaaggtccaggttgagagtgaaatcaagaacacaatcccatttacaatagccacaaagaaaatgaagtactcataaatatagctaatgaaggaggtgaaagatttctacaagaactacaaaaccttgctgaataaatcggagacaacagaaataaatggaaaaacattctatgctcacagattggaagaattaatatcatacgaatatttatttttatatccttaacttatttgctacaactttctacttcacaaaactttctatttttttcatttgtttcagacatatttagaattgttttaaagtgttttgttttagcggcattggaatccttgtcctgtcatcctaacatctgtgtgtgaacatttgcatctgttgattgtctttcctcattccctttgatatctccctgggtcttgctatgacaagtaagttttgctggaaacctgaacagttagggtgttatgtttaagactttggatcttattaaaatctcgtgttttagcaggcatggtttgacatttctctagtgattgaaagggagttctgattcatttctaccaggttgagttggaagtccaggttctttagcctgcccccacggacacccaagtggaaagggctttatgttacttctggaaatggctgggagttgagacttcccactgagtctctgcttacagaaccctagttgggagggaaattagtacctaattgctgcttcccatcactgatatcaggggagtaacctccttagtactgagaagtggtcaaagtcctgactctcaactaggcctctcaactgggtcattctcttgcttaaaaacaatctgattccacattcctcctctaacaccattccagtgaggaagaaaggggcacatcactgctgcttcttttgggtggaagttcaggctttgagtcccaagatcaatagctaatctaccgtcttctctccaattttcagagtttatcatattttacatataatgaccagaattgttagttgcgtttagtgggagtaatagggagagtaggtctatttttcctggaagtggaagttccactaatgaattttacattgttaaagcacggttttatcacgggggtaaatacagcttggccagatgcgtacatatgtacatacatccacactgctagattaattgcaaaatattctttaggattttactcatctgtgacactggtatgtaatcttatcacatactttcttttctgatttcagtatcaagcttatactagccttagaaaattaattaggtgcatatctttctgtatcctacttctatagtcaaatgtatgctatgtggaagttatccattttataaatatttgttaaaatgtgtctaatagtttaaaatattagatattctttcatagggagaattttctactgattcaatttctttaataattgatattgtgctaagtttttctattatttttgagtaaattttggtaatttatatttttaagaaaatttttattttgatagtttaatagtcttagaaaattatccatttccttaagtttgaccattaattggcataaagatgtatatatcattctctcagaacttttcaaaatctttactgtacctttaactatatcctcttacataataataatattgtttatatgtacattctattttcttagtgctgcttaagatttatacttccattacaactttaaaaaagtctttatttatactcatttttccatgtcataagtttacgttattgtctttttttttgtactttgagtttataatgtgttttttttttatcttcttgagttgcacttaaactgatctattttacttttttgttatattttaaacaaagttttaaggttataacctttcttctgttacattaaatttatctcacaaatatatgtatgcatgtgatgtgttttagtgcatttagttttaatttttattaatgttttatcatttccattatgatttcttttcctataaaataaggcatgcttaaaagttttcaaatgtggttttcatttttgtttttgttgtattttgttttgttatatttgaatcaccattgttgatttcttatttgattggtctttttgatattctgtggaatatgttgaggcttcttcgtggccaggtagataattaatttttttttttttttttttttgtgagacggagtctcagtctgtctcccaggctggagtgcagtggtgcaatctcggctcactgcaagctccgcctcccgggttcacgccattctcctgcctcagcctcccgagtagctgggactacaggcgcctgccaacacgcctggctaattttttgtatttttagtagagtcgaggtttcaccgtgttagccaggatggtctctatctcctgacctcgtgatccacccgcctcggcctcccaaagtgctaggattacaggcgtgagccactgcgcccagcccataattaatttttaacagtattttatgtgaaaagaataaatatatttctgtttggtatgaattctgaacctacatctgtatttggtataggcttaagattcctatcttcataggcaaatcttttccattcacgttcctaggtggaaagaaaatttccctctgtttctccacttccgtagttaattcttatctcatgcttttatattttatgagtgtttttaataatattctttctggttttattcaaatagttctagaaagttatagcttttcttgtttacagattctattgtacctgggtttaccactactgtaaaagttgcgtgaccaatggtgttatttatcttggttttcaactgttagcatcccctgtccctagcacaatgcctagaacttagggacacttggtggatgggaaatgaatcaatgaatgaaatgtttcaatattcctgtgagcaattttgatttttactgcactgaagattagttttgagttgcttcttcatttgtaataattgggagattatgtttgattttgagcttagatatgttttaaagtttaacaaaatcatgttacctagtatttgtgtgtctgcatggaattttggtatatgtggaccagagggaagaatccttccatgtggtatcttattttgctttattgcctggcagactagactggattttcaaaaacagaaaataaaattttgattgtgttatatgtcattctcttgcttgaaaatattgtgtgattccacattgcgattaggatataatttatattccttaatacagtagtctccctgatctactatttactttccatggtttcagtcacccatggtcaacagtggtccaaaaatattcaatggaaaattccagaagttaataatgagtaagttttaagttgtatcccttctgagataggtaatgaaatcttatgaattctgctttgtccttcccaggacgtgagtcatccctttcttcagcatattcatgctgtatacactatccatagttaggcacttagtagtcatctccgttatcacacctaaacaatgtagcatgtttagagtttggtgctatccttggttctagtcatgcactggggatcttggaacatatccccgcaggaataagggctgactcctataaaatatgtaaggacttttgtgttagaaccttattcactctcctttcatttcttgcaattgtttactgtcgcactcccatgtctcagtccctaacactctatgctctttcaagcttcaatgccttttgaaatcctttttactctgccaggaataccttcacacatcaacaaaacccactcctctcccgaatgagtccttcccaaacccaatgttctccatggctgaagagttagaggatctcttctctgtgcttccatatcactttgttcatatctttaacatccttatgatactgaactgtcattgcaattcagtttttttctttttcttttttttttttgacagcgtcttgctctgtcacccaggctggagtgcagtggcacaatctaggctcactgcaagctccgcctcccaggtttacttatgccgttctcctccctcagcctcctgagtagctgggactacaggcggctgccaccacacctggctaattttttgtatttttagtagagatggggtttcaccatgttagccaggatggtctcgatctcctgacctcgtgatctgcctgcctcggcctcccaaagtgctgggatcacaggcatgagccaccgtgcctgaccaattcagtttttttagattactgttgaggctgtaaatgagtgatcaaaggtatgtgagttatgagttaaatcagcattaatctcccagcactcatccagttgcatccagaagtatgtctgaaacatacaccatccacaggtacttcctctgacctggaagcatgtgctccttattaataattcacaagacagtttaaggaattcaataaaagggaagataaagttatttgcagacttatctagcatacagtaggtactctgtaaaggctaatgacagctcagcaaccctctgatttcattaatgatttttctttgcactgtttttggctcccatgtgatgactttcaggcatactacacatgtatcaaagtcgtatctcttttaatatggtgacaaatagagcaaactgtttccaaagaagataatgaattatcaccagtgggaaatttatactgtgttatcactgaagaacctcagagcaaagatgtttaagggaattcctaaactagatagggtggaactcaatttacatacaaacttggagatctctcctattcaaatttccttcaaaaagtgtgttataatagaggtaaaacattgagggagaaaatacaacatttttacttttatcttagaagattgtaaattgactatatctatccatcttaatcttaaatgtaggcattaggtattatgaatatttatttttcgtggtaactggtgaataaacattccttgttttagtgaaaattcactacacataccaaaagatatcatagaatttagagctagaagatttagatagatgctggtgaaatattcttattttacttatatatgaaggaaaactgagggttagggagatgacatgtttccgtagattacgttcagatttacttcttggggatgctcacacaagaacctctgatggatctaatacacaggagacacacatatattattggtatttctatatactgagaattttggttttataggtcaccatgcagcatggttgaatagaatagtgctgttcgccgagtaaatattttatcagtttttttattttaaattgtttgtggaatttgaagacattaaaattgtataaccactacaaacttactttaatcccatttataggggaagtttcactataaagtagatggatgtactgtggtctcgcattaacgacattaaattgctgagctgcaaaatgaacctgttgtgagatgatatgtgccttctaagactaggaacattgggagcagcattatagggagtacccagcatgtaattacagacattttaccacaattttactaagcagaacaactgtatgtagaataaaaggcaatttatcagcgaacaaagactgtgtgtatatgtgtgtgtatttactatatctatctatatacacaatatctgtatatacatatatgattatctgcatatctgtacatgttttatatatatattacactgccccttgaataatagccaagatttttgcctattgtatacattttacattttattctttccccagctttattaaggcatagttgacaaataaattagctatttcaaggtgttaaaatataatgatttgatattcatatacattgtgaaatgattaccacaataaaagcaactaatacatccatcactatactgagttacgtgtgtgtgtgtgtgtgtgtgtgtggtgaggacacttatgtactatattaacacatttcgagaaaacaatgtagtattattggctatagttgtcatggtgtgtattagatccccagaatttattcatcttataactgaaagtttgtacactttgaccaaaaactatttcccccacccccagccctggcaactactgttctactctccacttttatgagttcagtttttttttttgtgagattttacttataagtgaaataatatttctcttttctttttctgccttatttcacctagtatatgtcctctagattaatcaatcttgtcatgaatggcaggagttttttctttttaatggctaaataatcatctgtgtgtgtgtgtgtgtgcgtttgtgtgtgtatacacatatatacacataacattgtcttcatctgctgacaaataggttttttgttttttgttttttgttttgagacggggtctcggagtctcgctgtctcgctgtctcccagactggagtgcagtggcgcgatctcagctcactgcaagctccgcccccagggttcacgccattctcctgccttagcctcccgagtagctgagactacaggcgccagccaccacgcctggctaattttttttttgtatttttagtagagacggggtttcaccaaaataggttgtttttataccttggctatagtgaataattctgcagtgaatatggcagtgcaggtatctcttcaacatgctaatctcattttatttaaatttatacctataagtgagattgctggattattatagtagttctagttttatgtttttgaggaacctccatactgctttacttaatggctgtaccaatttatgtttctgtcatcaatgtacaagagttcctttttgtgcatgccattaccaacacattatctcttgtgttttaattataaccattctaacaggtgtgaggtgatatctcattttggttttgatttgtatttctctgctgatgaatgatattgagcacctttttaaatgtgtattagccattaatgtcttttttgaaaaaaatacctgttttagaccccttgccaatttattaatcaaagagtttgtgattttgctatggagttatatattttggatattgaccctttatcagacatatagtttgcaaatattttctcccatttcacggtttccttttcattttgccgattgtttcctttgctgtgcaaaagcatgttaatttgatgaacctgtttatgttttattttgttgcctgcatttccagtgtcatatccaaggaaattattgctatcccggccaatacgttgccaatggtaaattttccttaaacttttatcttggagctttatgggttcaggtcctacacttaagaatccattccaagttaatttttatgtggtataaaataaggatccaattgtattcttttacatgtggatatctcatttttccaataccatttattgaagagacagtcctttccccattgtgtattcttggcaccttcatcaaatattagtttgccatatgtctgtggttttatttctgagctctctcttctgttccatcagtctatgtgtgtatttttatgctggtaccatattgtttcaattactataaccttgtaatatagcttgaaatcgggacaaatcatgccccagcttcgttcttttctttaaagattgctttggctattcagggcttttttatgattccatataagttttagaattttttttctatttctgtaaaaaagccattggaattctggtagagattcctttgactctgtaagcctttgaaaaagccatgggaattttggtagagattcctttgaatctgtaggtcacttaaaatgcaagctttttaaggatatcagtttttccagtgcaggcacactgaacatctttccatttatttatgttttcttcaattatttcatcgatgtcttatagttttcagtgtagtcttatagtttccagtgtacagatctttcacctccttcgttaaatttatatgtaagtatttaacattttgatatagtaaattttaatttttaaaaatttctttttcaagatggagtctcactctgtcaccaaagctggagtgtagtggggtaatcactgctaactgcagccttgacctcccaggctcaggtgatcttcccacatcaatctcctgagtagctggggctataggcatgtgccaccatgccctgcaaattttttttttgtattgtttgtagagactggttttgccatgttgcccactgttttaatattttttcagatagtttgttatattagtgtatagtttttttatcatgacactttagatttgtttatcagttttaagttttttggtggagtctagggttttccatatgtgagttattgtcacctgtaaacagaaacgatttacttcttcatttttttatttagatgccttttatttatttttttcttgccttatttctccagtgagaacttctagtactatgctggatagaaacgatgagagtgggagcccttgtcttgtttctgatcttaggggaaaatctttcagcttttcactgtcgagtatgatgttagctatgggcttattgtgtatggcttttattatgtacaggtgcattccctcgatatctgatttgctaagagtttttatcatgaaaagatgttgaattttgtcaagagctttttctgcatctattcagatcattatataattttcatccttcattcttttatttttgtgtatcacttttttttttttaactttaagacagggtcttgctctgtcacccaggagtgcagtggtaccatctaggctcactgcagcctcaatattctcaatcagtcctcccatctcagcctccccagtagctgggagtagaggtgtacaccaccatgcttggctaatttttgtatttttagtagagatagtgtcttgccccagctagtcttgcccaggctagtcttgaactcctgggccgtagtgatctgcccacttgggcctgccaaagtggattacaggcatgagccactgcactcagccgtgtatgccatttattgatttgcattccttgaaacatccttgcatcctagggataaattccatttgatcatggtgtatgatccttttactgtgccattgaatttggtttgttagcattttgttgaagacttttttgcatctatgttcatcaggaatagtggcctgtaattttcttgtagaatccttgtctggctttggtgtgagtaatgctggcccataaagtgagctgtaagtattatctcctcttcaattttttgaagagtttgagaaatactggtgttaaatcttggcacacaatgaagctatcttgtaatgggcttttctttgttgagagataattgatgactacttccatgttgttactcattattggtctgctcagactttatctttctttatgattcagtattggtaggttgtatgttctagtaatttatccatttcttccaggttattcaatttgatggcatgtaattattcaaagtggtctcttaagatcctttgtagttttgtgctaccagttgtaatgttgctcttccatttataattttatttatttgatccatttcccttattttcttggtgagtctagctaagagtttgacaattttgtttatattttcaaaaaaaccctcttagtttcatctatcttttccattgtcattgtagtctctatttcatttatttcttctgtaatctttattatttccttagttctgctgacattgggcttagtttgtttggttttgtatctagttctttgaagtaaaaatttaggttgtttatttgagatctttttttaaatgtgggtatttatcactgtatccctcttagaagtgcttttgctacatcctgtaagttttggtatattgtgtttctatttttgtttgtctctaaatatttattaatttcacctttgacccattggttcttcaggagtgtgttgttttatttccacatatttgtggatgttctaaaattcttcctgttattgatttctactttcaaatattgtggtcagaaaagacacttgatatgatttcaatgtttaaatttgttaagatgtgttttgtggcttgaagacttttccaaaatgtacactctagaggaatatatattctgttgctgttgggtagaatattgtgtcattttaaaatattttcaacaatatgattattaaataacagaatcttggaaaatataagagaatatgaatgaatatattaacctattactgaagtttaataacattatggggatgtttttctcaagtctatttctatatataactgtttttgtttttacatagtcaccttataacctgaagtaacctcaaacatgaggttacttcctaatttttattttatacatcaggaacattttctatatttttatttagcctctaaatgcattgattttaatggtcacagattattgcatcaaagtcatagaacataattttcaacccatagttctatatttaatcatgtatgcttttgcaattttttggtagtaaataatgaaacagtgccaatcttaacatattttttagtatttaaattgtatgtttgctggggttgccataacataatatcgaaaattgagtgacttagagtagccgaaatttattctgagttctggaggctggacgttcactatcaaggtgttggcagggccatactccctctgaaggaactaggggagaatcttctgaggcctctccccaagtttctgggaattgcttggcttgtggaagcatcactaatctttacttgatattattgtgtgtgcatatatctccaaatttcccctaatttttttttttttttttttttttttgagacggagtctcgctttgtcgccaggctggagtgcagtggtgcgatctcgactcactgcaacctccgcctcctgtgttcaagcgattcttgtgcctcagcctcccgaatagctgggattacaagcacgcaccaccatgcccagctaatttttgtatttttagtagagacggggtttcaccgtgtcagccaggctggtctcagactcctgacctcatgatctgcccgcctcagcctcccaaagtcctgggattacaggtgtgagcaaccgcatccggcccaaatttcccctttttataagaacaccaatcacagtggattatgagtccaccctgctctagtatggcatgttttaactagttccgtctgcagtggtcctatttctaaacaaggccacattgtgatgtaccagacgttaggacttcaacatttaaattggcagaggtaggacacaattcaacccataacaaaaataatttccttagcaccagtttccaaaagtggaattttcctgtcaaaacagtgtattgatagacatgttttgaaagttattttttaacttgtattattacaattttcatgctcatcaactatgcatgatagtgtttgattaataatattctcaacagccttgggaattatttttaatatcattaaaatcagtatctttaatcttcattaattttgtactctttagttgtagttttagtaaaatagataatttgtatgcatatttaccattgttgcattttaatttgtcaattatctagtaagtctaaatttaaaaatctctttccataggtttaataaatattcctttctctttttacttgtctttcttcctttaactattctatatttaaatctttaatgtatgtggaacttggtggcatatgtatgagatgaggatacaaatgaatattatagatacttaacctattgtccaagcaccatttactgactagtgcttctctttgtctttaataaaaaatgttttcttagtcattaaattcttgagtataagggtttcttaattatattttgtgtttcacttttaatctattattttgccaggaccatactgttttagctgttataaattattaatatttttatagattcatctcatagtgcttcttttacaaaattttagatatttttacttgtttattaatccagttacacttaaaattggtaaaatttcaagttacagcaatctgccattaggattttgactgtgaaatctacaaatctgttagattataattcatcttcactatatagaaaaatgaaataatattttccattattcagatttttagctattccatgaagtggtgtagcttattaaaattgtccattccaatatttaagaaatggttattagtcatctcctatatttcaggaatgtggtaaaagtaaaaaaaacagagagagagattaaaaaacagactaccatcaaggagctcaaattctgaaaggattgcagataaggaaactggcaaaggatgaagattagcaaagaggaatgcacagtgcacaatactgaacccaggatgacagcagggagaagtgtcacaagtttccagaaagagaggttgtgcttcagctaggtttgggacataacaggcagtcagctccatgaggatggagaacagttgtttcacagggaggaaacagcaatgcaaaggcacatagatttcaaagaacatggcacagaaatggaacttcaagaatgtaattgtgactgaagtttatgatgtgaatgagatataatgagtgatgagatcgcatttcacatggattttatgttctttcatgagggcactgtgtgtcattggtgggttttaagaaggagagtgacataattttatcttttttagaaagatttcagggaagaatacagcagggagacaagaaaacagtcaaagtgaacaaaaaaggttcactggccataaatatgtgttcagtgaatgaatgaaacattgaaagaactgatgtattaccagatttaacagctgaaaagtaattgatgaccttgttaagattacctgtatttagtgggatggttgagatggaagacagatatcaacaggagataatgaatataaagtactcattcaaaatattgcagatttgaaatcagatcttatttcattgttttccaaactagttgctagtgtataagaaataacattattattttgcttatgggttgactatatagttactctgttgactcttttatttgctgtaatagttttccatgtgattttgcatgttttgattactagatataaaattataattcttgtaaaaataactttctattttgacttctaataattatatagtttgttttggtttgttttaatatataggccagaattttcagaaagaagtgaaaattatgctttggacagtttcgtttgcttttaatggtgatggaaatgccctactatttcacacataaattgctgactgtaatactatatgtaatacttttttaacatattacacttaaagaagacccattacaatcccattttaaggaggttttgaacaactagaaggttttgattttttatcagatgacttttgctccctatgaaaattaagatatatattttctggccaattgatatgtcatattagattagtcatatcattattttaaatgatgctttgggtacaattttcttgaatatggtatattattcttctgcggtaatgctaaattttatttattttatatagtattttaaaataattatggccataaataagatttatcttttattactttacaatacattttaccctgttttgcatctgaagatacaaccctgaaatactgaaaaatctgcaccaaaatatttacttatgatagttaagcagcctatacttaatgagtcaagagaagtaatgcatttcagattttcatctgtaagggtcatcattgagctacatgaccttggacaaattttaatctttccattgctcatttatataaacaagggatttgaactaagtaaactccagtgtcactccagctctagcattttgccaacttgtatccatagagaagtttctccagttttatgctaataagcaaagatgaattaatgagtttcagagcaatagtactgtgtaaggtagtagtagactctatcctatgaccaggcaaatttaaacctgtgtttaaaaaatgatgatgcagtagtccattctccatctccttgtgtccatgagtagctggacctggaaaatgttggccctatgatttatcttgcattgcatctgaaaactgtagaccaagcacccttcactgttctgttcagctcacctgaaacattagatgtaaagagcaccagatgggagatcaggagccctggatttgtgtccctcttctgccatttactagctttgtgatcttaatcaagtcacttaacctctttaggcatcagttttcttatgtgtaagatggaatcaacttaatcttttagctcgtaaactctatgatatgagaagccataaatatataaactcttaataaaacaactttaatctacagagtcatctgaggtttactttcccaaatactgatctcaattaattctatcaacaatgttgcgaggcagttagtcaaagtatttgtgattgtatttcagagttggatctaggctcttgactccaaagagtttggtagcttatccaatgtgtctagtaagtggcagagcctcagctggagcccaggacttctgattcttcaactatgttcttttcttaatataacacattgtctttcattaaatcctgtaatcacttttatacttttcaagcattctattacatttctctgcactttaaattgtgagaaccaactatccttgtacccttgggctcaaccttgaaactctgtttatttataattttaaacaatgtaacatattaacactctgttcatgtatatgtttaaacaatttcttgaaaagtactccatctaacatttatcccttcttttcctgattctctttcagatagcagttctgtggatgaaaaggttttaaatcatacttattcttccctcctgaggaatcttgtcttttgtacatgtttgtttgtgacatattagatctgtttgattcctctgttttagttttgaaatgtgcatgttatcccagctttccattatttggttgtcctttaagtgtgcctctgatatgttgcacttatggagaggtcacaccttgccagctgcgcttaccttagctatacttgccaacctaggggtctgctactgtcaaacacagcatcttttcttaagtctggctaatcatgacctttctgactgattcatgatcttcactgtgcatatcaagttttaagggcaaatagtacttggaatatgacatattttccgggactctgccagtgcatttgtttaaatgctgacagctaatttcaaaacctctactcataaaaacacagtagctttgacttggagctgaccctgcttagcatctgtcatactaggtgttacgtgtgtagtgcagctgacctgtgtcccgatttcgtgtacataaaactgtagtatgctaaaagcctgtttgttttgtttttctcttactcttcatttaaggctcgaatagtaagtggcaatgatttggatgcttccaaattttctgcactccaggtgtgtggtgggtaagtaccttcatacctttctaatttattccattcatagatggcacttggctgtgttctcaacatatatgctttgagtgcaagatgctgcatgattagctagcctcattgttacttcattttacaataaagttgacattatagtgttttcttaaaaaaatgtaatacatgttaactataaaacaattctaaaaatatgaatatgtatatgattatatatataagtcaaaatcaactaaccagtttaactgttaacattatcattacatacccaaatagaatcacaaaattttatacaaatgaattcatattgatacaattaatgctctctttcaatgtgcttgtttgcacttaatgatatatgtacatgaacatttttcctgtcaacaactcaatgaatataatctatactattatttttcatagttgcatagtattacacttaacataagtatcaaagtatttaaaatttaatcacaaaaataatgtatgaaatttattttctatgtaaaaaattcaagcagcctcgtctttaatgttaaaagttacgcactggtatcagtgtggcatgaatgttcataggcatttttctacgtgtttgcaatacgtatctgtgttcatataaaataagtagttttgcatcgtggtttttttttttgcattttaacataaaacagtccactctgtgtaaataaataagcatgaatttaatgctgactttgtatctagtgctgttaaaattgtcctatacataatgactcacttaatctttacaatggccgtatgaggtaagtactattttgactctaattttacaaatgaagaaaccaatccacaaagcacttaagagatgtttccttcagacagctagtgagtgacaaagtcagtattcaagctcagttaatccaattccagagcctgtaatctcaatttacatgccacattgcctctgcaacttgccgttttctctttttccatttaacaacaaatgctttgccaaattttctactttattattttgaagtgatgcaaatatttgaaaacattcatacaacatgttttattcttctattggtgggttttcaaaattatttctaattcataattgcaaattatgacataattatagatactatggtaaatatatcacaatagattttaaaagtgtaatttgtggatcaatgcttatacacagtttatatattcatatatacctctttatatatgaatatagagagatatctatataattaattatctatctatctatatagatttttgttttaaaaccaagaccgggttttgccatattgttcaggctggtcttgatctcctgagctcaggtgatccacacaccttggcctcccaaagtgctggaattacatacatgagccaccgtgcctggcaaataatttaaatatatatacatatatatgtatagtgtattagatgttttataaatgttgaaatttgaatacatttatgtacagtataaatagaagcaaaatttagaggcatgttttagtttttttatctaggcaaaaagtttcacagttctgttttgtaatacactcattttttgaaaatcagtttgttattaaatacatccacatgttacttattttaaataaaatatttgtaagatttaaagttttaaatgtaaagctcctacaaattaatatatatgtatcgtttttattttgatgtttccaaatagaagtgattaagatgttatttctgttacatctctaactttaatgtccttgaaatatatgaagaattactctcgttcatattctaatgttatagtaatttaaataagttataaaagcagctgtggtgaaagatcattatgaattattcagagatattaaggtagtgaatagactctctactacaacaccatgaatactgtgtctttaagttgaccagcaataataatttgacaactaaatacaatgattgtcttaggaaataattaagttgaattctaagttagttatgaaaattgttgggacatcgtgtcatgcacctggaggtttatctgagtttatgatgttatagattctgcacctcccttcgcctacagcatctatcactttgtaaaaatttgatttgctaactcatgtctgaatatggacgtgatccttgtcagagcaacagagttaatctacatccatgcttttgttaagcacatgcagtataaatgtctggctaaaatagttcctctttgcatttcgaatagatctttccacattgttacgttttctgaaaatgcctctttcaacgactttctaagggattttggaactgtgatatatgggaagggggtgataattttcagtcatcaagagaatttgtcattgcctgaatgcttattttctcttaaagaacctgaagggtacgtttacatatgagccttcaatcacaacctctttcagaaagatgtgcttattttactttttctataaatattttagaatatatttttaaaataaaatgaaatactatttaaatatcacaacttctattatcctaaaaaactatgactggggcagacttttgaaatacggagtcattgcttttctattacaatgctgctaaatctttcacttttctaccttcgccatccccaatcagttgagagccaaacgacattcatccttcccttagtttactcaagtgtcaatgacagcataatctctacacactaaaaccaaattaataaactatatacactgaaaccagataatgaaattaataattctgctttctgatttctgcttagctctctgtacatttcctgtaagtgttgccagaaaagacatggcaaatgtcattctgtttttcctatctgtcacaataaaagttcagacaggctctggggaaaaactggaagagggacagagaagaggtgacagaaaaataaaaggagcaagagaaagtaggaaagatacatgttttggtgaaatcaatgaatttaacatttataccctttagtggttttataagattttgttaacttttatcatctatgtaagcaaagagtcatacagaaagcacacagcaactcaatatgaaaagtacaagaggtttagtggacagaaatgtctcaaagataaaatggagaggtagcagaagtaggtgagaagagcctttggaccatgacacagttcttaggtttgcaaaagtatatggagcaggaaggtgaattgagtatgaaaagcctgaaattgactataatgaggctaaaagaaagtcattcagacaaatgcagaggaaagtttgcttattagatgagtctttcattgggtacaagtagccagctctattatctccaccaagtttagccattggttgggagcagcttggggagggtgtagccttggggtgaatgctgcacccggtgaatgacacactggaggtgtgtcagctggaggcttttacccaactatcctgcagcagattctctctaagggatatctgagtgatacatgcccatggcagctaccgagcatcaatttgatgaaactacctttttttttttttttttgagatggagtcttgctctgttgcccagactggagtgcagtggcacaatctcggctcactgcaagctctgcctcccgggttcatgccattcccctgcctcagcctcctgagtagctgggactacaggcgccctccaccacgcccggccatttttttgtatttttagtagagacggggtttcaccatgttagccaggatggtctcgatctcctgacctcgtgatctgcctgcctcggcctcccaaagtgctgggattacaggcatgagccactgcgcccagcctgatgaaactacttttattcaatgatagtgaacaaagtcacatgagtaccttctccaaatgtgaaacacatttttaattagaataacactcctttggtgctttgattatatatgacttaagtttacctttcccttgacatttgtaattagaactccactggttgaattataagaagcatcacaaggggtgtgtgtgtgtgtgtgtattctgaaagtaccacaagtctataaaacagtggttgaattataagaagcattgcaaggtgtgtgcgtgtgtgtgtgtgtgtgtgtgtatgtgtgtgtctattctctaagcaccagacttgcatgcaccacaatttgggcaagtctataaagcaatggtgggattagggaaaaacagtttgaggaggatattatcatctttattttctttcttcactagtcattgaagttcttctctgcagtacagttctcatagcactaagttccttgagccgatgtgaaattcctctgtccatgattctgaactaggctggtaacttctgttcaacctctaccagaatgattgaaccttatcaggaaagaggcagtggttgcagaagtgaaataatgcagagacagagaaaaatgaagagacactgttgaaggaaagggcactgagatattgttaaattaaaacagaagcttctattttgacctcattttcaaacaggtacatttaccaaaaaatattaataagaaacgtatgctgagatttccaaggttgttcaattatcaccaggaacaactatcttggtaaatgtgaacaagccagttttcatccaaagtcctgcacaattccattgtttttcttaaatttaccttaattaaaatacccatttttgttaccgttgtagaactcaatgtcagttaggttcaacaaaggaataaagctggtttaacatatttttaattttctgtcacagtactgacattgcttttttatttgtctataaagttgagattgcctactatcctcacactctcttcctctttcatagtcttgacttccatgtttagccagggcctaaaatcttccacttagcatagaagataaagttgttcctactctccaggggctcttcacctaacttttctcattgcagcagtcttatctctcatagctgagaacttttaatttcagttcttcctatcaagtccactaatttgattcttccctgttccctcagataacttccctatttctcaagggtcagaaattctcctaagcctagacatgggctgtttcgactgccctttcttctgagtcagtggtttaccctacggcaccatccttgcatgctctgaatcaggtttgccaaatattaagaaaatgacagcccccacataacacagtgctttaatcatggaggaaggagccgttgtcttttatatggtttggttgtgtcacctaaatctcatctcaaattgtaatccccatgtgtcaaggagggacctggtgggaggtgattggatcatggggggcagtttcccccaggctgttctcctgctagggagttctcatgagatccgaggctttaaaagtgtttggcaattccccctgtccctggctctctgtctcctgctgccatgtaagagacgcctttcttcccctttggcttctaccaggattttacatttcctgaggtctccccagacatgcaaaactgtgagtcagttaaacctcttttctttataaattacccagtctcatgttgtgtttttatagcagtgtgaaaatggactaatatggtctttgaccttttagttagttatttttagggaacagtttcctttccctccagagaacttggtatagaaggagttcactatagagttaggtaagagtgaaatagagatttctacttattataagggttaacagatgtaaacagggcccactttcataattcattactgtatagccagtgactcatcatgcccatattttttcaacttatttgtattcacattaccactgatctagttttagtcctcagtaccttttacttaggcaattgcaaactgatcttctgagactgatcttctaaccaatcttcctttgttaatttcttcttccacattaaatctaatctctacactgttaaagatcaatgtctttaaaggacgggcctttctacctaaatatttttaatgactcttgtttttcttgaatgtaaaggacagttggccctctgtatctgtgggttctacatctgtggattcaaacagctgttgattgagaatatgctaaacaataataataaatagcaatgcaacaataagaaacacaaatagaaatacaagatcacaactgttaatgtagcatttacattgtatttggtcatgtaagtaacctagagataatttaaagtatatgggatgacgtgcacaggaaatacacaaatactgtgccattttatataaggcagttgagtatctgcagattttggtctctgacaggggatcctggaactaatctcctatggataccaaaggataactttatagctcttttcacatggctttgaatatatttcttgattcctatttctctctctttttactatggtaaagtattatcactgtttttagtgtttctatttttttggtatcagttctgtagcttatattagtttgataagttgcatagatttaacaagattcttatcctccaacttgatttcaaattcctaaggagtttaaaataagttgatttgcttaaattattacaggagaaacaacccttgacatctcttggccagtgttgggcacaatcatgccacaaggcagttacagctgctcgaaaggagcctcatgtgagacttcagggagtacgcctaatcacagactcttgattgtatcatgcctgttagtcctcagcacactgtctgcagtcctcacgcagagcaagcacataatgtcctatgcacaaaggcttaatctagacagagagtttcttaattaggaaaactgttaaccacaaggccgccaactttctaaaacccatgaatcaagaagtggttgctgagccattagcttcctgtggtcaagaagactgcctatctaattttggcctacctccagctctctctagtctcaggagcacttgatatcttctctacttagaaagtcataagatcattaggttagcttttgatattaactacaaagaccagacatcagggtgactacttcaatgtgtggatctatgagacctcacaaccccagacccatttagtgggaaatatactttggtacagcatctatgaaattaagataaaatttactatctatattcccaaccaggcttagttaaaccatagttttcttggggtagattataaatagtttcttttaggcatattttattcctaaatttatggtggcaaaataatcataaaactgactcagaagattaagaaaatggagctgtcatcctgaagctgctaatagctcatagttcaccaagttgtagattggcacctttttgatcatctctctttctggcttgggtttatagcttaacattctttcttactgagtggtagaccataaacccaggaaaaaatatttgactattacccacggttgatcagggatactgtataagactcccccatcttcgggtaatattagaaaataggtccatccatcctcacacatatataagaaacctgatgtctattgtaatagaggccatcttctgagctttaggaggctgaccataaaaaagttattcccccaaatcacattttttacttccattatttaatagtatttaagaacatgaaacctcaggataatcctagtacatgtaagccaggagaacctccaattttactcattatatgaaaactactcttttattccttttttttctgagatggagtctcactctcactgaagcaggagtgcagtggcctgatctcggctgactgcaacctccgcctcctgggctaaagtgattctctcgcctcagcctcccgagtagatgggattacaggcgcgtgccatcatgcctggctaatttttttgtattttagtagagatggggtttcaccaagttgcccagggtggttttgaactcctgagctcaggcaatctgccaccctgggcctcccaaagtgctgggatgatacgagtgagccacagcacccagcatttacattccagatcaagatccctttcaagccacgatgcacacaatggttctactttggggaaggaaatcagagctgccatcaactctgacaactttcctttagccagttcctggcgctggagcgttccataatggatctacacagctctggttggcttcttagaaagggcctgcttttcctttcatctttaggtgactgccgataaaaacacactcaataggaaatttacctttccctgatttctgtgagccactaactcgacctcataatatttgagacgtactttaaaagaaccccaaatcacgcacttccaaaggactagcatttggtaagaccgtctgcatattagcgatataagtttcatcacacacccaactcccaaaggcagtcttttctcaattagaaaactaaggccatcaacataagcttaagcatagtactacttctatcccctcaccctcatgaactcattcacaattttttttctcactccagggtctaaatctcaagccagtgctggtactcacttctggctttgagtatcacaggagtgccaacttaatatggcagctagcggggccaatccagcctcagaaaaatgaaattgctagttaagaaacctgaagacagtatatttgttgatgagaaaaaagtattgtattgaaacacatttccttctctgtgttcaatttgcttattcaacatttatatattagtatacatttcagctctttatatatcagattcttaatcttgacccctaagtctctagggcttaaatttatgaggaaattaatgaatcttagctacatcagagtcaagcttaatcttctaatgccttccagatattcttgagtttgaagagtagcaaattaaaaccactgatacatcctttatgaaggcagtgtttgagtcgtcagtcttaaagtggtgcaagtttagtaactacagaaaatatcatgttacattgagcagaataatcacttgtgttagaaaattaccagctattagctgggaaacactgaaaataaccccactaaataagatggaaagtgtaagaaatgccatggtttctacacctactggttctttccaagctgtaattgataatggctgttgggcacatctaatatatataaaagtcttagagagaaaaaaaaaagaggaacactgagggtgataattgtattttccaatgaagcatatatagagtatgtttttaggtatcttttaatgaatgaataccttattccatgaaggtagatgacatagattccctcttacagacagactatatagtagtcagagagaacaataaaataatcactgctaaaaatgtgtgctgctgctgctataagcttgtaaataattactcacttcttatttaaagcaacaagtttgcttaatccatatactttcttaaatatgaaacaacttgctcaaagaactgcactgtaatccatattttcagatatgacaaaatctatctaagactagcagattaagagttcttagtttttagtctgtcttaacatttagaaagaatataaaataaaataattaagcaacactttagatgtcatttaaaaatggtatatctcaaattcataattattatgatataagtaatactttttgaaatattgtaatataacagacccatatctgagcattctttagcattacttcctttaattcttgtagcaacttttggaggtaggtatgataattattattcatattttacagatgagataattcagaaatccagacactaagcaaatatcaagatcagtgacagtatcagagctgagatttgaactagatctagctgactccagaatttgattgctttgcttttatgcgaaattgatacaattttacacatcaataatgctcatttctggatctgttctattaaatattgtactgtacacttacattatattttaaatttaacattacattatgtattggtctgaaaagatttctaagtatatgtaccaaataaatgtagatatatttctagatttcaaaagtatatttgcaaaggaatttcaggatatatcctagaaaaatatggcctagataaactagtaataggttgaatgactggacccaaggtgtgataattcatgattgatattgtactcaggggtggctcttattgaaatgcctcaggaattgcctttacatagatttctaaaaattggtatataatagaggtacatattttaggggtacctgtggtattttgatttattcatataacatgtaataattaaaccagggtaattgaaatactcattaccttaaacatttttctttatgcctggaatattcaaattattctgtactagctattttgaaatatataataaattatatattgttgtagtcactcaactgatttattgagcactaggtcttatttcccctatctaactatatttttgtacctattaacctctcttcttccccacctcctctgtattcttcctggcctctgttattcaccaatctactttctattggtattttgatacatgttgcattgaatctgtagattgctttgggtaatatggacattttagcaatattacattttccaatccatgaatatggacttagattgtttttaactggaaaagataaaaatataaaatacatacttatacaatttaagggtgacatatacctgggaaaataattagtatattaataatggaattaatgtctaaaagatcttagcatattacaacaatgagctgaaactaacaagatggagtataaatcgtatattaaccaagataacctaggttatgatacagtaattaacaactaccaaatttcagtatattaattaaataaaatgttatttctcatccatgcaacatttccgttttttccccttatttctcagaatttaagcatgcaacatatagatatgaggaggagggtgcactttgatcttcatagttgttcagggaaccatgctgacagaggctttgccttcatacacgctgaatctagaaaagagaaggttcaagtgagaattcatgttagaggtcttcaagtattcaaaagattaggttataaaagggactatattgtcctgagcttctcattggacagaacgtggatcattgaagaaattgtgtataggcaggcttctgaccaatataagaagatatttccaataataagaactgtctttgtaaatactaagtttcctactgctagagacttttaaataaattaggtgctcagttgttagaaatattgcaaaagaaatttaaatatcagatgcttgattatttaaaacctgttccaatcttaatgtcctatccttatattctatcataatatagtacctgtatcagttagacattgccatgtaacaaaccactccaaaactcagtggcttaaacaatgattccttgggtcttgtctacattcactcatgcatgtgtggtcagcccaacagaggccattgctcacatttctggaggctctttggctattctggagcgggggcatttgggctgttattcatcatccagctggccaaaccaaacttgattatatgatggtgacaggattctaaagaataagtggaagcatgcaaggccatttgaatccaaaactggaactgacacctatcacttttgccacattctattgtgaaaacacgtcataagtcccactgagattcaaggaatgtggaaatgaggctctgttttctttataagaggagcgagtgactgaggccatttttgacaatagagtataatcatgtatattcacaattaaatattcttcaaattatatattttccacaatttagagaaaatagaatatcatttcttatatttacttccacttatttgtattttaaataatggaaaaatagatattgccatgaaaacatcagaatctcattttcagtagtacctaattattctgttacaatatgggataaagagtaatgtactttccagatgggtgaataaaagtgttctgtacatttaagagaagctgcatttctgatttggagttctcagtgcagactttatggagaaggtggaattaaattgggcttaaatgtttggattcaattttgacacatggatatggaaaataaaatgcagaccagaaagcagtacaaaacatgagttgcatcataggcaagaaagtggacagtagtatgtccgatcatgtggaggaaagaagtggaaaatatgttgggaaatgtaagttgaaagtttgaatgcctgaccaaagatactaaatatattaacctttgaataacatatttctgtaatttgaaatacctacatcttgtgaaaaatgactcagttattctggtcaaacaataactacagggtgatggtgaaaatgacggggaagaaactgatggatttaaattcacaagattgtatgattttcattaactagagcagaatcatctgccaaagtcttaatttttagaaagacattagtctccagaagcaggtgcactcaggcatagcaggcatcttttttgctttgagaatttttacacaactctgtcaaccatgataagcatcactgtaacgcctactcattatcttgaggcttagactctaaggtgccaggtaggaaaggccaaaccaggggatttgtagaagccatcactgctgagaatcatctgtataaatctttttatacaagatgacatcatctgccctataatcttcacatataaagacctcttcaggaaacaatacttgaaacagttattccagagtcacagagtgacagctacagaatcttataatttagaaggttccccacgtttaacaataagttgcatttatttgtatcaagtgtgggaggcacaaagctgtagtgcaagtgtcaaggaaaacacggattacatgtaacagggtatcctttccaggctagagctgagactcagatttgtccagtgtgacatctgcaaaatctctttgcaatgtgtatgtttgctttcattggtttacacagagtctgagagtagagaagctggacggtgcctgcaactgtggttcaaaactagacatatttgatgaaagactgtgtcagtagcagtgaaattgatgggcaacataatttttgaaaggcacctaggtttcctgtgagaagtcttatcataaagaaaaaaaagagctgaggatggcaattcagactcagcagttagaactagacatcagaggaaagaagttctcattactctgtgtgtgggtgggtgtggccaacctggttgtataagtaacttttaaggagagagaaaaggactgtatgtgaacttgagctgtttctctgggatcagggcaaaactgctgagttcccctctcaccaattgagtacaagccagccataggttacaaattagaattaacactaagtgaaggtgaataatgtctttgctttttccatttagccaatgggacttgagaagggaacattcccacattgcttctgaggaaaagacacatgataatgtgatacactgacaaatacaaagaacttcgaattagaaggcctagttttaaatcttgactctattgcttagtagctctgttagtctgggcaagtcatttaacctgtgagtcttaatgctccatttgaaaactgtggattatactcataatcacattataatcgcaagatcatttagtatgttttacctttcttttcaaatctagcacacatagaaaataatagtttaataatacattattaaaaggtaaatccttgctcatggtgatcagaggtagggtttcttggaactggggagtttcttaggttgcagtagttttagtgctagaaccaggaaagccttgagcaaaccaagataagctggccactttatgagttttgagacactctagctaccccaacgggctactcaaagggttcttctgagaagatcagcatagctgtaaaacatgtatagttcactagaagctctcatttagagaattaaatgtcaaaacagcatggtactggtatcaaaacagagatatagaccaatggaacagaacagagccctcagaaataataccacacatctacaaacatctgatctttgacaaacctgacaaaaacaagaaatggggaaaggattccctatttaataaatggtgctgggaaaactggctagccatatgtagaaagagaattaaatatatttctatctactcctaatggtcttctgcctaagaaaatgtacagattcaagcttggaaaaatagtaattgcctactccagccctctacttggcatatatctttagccataattgtttacctcttgaaaacaagaaaatcatatctcaaggaactcatctccagaacgacaaagagacaaggaagagagaagcctcaggatagaatggtgagttctttctagaactgaattgagttgtgagaaggagcaacttttagaacagaaatttgttttgttgcctatttgagcaaataagtagacctcatcagagattcttccctttctaaaaactttgatgtttgaatgaatacctggcagatgctgccaaacttctttcctttccatgcatggtgcagtgtcatttactcttttttttaattttttttttgaaatggagtctcactcttgtcgcccaggctggagtacagtggcccaatctctgctcattgcaagctccacctcccgggttctcaccattctccacctcagtagcctggggctacaggcgcccgccaccatgcccagctaattttttgtatttttagtagagacgggatttcactatgttagctaggatggtcttgatctcctgacctcgtgatccacacgcctcagcctcccaaagtactgggattacaggtgtgagccactgcgcttggcctactctttttaatattagctttttttctttttattttttttaaactttttagaaataggatcttgctgtcactcaggctggagtacagtggcacaatcatggttcactgcagcttcaacttctcatacttaagtgatcctcctacctcagcctcccaaatagccgagaccacaggcgcatgctaccacacccagctaatttaaaaaaaaaattatgtaaagatgaggtctcactatgctgcccaggctgttctcaaactcatgacctcaagtaatcctcccgcctggccccgaagtgctgggaatacaggcatgagccatcacacccagccaatattagctttgttatctcctcagctgagaccagccttttttcttcctattattgcaaactgggacatgggcaggattttattttgctatctttggcaggggggcccacttttcattggagttagagctagatacagatcttggcactgcttagaaacttgacactttctgtaccacaccattaaacatctccctgctggcaatgtgtcttacttattatactttagctatttcatgctcactattgagcaggctacaatagaactgtcgagtaaacatgctgattcaataatttcgaagtttcactagcattcaaattcttcgtagaccgcagaccaggcagaatgaacacagtaaatatcttacacagactaaataccaaaggatgtgagtggagaggaaaactaaaggaagaagactataccatttcattcaaaaccaagtcaacactttattaagtgtgcaccaagtacaaaagcactgtttgtcctttgagtcttttttgattagaggatgcagatgcctaaggcactgtttccttgtgcatgttgtatttagctatgaagatagttaaaaggatcagacagacaagggaccacaggaactgcaaagaaaaaacaggtgtccctgtggctaaaatgtgtcttaataatctagagtttaagggcctacttctggcatgaagaaacacttggacattggaactagtgggtcaagtttggtagatgtataaggctcatggggataatactggcacaaaaggattttgaagataggtgagtgccagattggaagggccttaaacatcagctaagaaacatgagggttgtgcctatattttctaacctgcttttgtaacttcaaatacctgcaggatattctggtttaccattatgcagtagtgcactagagagaggattagaattgtgagaaggcaggggaagagtaatacataccttcctcttcccttagttactattaaattatctgcctatcctgtccttccttgggcaaaacatcaattgtatgcaattagaagtcagcaaaggcattcaagccatgagtttaaaaattaaacctttgttgtgtgaagattgaggtagaaggaatatatgatacatcacggaaaactagacaattggaagacttttggaatactattgacaaaaaaggacatagaagctactctgtcagaataaataatgatgctagctttaagcatgttttgcttgggaaaaatatgaaacggatagttaaatggaagtgttaggtagactgttagtgaggatctaggtcatgggagaaagtttaggattgatacagtgatttgagattcagatctacagaagtgatagctagatgaaaatgacaaagagagcatagaagcctagactgaatgattaagaaagaaggatgttattacaccctcctaacaatgcatactagattcatttatatcaagcaacagaaagctatgacacatgcttgtttcatagaaactatgataagttgttgatcactccaggatatcctttacttacttatgttctgaaaaaactaaattacaaagatccagagtcacttaaactcttttttgatttagaaatagaattcatgatcttcaaatctggtataagactctgatgtctggaataaagttcttgctaaatagctgttcaaaagtatagctgtggaaaagcttcctaatttctctaaaatgatttttatatgcataagtaaataattacaattttcaactcattcagttgctatcagtattaaatgaattgacatgtgaacatttaacacaatttatgacacatagaaagcaaatattttttacatgttggtcattagtaattgtttctggtttgtaaatatgttctaatatctatatctctaatatatttctgataattagtttaaatttttatgataaagctattttaatgagaatgtaagtaatatactctttcaaatgtgaaaaatctttaatttgcacatttcttttgaaggttgatatcttagcctaaaaggggttgggaaagctgttgtgagtaacaggacaacctcataattaaacaaaagagctcagttgatctacaatgagtggattgttgtaaaagaaatattaccttttttatttttaatttttttaactatttagaaataggatcttgctctgtcatgcaggctggagtacagtggcacagtcatggctcactgcagcttcaatttctcatgctcaagttatcctccgacctcagcctcccaaatagccgagaccacaggtgcatgctatttgttctatatgtagtctcaaagtttataagttgaataataaacagggacataaggccaatttggacacagagagtggagatcttgtgcttttatgttagtcataaagccatttctttctgccaggtacatggacatcgtttgacagtggtacaagtccgctatttgacagtggtaggccaatgattttgtctagtgaaatagtagctggccaatttaaatatttattaatttaattatattttaatatactgagagcattaataacaactgccagaatttctcttatattgggaataaatatcaatatttatttctataagttcagagttgttcttgttttggtgtttttaggttttgttttatattagatacagtaagccttttgtcagttatcattaaaattttgactttttcagctgggcatggtggctcacacctgtaatcccagcactttgggaggccagggtgggcatattacctgaggtcaggagttccagaacagcctgaccaacacagagaaaccctgtctctcataagaatacaaaaaaaattagccaggcatgcacatctgtagtcccagctactcgggaggctgaggcaggagaatggtttgaacctgggaggcagaagttgcagtgagccgagattgcgccactgcaccccagtctgggctacagagagggactccatttaaaaaaaaatggctttttccaagcaattacacagtctgtgtcacagagggatttgtgattttgctgaagcacaaatttatgttggtcatccagcattcttattttttggctgctttgctctctagtcattaggaaattacatataatagagtcatattgttgttactcataaattcatgtgcatgtgtgtacgtggctgatgtctattgtttaggatttgttttgctttttcttacagcagatgatctataactgcaaaagggttaaggtgaactcaggcaagtgactagatataatccccagtaatttgactaaaaggcagggactggtccatttccttgtctggttcactctactgctggttacctgtgattgcagaatttagagacctgattcctttggcttgtgacactatgcaatcatggatagacagaccagaaggcattcaaagagaatacctgggcagctcttgcaatcagacagagaacatatgaaatattgtggcctcatactaaaagatttcctggtaaggaaatttcaaaatctctctccccatcaaatacagtctgatattttgtcactttcactatctgaataagattctttccatcaaaaccagagtcctgcttttacattaatttagcctattatgtcctctatccattgagaccagctccaggaaatagacagttccttggctattagtgagaaagatttcctggaactttctccatctccttccattgcatacaatacaaactactttatactttagttaatatgacttttagtttccatttaattcattaattctctaagatcttacagaaatgtatttttttaaaatctcatgttggtttaaaatagttccctgaataatcccttgttaaaactcaacaagattaagcatgagggtgaaatcaagagataaacagatattgaataatgcaacatcactgagtttaattttgtttttttaaactatgttccctgaataggtgagacaaggtaactgtagataaagttgtgccgcgttttaggattttcttttcttctgtctcactccttgtggtagacagcataatggccctgcaaagatgtccgcatcctaattcctggaacctgtgaatatgttaccttacgtggcaaaaggcactttgcagatatgattgaattcaggatcttgagatagattaccctggattatctgagtggacccaatataattacaaaggtcctaatgacagaggtgtcagtttcagagaagatgtgatgatgaatgggaagcagagactggagtgatacacaaaggggctactagccaaagactgcaggtagcctcaacctctggagcaggaaaagacaaggaaaaaaaatctcctacaaagctgccagatggcgcagagccttgcagagaccttaattataggatttctggccagaattgtaagatggtaaacttcttttgttataagccattaaatttgtgataatttgttacagcagcaatggtaaactaatatattctccatcaattttttaaatgtgtctaaatcatttttaaactttaccaccagagtgctttgcatcttttggaacacccactgtacttctttttcattaccttcttctacctaggatgtttgttttataactagagcctgttgtgcaaattcactgccattacttcctgagaattgggattgcttttatcatcaatctaacagaagtcatttacccagtatctgctaggtgctttatgctgtgctaggtattattttaatgtatcctcttctctaagagatcaccatcttttttgtaatcatgagttgaagaataattttggagagtgaagttacttggaatcagaagaaataattatagtgttttcaattaactgatgtagaaaaaaatttctagctgaagaattatagttctcagaatgtaaatcataagcctgcctgattgtgaatttatgggatgaataagactagagaggtaatatgcagtatgaataatatggctgtaatagcatttggtatggtgggagtttgctaagagagtggattgtagatgctcttacagaaaaaaagggtaactctgcaaaatgatgcttgtgttattttgcttgactatagtaaccatttcattatgtgtaagtatattaaaacagcttgttgtatacgttaaatatgttcagttaaagaaaggaaaaaggagagctagctagctaaaggtaattacatgtaaatagttggaatttatgtgtcgtttaatttaaattatgtataatatatacacatgtaatttaaataacctaacttgaatacactttaaaatatgtttatgctccatctttttaaaaaattgtagtagctatgtagacataaaatttggcttaaatgtaataaattgtatataacgttttcctaattatactgtatatcatttggtataccaatgtaaaccaagttaaaaacactgtcttcatcttagacagtgtggcttggccaaatatttgtgtggatgctataaataagtaaaaaaatctaaataaataagtaaataaaacatcagtaggacagtgctaaaattaaaacaacagaacatgagccttacatctaggtgagaacaggtattgcaagtggttacagcatctgctctgtcagttcagccgggtttctagagccatcagcctctggcagggttgctttcactaaacaattatggaatgtaaatttgcagctcagtgtcaaatgttctggattgatgtaaacgatttgggtttaatttttctcagaaccatctggttggcactgaaggactagcaaaaaggacagttctatggcttctaaacattaaaaaatcacagacagctctagtattggaataatttcatcatgatattttataatttgaaattttagctaatgaagtaacagttggtttatctataggttttgatatgtctcattatattgtaaaataacttttattaaaatatgcaaaatataaaaacaaaatcacttgtaaaatcctatatccagaggtaagtagagtggacagtttgtgtatgtgtgttattttaaaatcaatactcattttaaaatttcaaagactcttgagagtgaagtaagtttaaaaagtcaccttccctttgcttctagtgtcccctttcccacttccaacagtgaaccactgtttacaattttttgaatgctctcccagaaatactttaaagaaatatctgtgtgtttgtgtgtgtatatatgtgattttcataaatatgaaatcatgttgagtacaatatttatagctctatcttcacctaaagatgttaataataaatcattactatatgtatatatttcaataaattctgtaacaatatggaaaaaatgaactgttataagcgctatgtgtcaggtactagtattttttatcccattatttcattgaattctcacaactatattaagtggttcccattgctgcaatttacagatgaggaaattgagggataaagatgaagtctaaggccacacagtgagtaaatgacagagctaggttctgattccagccctgtgttacttcagaacttaggtattgtagttcttacatcaacaaataagttatcatctttatatactatagtaaaacattcaaatagaataatataacataatttatttaatcagcattttgacatcaggttttaggttacttcatttttattattgtatgtaatgtgttttcaaaattattgctctgaattatttaaaatataattactgatttagtaaattgtcctcaacatacattttatttttaaaaattttggttcattttataattctctctgcttccctctctctttttctgttttcctttttttctccctccctccctctctttttctccctttcttgccaatctgaaaggtcaaaatgcatctcatttttaaaatttgtattatttttaacaggtgaattcaaaatgttttcttatttcttgccatttgcatttgttattttgtgattgttcgtctattgttctcattacatttatcttctgtgataaattatctttattaaggtttgtaggagttatttatgtattaagggtatttttggcttatgtatcaaagtcatctttccagtttatcacattttgaatgttattatagcattattgatcttgaacagatttttattttactaaatctatccatattctcttgatttctgcctttagataatgcttacaaaactattcccaacagaaaaattatgagaatatttgcttccagtcttcttagagcaaacattcgtatatttagcctgtattaatttatttgaatgtatgataggagacatgaaaaaatattacttattcaattatttattacccaatcatatcttaaaaatattatttctccaaatttttaacatttttattattatgtacaaaattatatatatttgtaaccaaattgtgtttagttatttctgaactattcattttctgtaaattttcagtccaattttacagctttttaaaacaagtataggcaattaggcaagaaaaatggcacaaagattggaaaggaagaaacagagctgtctttatttgcagacagaatgatgatttgtatggaaaaccttaagaattctgcaaaacaattacttgaactaatagtgatgttagtaaaataggtttcaaggttaatatatcaaaatcaatttttttatcagcaaacaattataaaatgaaattttaagaatttcatataattgtatcacaacacataacatatgtaggaataaattttaaatgtggtacaagttctgcagcctaaaaaacagaaacatttatgagggaagttaaagatgacttaaataaacaaatttgctatgttagtggattagaagttgcaatattgataaaatctcagttttctcccatctaatcgttggattcagtgcaatcctactcaatctcagcattatttttcacaagaattgacaatctggttctaaaatttacatggaaatataaagaacttgaatattcaaagtaatctttagaaagatgaacaaagtttgaggatatatactacctgactccaagatatattataaagctacaataatcaaacagtggtaaactggtatgagagtgaaagatatgaaagcaatagaaatacacccacataaatgtgggcatttgatttttgacataaatgataaagcaacccaataggaaaagagacggggccgggtgcgatggctcatgcctgtaatcccagcacgttgggaggccgaggcaggcggatcacgaggtcaggagatcgagaccatcctggctgacatggtgaaaccccgtctctactgaaaatacaaaaaattagccgggcgtgatggtgggcgcctgtagtcccagctactcgggaggctgaggcaggagaatggcgtgaacccgggaggcggagcttgcagtgagccgagatcgcgccactgcactccagcctgggtgacagagcgacactcgtctcaaaaaaaaaaaaaaaaaaagaaaagaaaaataagagaagatactcttgaacagatggtgctagaatgagtgaaatgagtgaaagaatgagtatccaaataggaaaaaaaaaaaaaaaaaaaaaagaaacaaaaccaaatctcaacctctcacaccatccacatacaaaaaaattcaaaatctatcatatttttaagcgtaaaagttaaaactaacaaaccttaagaggaaaacaaaggactggtatgcagggtatataaaaaaaatcctacaactccattaaaaaagttaaacaatccaataaattatggaccaaaggtttcaacagtcacatcaaaagaacatataggagtggccaataagcatatggaaaaatgcacatcactagtttttagaaatatgaaaatcaaaggcaccaggagacactactatgcacctaccaaaatgttaaaaactaaaacaacatctaattttggcaaagatgtggaacaaccaaaactctcctatggagaaagggagaactatcctttggaaagtgggatggttatacgaatagatacgtgatagagcaagtatagtaaaataattatagtagaatctaggtggtgagtatagggtatgcctttaagcatttgttcaattttgctgaatgtttgagatttttaacaataaaacattagaaaattatagctttaaaatatacttgactataaagtcagttcccatgttgtctttaaaaagttgctggctactttcgctggtttacattgctattctaaaaaaatatcactttgagatttgtttggacttcggtttactcagattagtgtgacaatttcatcgagtttcaacagttgaaatatagttatgcaatgtgtaattttatgtttacattcattgttaaatttgttgctagatattaaatatttctggttccttgtaagattgggatctcgctcatttttattgtaattggttctttctaatacagatgctcttttaagagttttcagcgttcaacttttatatgctactaagcaaaagtgaatcattctgtttattaatatttaatagaaagggtttttggccacggtcattttattcttggacagctcagatatgtcttgcttcctgttcttgattatttttgaggtagtttatgaatagtataacacaacgcgtctgttaaattcaacagcggtgtgagggtcaaaaaattaagaattttaaatagagttctaggattatattggaaataaaagtagaaaaaatcagcgaaaactaaaaataaaatacaattattacacatgcatatgatacatttttaacaaactgaacattaaagagggcataaatgaatcttgcaactcataacaagtgctgtgtctatgcaattagcaataatcaccaagaatcaataaaagtgattaataaaatggaaaaatgctaagggtgtgtctgaaaacatatttcaatttgatcacctatcaacctaatgttaactcagttggacaagtgtaatagatccctgctgataaagtttttgtcacatgttggataggctaaatggcaaggaaacattttacagggaactcagttattgaagaagtagaaccaggcagagaccatcaaaggaagcaggcatttgcttaaaagtttttcaaattagacgaaaattttcccttttaaaaagcccaaaagaatgttggaattactatagctgtttaaacagctttaatggaccatttcccaagcctatttgatagaaatgcatctgatggctatacgtttacatttctcttagtcattttgaatttttgcatttatgaaattatgaacacctttccagaatccaacctcttcctaaatatcggattttctccatgtagagagactattttcttttctttttagtattttgcccattactaaccatctactaagctctcttgtcaattcctacagtaattaattgcctactcgagtttccaggaggcgttctttgtaaataatggcaccttatgacacttcttagaattgaaattcaatgtatttaacatgacccagaaggcctgggctgcctctccagcctcatttcatgcctctctttccttcctttgctgcactgcccaccattctgacctgttttctttccttgaatatgaggattgccctttccagccctagggctttaagctttctgttcttgctgtttggagagccctttgggacacatcacctctcctcaacaactcctgtccgtactttacatctctgctaaggggaccttcttccaagaaactttccctggctctatagtttatattagttcccccaccacccacctgttctgtctcagagcagctggttctttttcttcagggaacatttcgcagtttatgaatctatcttttatgtgataatgcatttgatatctatctcctctcccacaaggttgtaagcttcatatcagcaaggacaatatcctttttcttttttttttttttttaaacatcgctatattcttaaacctatcatgtacagggtatataagagaaagagaaatttcataaatattatttaaacattgaatgctatcaaaatgggttcctgtttcttgcagataagaccttactctcacatatttgtttagaagaaaaaaagaaaagcttgtctctattgtgatacttacgtctgatagtgactttatagatttccatttgagaagcatttgtatatgagaaatatacaacgtgttaataaaatagagattctaatgatgaaattctcaaaaataaaactacagggcagtaaggggaaaaagatgaaaaaaacagaatcatttagcgtatagcacacaggtgattatcaactcctagctccacatttgggaagacaagatctaatacataaaaatatgaagggagtataaatatataaaaagagatgatctatatattctggggaatttcaaacaacgtcattatcattacgtgtggtactgagagactgtcaagttttccctttttaaaattaaaaacattagtaagtgtttttttatttccttttttttccttaaaatatcttatttttctgaggaagagacagccatttcatttgaacaggttaaaggattttatctgttatactatacatcctgtactttaagctatttgaatgttagattagagatggcgctcagaaggtacgatactctgctagagagaacgtggcaatgaaggtgccacaggtgattcctttttgtaagtatgttttggctgtaaagacccagaaatcctcattctttcgcagatacctaaaaagtaaactggcctagctatattttttaaaagtctgaagaatgtctgcctaaaggtataagccattgtttctgtgagagtctgcgcaagactcagatggcatccctaaaatggaattgagggggtttgtttacaaaaggactattcacaaagtccacgtgtacaaaaatcacaaggatgggcatatacattatatgcagtaaaacaagccctttttagtgtgccaattaatgagttttgtcaaatgtacacatgcttatataaccagctgcccaatagaaattcagaacatttccattattgctaaacattcccttatgtctctctataatcaatcccaaaccctaggttgcgagcactcactgatcaacttgcaattactatagattagttttgtctgttcttggcaaccaatgcaaaaatggacaaacaggatcagatcaacttaaaaagcttctgcataccaaaggaaacaatcagcaaagtgaagagacaatccacagaatgggagaaaatatttgcaaactacccatctgacaagggattaatagccagaatatacaagggactcaaacaacactataggaaacaatctaataatccgattaaaaaaatgggaaaaatatctgaatagacatctcttaaaagaagacaaacaaatggcaaacaggtatatgaaaaagtgctcaatgtcattgatcaccagggaaatgcaaatcaaaactacaatgtaatatcatcgcaccccagttaaaaggacttttaaccaaaagacagacaataacaaatgctggtgagaatgtggaaaaaagggaatcctcgtatactgttggtgggattgtaaattagtacaaccactttggagaacagtatggaggttcctcaaaaatctagaaatagagccaccgtatgatccagcaatcccactgctaggtatatacccaaaagaaagaaaattggtatttcaaagagatatctgtattcccatgtttattgcggtattattcaccatagctaagatttggaagcaacctaagtgtcccatcaacatttgaatggataaagaaaatgtggtatgtatacatagtggagtattattgagccatgaaaaagaatgagatcctgtcatttgcagttaccatggatgccagtggaggtcgttatggtaaatgaaataaaccaggcacagaaagactaagtttacatgttctcacttatttgtgggagctaaaaattaaaacaattgtactcatggagataagagtagaatgatggttaccagaggctgggaagggtagtggtgggggagtgggaatggttaatgaatacaaaaatagagttagatagaaggaataagatgtagtatttgacagcacaatgaggtgactgcagtcaataatgtattatacattttaaaataattaaaagagtataattggattgtttgtaacacaaagaaagcatacattcttcaggtgaaggataccccattgactcttatgtgattattatgtattgcatgcctgtgttaaaatataccatgtaccccataaatatacacacctactaggtacacacaattttttaaattgcctgttcttgaattttatatgaatgaggtaatacagtaaggattctttggctctagctcctttagctcagcataacgtggttgaatgtattagtaatttgtgcctttttcttgatgagtagtataccgttgtataaattataccacaggttatcagtcctctgctgaaatatacctggaatgtttccatattatttttcataaagcttctataaatatttttatatgatgcttaatttatgatgaagtcaaatatatatattaatttatgacaaagtcaaatacacacacagatatatatatatatatatatatatatatatatatatatatatatatatatatatatatctttactctataggtcattttgggtcttgtctaagaagtatatccctaccccatggttgtgaaggttttattctatggtgagctttagaatctttataatttcagcttttatattgagacttgtgatccattatagttaatttttgtgtacatcgtaaaggtaggaaataagatttacttttgcttatatgaacatacagctgttccagaatcattggttgaaatactagcatctccctcatgaaattatcttggcacttctgttgagaatgagctgacctaatatggatgagccaatttctgaactctctatcctgttcactaatctttgtgatgatgctgatatcacataatcataacttctataacttgataataagccttgaaaatcagagtgtatttctccaattttgttatctttttacaaggttatattgtagccattccaaataccttgaagtcccatataaatttttacaaggtctactaaaaacaacctgctgggattatgattgacaatgcattaaacctgttgattaattgagggttacattgtcaccttaaaaatactgagtgttctaatcaaagaacatgtaatgtgtctccatttatttaggttttcttcaatttctctctgtgctttttttgcgtgatttacattgtacagttactgcacgtttattaaatttatctcaaagtattttatagttttggatgctgttaaaatttatatctttaaaatttcatttttcagtttttttgtttctcataaggagagattaaatttattttgtaatattgatcttgtattctgcaactttgccagatcactaattttcataacattgttgcagattgcttaggagtttctatgtatatgcccttgttatccacaaatacagtttcattacttcctttccaaagtgtatgggttttactgtttcttttcttgccttaatgaactgactaggctctccagtaaagtgataaatagaagtgatgacaatggacatccttgctttgttcttaattttaagcagaagcattcaggcttttagcattcgtgaactatgttagcagtaggtgtctcagagttgccctttattaagttcagttctctacctaacagttttttttaatcataaatgtgtgttgaatttgtcaaatgccatttatatatccattgagattatcaggtgggtttcccctttgtttatatagggaattaaattgattggttatccaattgttgcatcaatattgtattcttatgataaacttcaataggtcatgatatatttccctttttatctgtttgaatttgctaaatgcaacttgttaatattctgtgaaggatatttttgtttttatgctcatgagggcaattggtcgctagttctcttttctattagtatctttgtttgggtttagtataaaggtcctgctgtcctcattaaataaataaagaggtattctttcttcctctatttttctgaaacattgttttctccttaagtgagattattttcttgttaagtgattgcaaaacaaaaatagttttcttttatacaaattacatcttcttcaggaatacgggttttcttccagtagtgagctggcttatttgcgtgatcaactttcatttatttgtggagagatttttcatagcaaatcttgtttttaatttttaatgataattgtgctgttttaactcctattcataaaatttggcaaatggtttagtttaggtatgatttaatcactgtattctcaactataacttaatgtagcatcaagaaattaaaaacaagttgattaaaaccagcttacccttagaacataccaagttctttgaacagtataattaaatatgattctatcttaatcataaattgttaaacaagcaaagcaaaacgaagcctggaccatataataactccaacagccccatccccacacacttcagaatcagttatttcctctaaagtaacagcattttataataatcatttcaaaagccctcgtttccttttccagctgtgaacaatttgggtcatgtactgattaaagcaggtaagaatggagatactcctcttgatttcaatttaattaagatgccagttatccaaagttcacaatctttgaatttaaactcaatcggaaggaacctcacatgagattaaattttgcttttgtaaatccttttgctgagctcaagcctattgaccccacatgtttctccttgcactcgcctaagcatgctatcccagtggtagtgagaagcagaataacctgcgcctttatctttctcaactccttaattccccagcctttggctacattcatgactccaacaggggcatatttcctttccaccacttttgttctccctgcagcagaaactaacttaccatggaaaagaaagccctaaatcttatctctccatcagcttttctttatgtaggattccaagcaaacaaaatattattttcttaatacccagaccgatgtttgatactttaaaccctggccaaggaaagactaaagaggaaataaagtttcaaaacaagcacaagaggagcagaagccatggtgtccaatctgtctccagtagcaccacgttatttgcccaccataactataaaacagtaaaccaaggtgagtcttccctggtaccaaatgaatcctctttccagtaggaaaagagacactttgttcccaaaaacactgttgttgtggccctagaattttttttttttttttttttttgagacggagtctcgcactgtagcccaggctggagcgtagtggcgcgatctcggctcactgcaagctccgcctcccgggttcacgccattctcctgcctcagcctcccgagtagctgggactacaggcacccaccaccacgcccagctaatttttgtatttttaatagagacggggtttcacagctccacagagaaatacacagaaactggtagtaagtttagaaacttttatagggatttggcattgctctgccattcagactcatgaggagtggacttattgaaagtgttatgggtcatgtggtggcacactgcatatttataagcagtggttataaaactggttatgaggttttaaaaccacatactggtctatactaaatagaaatttttttgaaaaattgcttttcagcatagtgtgagaagcactagtataaaacatatatttagtgtctaaaataatgcatctgtcatatataggatatctccttcctcatctctcacacttagtgtagatgtctactctttttttgttgcttgtggttttttaacatgcttctgcatttcaactttatgaaatttgttttaaaacatcctgaaaagaatctggaagcacagtgggttcaacattctttttaaccacaatcttcaagatcgtagttttttttttctctgctaaattttattaaggctgcttccagtggtgtataagaaagtgtctcccactttttagtagcatctctaaatcatattgtggaccagtggcttctagaagataggagccaattacagtgaaagtactgagattattatgttctattaaagaaacaatataacttttaacttaggttgtctgttctgttctgtctttattcctcaatctttctactttttgagatctggcttaccttggccctgtaatctacagttaccttttataatgtctccattagcccctgtctaacccttatgataatatttctacatatattacacaaaaaatgaagtagaaacaatgttgaatgactgaaatcctttatcaaaaagttcttaagtagcaaattatgattataataattcatatccaccttaaaaccagggagcatgaaacataattgagccaatagactcaatactttttatgaaagtctgacattgaagaataaatttaataatatcaaatagtaacttaaaagcacaaatttgacatgggtttaatatttgaagactaagatattaaaatctaatgttaaagttttggttcactatgtagttataatttctgccttgctctatggaacaaaaagatgaattgtttatagaagatgtcttataatgctataaaagaaacataaatgctactgataaagactcatcacattaaggtgaaaatagattaatattctttatcatgggaacaccagtagcattgagattgatgttatcaaactatcttcaaactggcagaccgcatatgtgattgggttccctgacctcccaaatgaatacttttctcttattatatagtctagaaatctgaaaacctaaagtgtttcaaaggcattctgaaaaaaagattttaaaaaataaagcagcagtatcaaacagcagggacatataattttaggactataccatgcgcatgtgtagcaggtaacacacttaaagagaattgatcctatgcaggtacaattttatcaaatactaccataactaaacaatagtgatggtaatagttaccagaggtactgtatgtatagactgagataatgactgcattgattcgttgggttctctgaagaggttctttacaagttaagactattttttaaacacacatacacacaaattagctaaggcaatttgcatactctggaaaagtactacatgtagctcactctatgaatacacatatgcatgtaatcttcaagtaaaatacaggtaggcattatatctccagcacaagtcagtagtctctcttcactaagaggttaaagagaggccataaaccagtggaaaggaataccagaataaaacaagcaaagctttatttttctctttgcttctttgattcagtgtgtattgtcttctgtgagtctgtttcctgataatttaaaatgaatttttatgtaggcatgatatgtataatttcaggtattgtgaattgttaaacttccaatcagtgtactcagtctcctgttgttatataatatatagctactactacctatctatagttgttactctgtatccatcatcttcctgagttagtaaaatagaacagccatgttatttccgtcccaataacatgattttctataacagataaaatcctgtgatatgttgtatgtaggcagtattattaaacattttttctcatttttttctctctctttctattgccttttcctttagtagtttgctgcctatgatcacacaggaatttattactcagaatttttaaaatgtgcatttttattgattttttataaaaataaaaacactataccctactttcctctatctttccctttaacttctatcatatttttcttttaagcaggagaattattctctatttttcagctacagtaaatcaagtgtttgatcatcaagcatggttttcaatctatacaatcctgtatttagggtctcattggctgtaagttgatgatgtaaaaccatttgaaacagatctgtttgtttgaagtggggtgtagggaacccctgtaaaaagagggattcctccctccccatatcttctctccacatgatctttctctgcccaatgcagaatagccttaatgagtttccacggtaattcttggttttcttatgaatagcttaaaaatcgatggatatttaagatgtaatccatcaatttttaagctattcatgaagtatctcaaattaaaaaacaaagaaaatatcagcagatacacagaagagtaactcctagcatcttaagtgaactgtgtttaataagtagttcctagaaacagctgtggaaacgaaaaggattaaataaacaaattccaagagggataagcctttccaaggtgcaaaacggatgcctgttgttttcgtccctggaaataattaccatttctcagtatgaattaagggtcaggctttgctcacacaaaggataaagtaaaataacaaaatttctgtgcagaacttgcacaatatttaagaaactcaaggagcccagaattctgtttgccccctcacctatttgccaaatctgggggtcatgctgaaggcctgggagctttacagagaagtctgacctgttcccataccttcacagaattaaggaaataaaatcccgcttgaggaacaggcctgcctcaaacacatagtttatcatcttctcatgatatctaccaaatttggaaatagcatggaatggaagggcaaacagaaaaacccaagacctacaaaggctgactgaattttcatagttatttagagatcaggaagtataaatctaccagtttccgaagaggaagcttggaacatgcctgaataacatgaatgaagcaccaacccagccaattattcactataatccatgattgagtagaagtgattaacacccctcacatgtaccctacccatcttacagaattcaacaggaaccctagaaaaaaggtaagctcaaccagatcctttatgtttccttaatatatgatatgcacatacaataaaaaattattgaaaatgtgaataagcaagaaaatgtggctgataatcaaaagaaacaaaataagcagactaacaatccaataatggatttagtctgtatctacagactgtaaaattgctattattaatatatcaaagggcagaagtatacatgcactaaatgtaggaatacatggagagtttcactaaagagttgaaatacgtgaaacaggttgatattctagagctgcaaaatacaatatatactattaagtccttattggatgggtttcacaagagaagggacatagagaagatactataaatataattagagatagttcaatacatctaaaggaagctctgaaagaaagaatactaattaaagaaaaagaaaatatcagtatatgagctacagcgagaaattcaaatatatgtgcaattggagtgccaaaatggagagcaaagacaacaggaaatcaatatttaaaaaccaaatcaatatttaaaaatcaaaataaccaaaaatgttccaaaagtaataaatggcatcaagttacgaattcaaaagtctaacagcacccaagcaggataaataagaaatgatcacaacaaagatcactgcagtcaaattattaaatatcaaagaaaaggaaaaaatatttaaaagcaatggtatgttcttttcaaaagagaagcaataaaacataaggttaattttccaatagtaactgtgaaagacaagagaaaataaaatgatatctttaagtgctaaaataaaaactagaattttattgactttattttactttcagggggtatacgtgcaggttcgttacctgggtatattatgtgatgctgaggtttggggtatgaatgattccatcacccaagtactgaacatagcacctgatagtttttaaacctttgcctcttctcttctccgctctgatagtccccggtttctattgttacatctttatgtccatgagtacccaatgttcagttcccatttttaagtgattacatgacatattttgttctctattcctggactattttgcttaggataatggcctccagctgcatccatgctgctacaaaggacatgatttcattctttttcatggctacacagtattccatggcaatatgtactaaattttgtttatccaatccaccgtggatgggcacctaggctgattccatgttgttgatattgtgaatagtgtgatgaacatgagagtgcatttgtatttttggtagaaagatttgttttcttttggttatatacccagtaatggcattgctgggtcaaatggcagttctgcttttagctatttcagaaattgccaaactgctttccacagtgaccaaactaatttacattcccactaagtgtataagtgatcccttttctctgcatcctcaccagcatctgttgtttttgactttttaatagccattctgattggtgtgaaatggtatctcattgtagttttgacttgcctttctttgacgattagtgatgatgaattttttttcatatatttgttggacactggtatgtcttttgagaatggtctgctcgtatctttggtccattttgatggcattattcatttttttgcttgttgatttgtttaagcatcttatagactcctgatattagacatttgttggatgtgtagtttgaaaatatgttttcctattttctaggttgtctgcttactctgttgatagtttctttggctgtgcagactctctttagtttaattgggtcctacttgccaacttttgtttatgttgtaaaattgcttttgaggacttagtcataaattctttcccaaggctgatatctagaatggtgttttctatgttttcttctaggatttaagaatcctagtttgaagtcttgcatttaaatctttaatccatcttcagttaggttttgtatatggtaaaaggtagggatacacttttattcttctgcatatggctacctagttatgcaagtatcattattgaatagggagtccttcatccattgcttatttttgtagactttgttgaagatcagatggctgaagatgtgctgctttatttctgggttctctcttctgttccattggtctatatgtctgtttttgtacaagtaccaagctgctttggtagttgtggctttatagtatagtttgaaggcaggtagtataatggctgtggctctgttttttgtttgtttgttttgttttgttttgttttttgtttgtttttgttttttcttcttaggcttgctttggctattgggacccttttttggttccatgtgaattttagagtagttttttctaggtctatgaaaaatgacattgatagttcaataggaatagcattgaatctgtagattgctttgggcagtatgaccactttaatcatattgattcttccaatgtatagagcatggtatgttttcccatttgtttgtttcacctataatttcttttagtagcattttgtagttctccacttacagatggtttacctttttggtttaaaaaaatttttttatggctattttaaatggtattgcactcttgatttggctctcagcttgaatgttttagtgttgtatagaaatgctactattttttgtattttgactttgtatcctgaaactgtactaaagtcacttgttagttccaaaagccttttggcagaatatttagaggtttctagatatatgatcatattttccatgaagagagatagtttgagttcttctttgcctattttattgccttttattttttctcttgcctgattactctgaccaggacttctagtactatgttgaataggagtggttagagtgagcatccttgtcttgttttagttgtcaatgggaatgcttccagtttttgcccattcagtatgatgttgcctccgtgtttatcatagataactcttattattttgtggcatgttccttcgatgcctagtttcttaagttttttatactgaagggatgttggattttattgagagcttttttctgcatctattgagacgatcatatgattttcatttttaattctgtttatgtgatgaatcacatttatcgatatgtgtatgttgaaccaaccttgcatcccaggaatgaaacctacttcatcatggtgaattaactttttgatatgctgttaaattcagtttgttagtattttgttgagggatattggtctctagtttcctgttttggttgtgtctttgccaggttttggtatcagggtgatgctggcttcatagaatgagtcagaaaggaatccgtcctcctcagttttttggaatagtttcagttgaattggtaccagctcttctttgtacaactggtagaattcagctgcaaatctatctcaacctgggtgttttcttttttttaacaacccacgatttatcctccaggaaaatatcctctaaaaaaccctgaaataattcatcagcatatctttactacaagacatattaaaacattgttgaaattgaaggaaaataattccaagaagcatggaactttaggaaagatagaaaagtaccagaaagagaaaatatctaggtggttataaaggaatattgattgttaaaaagaaatgatatacagcctataacatatgcagcaataaaataaatgaaaacagtaatggcataaagtattgagttaaatattatgtttcattcattgttcaggaagctaaagtactaatttcatttgactttagtaagcgagtattcatgttttaatatctagaataaccactataataaaatagatgattcaagctagtagaggagaaaaataaaataacaaaataaaaacattttacaaacccgaaagaagttaaaaaaggtgaaatagggggacaaaagcagagatgggaaaatgaatatcaagtagtaatacatattgcttccatttattattgtaatataaagttgataaatacattctttaagtttaaaagtcagttgagtttaagaaaaacattaaataaataaatggtgctgattgtacataggtgacagaaatttggaaaatgctggcacaataactactacagggaagcagaagagaatgttttctgaatttaggcaaactagatgcagttctgactatgctattacttatctaaataaccagcaaatagcaacttgtctttgcaaagcaaaagattatttttcaaaaactttcatatatatatgattttgattcctcaatcactttttattgaaatgattactatttgccatgtgtgactatttacatgtgtaggttattaagggccaatatatatttttgtttgtgttaaaatgtccaaaagaaatttactcacatagggcatttatagaactgaaggaccatggattatcgaaacgattttggagaatatgagtgatggaccatagccattcatgcaataactatttattgattatgtaatatatgttagtctttgtgctaggctcagacattgtgagacagaaaaaaaaaaaaaaaaacatgggaccagtcattgcagacagtattaagtaatagaataaggctaagtctcaaactgagcagtggcacagggagaggaacaatttgttttactagtgtgagatcctgaaatcttcacaaaagaccagacacattagctatgccttaaatatttaatagctcgcttacttggggaaaggacattcaaccagttttgaaaaaaaaaattgcaaatagattcacacttttaaaaagtacaaaaattacttgaaatggatgatttaatttgtttagcattataatttctgaaatgcagactgtacattcccttcacatgaattgttacatctgatttagtatgtttttagattggttttgttttgaggcaactgatgctaataagaaacttaacaagaaagaaagccaaggcattttcctttgttaaagttttaaatgtttctctattagattcattatccatttgctttgtagtttatttttatttatttatttattttattattattatactttaagtttcagggtacgtgtgcacaacgtgcgggttttgttacatatgtatacatgtgccatgttggtgtgctgcacccattaactcgtcatttagcattaggtatatctcctaatgctatccctccccgcttcccccaccccacaacagtccccggtgtgtgatgttccccttcctgtgtccatgtgttctcttcgatcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacattttcttaatccagtccatcatcgttggacatttgggttggttccaagtctttgctattgtgaatagtgccgcaataaacatacatgtgcatgtgtctttatagcagcatgatttataatcctttgggtatatacccagtaatgggatggctgggtcaaatggtatttctagttctagatccctgagcaattgccacaccgacttccacaatggttgaactagtttacagtcccaccaatggtgtaaaagtgttcctatttctccacatcctctccagcacctgttgtttcctgactttttaatgatcaccattctaactggtgtgagatggtatctcactgtggttttgatttgcatttctctgatggccagtgatgatgagcattttttcatgtgttttttggtggcataaatgtcttcttttgagaagtgtccattcatatccttcgctcactttttgacggggttgtttgttttttttcttgtaaatttgtttgagttcattgtagattctggatattagccctttgtcagatgagtaggttgcaaaaatttttctcccattctgtaggttgcctgttcactctgatggtggtttcttttgctgtgcagaagctctttagtttaattagatcccatctgtcaactttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtagaaggtgtaaggaaggaatcgagtttcagctttctccatatggctagccagttttcccagcaccatttattaaatagggaatcctttccccattgcttgtttttgtcaggtttgtcaaagatcagatagttgtagatatgtggcattatttctgagggctctgttctgttccattgatctatatctctgtttttgtaccagtaccatgctgttttggttactgtagccttgtagtagagtttgaagtcaggtagcgtgatgcctccagctttgttcttttggcttaggattgactgggcaatgcgggatctttttggttccatatgaactttaaagtagttttttcgaattctgtgaagaaagtcactggtagcttgatggggatggcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttccaaattgaatgccctttatttcttctcctgcctgatttccctggccagaacttccaacactatgttgaataggagtggtgagagagggcatccctgtcttgtgccagttttcaaagggaatgtagtttaaatttcctttgctgaaagtcaatgaagaaaataaattctggtatatacttgacactttaaaaattatatcttaagccacaaaataactgtatgtaatcaattggtatatcaaaataaaatattttctacttaattatatacttcaggattctaaaaacaaatttatcttttaatttcacatcatacagtataatttttcctccaagtgaagaatgtatgttattattttaatattataacagaaaaaaatccacccacactgtgggaaatatttaattatgaattgtagtaagaatggatcaatacccactccatgtaagaacaagttaatatttctgagcttctagagaaaaccttaatcatgcagtggagaagtaagtgtgtccctttggcttacatattacttaatgctcactgcccttaattaccacattatcatgtccactgacacatacaaagaacataatatatatgtatatatatattttgttttttgagacagagtcttgctctgtcaccgaggctggagtgcagtggcacaaacttggctcactgcaacctctacctcccaggttcaagcgattctcctgcctctgcctcccaagtacctgggattactggcacatgtcaccatgcctggctaatttttgtattttagtagagacagggtttcaccatgttggccaggctggttttgaactcctgacctcaggtgatctgccctccttggcatcaattttacacataaaagttggtatgagctcacacgtatgcatttcctgagagtaattctttaaattagatcaaaattataatgtttaataaaatataatatctcctgaatctctcctcttcatcactactgccttaccctgacttggacttttaccatgctgtcttaattggcatttctacatccattcttgctccacaagaagatgttctccataccatagccagagtgggctatttcaaaatgtaattatgatcaggtgatcctactactcagacttctttaataactttccattgctcataaagatcaaaaccattaataaaaaggcctgacccttctcaataactctttagttttgctctttgaattccagtcacactaggtttcagtttctaaaatatgaataggtttctctacagctggcccattgtctctgatacccctctgctcagagtagcctttctacctccctttgcatagctaactcctcttcactgaatctctcagtcagcctgtcctcagaaaaagcctttcctgacctcggtgacaacatgatttttttctataaaaatttcttctggcatcatatctttatagcactcaagcagctgtatttataccttttaatactttgattaataatgtcttatctgttcactaaataataaggcctaccaggattcacactgtatgttttgtttttttgttttgttttgttttgagacagagttttgctctgttgcccaggctggagtacagtggcacaattttggctcactgcaacctccacctcccgggtgcaagtgattctcctgcctcagtctcccaagtagctgggattgcaggcgcccaccaccccaccaccatgcacggataatttttatattttttgtagagatggagtttcatcatgttggtgaggctggtctggaactcctaacctcaagtgaaccacccactttggcctcccaaagtgctgggattacagccatgagccttcgagcccggccacactgtatgtttttactcaccacctgctcctcagtatctagaagagtgaacttggtacataacgggattgaatacattcttatttcatattcttacattatttaaactaagtagaaaaccataacatttgaagttaattccaacagcgtaaaaaggtacacactgaccttgttttggataaacccaaaatgtattaaataattttctagttgtgattataaagaggtaaactacttgtggaacacatatgctggcaacaggcaaataataattatataaagaattttatttttattttctatatgtataattttaattgaataattacatacaaagattttatgataatgataattgggtacaacaaactacatttattttaaattcattagcgaagtgggacgctgctaaacagttttcaaatattaccttattttgtcccgataagagcaatcgcaaatgattttcaaagccggattgctttacttcagagcctaagttcttaataagtacactattgccttgctgtggcaattttatgtatgctgtatattagcccttatttgttaagcatctgttatgtgtcagacactctaaaagtacatgatctcactgatcctcacagctggataggtacgtatcatgatccctatttattagataccctatttgaggaattgcatttattggaaatttaaaattgatgattacaaataggggcaatcactaatgcttagatataattatgttttccaaatcagagcttatcttaggaagaaatgcaatcttactcttccattgttaccgtttccaaattttctagaaacaatgcgtatgcttacataataccgttttggtaaaaccacattaaaaataaggactgttgttgctttgaatgctggtttttaggtgaatgatattctcctacaaaagtcaactactggtagataattcagagatttatgcaccaaaaataataaaatagcaaggataactcattgcctattatgagtactagacatctgtattcatatgagactagatgaaaagctcattttctttgtcccacaggtcagcgtctggaataaaattaaaatgtgtaaaagtggttcataaaattctgtctcccagataaatattccctgggcaaaagggagaaatgaattggaggatatgggtgttaagtttgcctgcacatattctactcagaatttcttttcttataaagtgggccctctgatggtacgattttttttaaattcaatttattttaatagttcttccaagaaaaacaacagcgtcatgacaccagttgcctgctgaatcttttatagctattaggaaaatgagctccacaagtaataactacttcaatagaagttcttaggaaacttggagcatattagagtgtggagctgtgtctgcagaggcagatgaaagagacagctgaagcaattatgtagatatttcgggaaaatggaaacaagataattaagataatttgattaaaaattgaattttttaatgcaacacaaatggaaacaagataattaagataatttggttaaaaatgaatttttttaatgtaagaagttgcctggtcatgagacagtgttagttgtggcaaagcttatagggccatgttcagatcaagtttccataaaggagagaaatacatgccacaaacagctgcttgattgcggcggcatcttgattctttgatgccacttaatacccattttggtaaagattctattttggaaaaatgtcctactgtaaaaaaatagaagtgatttaggtaattcaggaaaaaacttagaaacatattatgtaacatgttaggtcaacagtcctaattttagcttaatgttttgcatttataaaaggttttagagactaaactgattctacaaaattgtccagtgagggaatgccttactcttagtacaggtttctaaggtaatggataaggtcacaccttctagtgttttggtccctgcagatggcttaaccaaccctacaagttggttaatactcttacctccattagggtgataaggaaactgagctaagctagcaagcacaaccaattaagtggcaaagccaagactaaaaaactcagacatacaagcttttctttttctttttttattttttttgcttaaaaaagtttaacaagacaggtaattcctttggacaataaaaattcaaaaagcaaaaagactacatagcaataagcaaatctccctctttcctgtacttctcgccacccatcccttttccttagggagagctcactttacccatttaattttgtatctttttagtgatgttctatgtacatcaagcatttttatataggtctttatgtatgtaaataaacaaatgatagattatgcgccattcttcacccttttttcagtttttaacataacatataggtctttacctacaaatatagagtcacttcatattttctagaagatatattgtattccattgtataatgtatcacaatatccatgagggacagtaagttgtttcccatcatattttattactaaatatactgcaaaaattattattttttatgtgtcccatttagtaattttgttttaggtgtgtatttatatataatagataaactttgcttttaaacgtaacattttattgtttgaaccatttacacttattgatataacaggcctagttctatcatttttgtttgttctttttataatctgttttgttctctagtccatctataatttattttagtaatttagaaagttgatctttttcatttataatatatttattcatctcatttttgagacattatgtatgcactttccgtaataagcaatgataaaattagtttagtccatattagtttagttcctcaattttttagtttagttccttaactttttaagcatttttaaattatgctttaagttctgggatacatgtgctgaacatgcaggtttgttacataggtatacacgtgccatggtggtttgctgcacccatcaacccgtcatctacatgaggtatttctcctaatgctatcgctcccctagccccccaccccatgataggccctggtgtgtgatgttcccctctgtgtgtccatgtgttctctttgttcaattcccacttatgagtgagaacatgcagtgtttggttttctgttgctgtgttagtttgctgagaatgatagtttccagcttcatccatgtccctgtaaaggacatgaactcatccttttttatggctgcatagtattccagggtgtatatgtgccacattttctttatccagtctatcattgatgggcatttgagttcgttccaagtctttgctattgtgaacagtgctgcaataaacatacgtgtgcatgagtctttatcatagaatgatttataatcctttgggtatatacccagtaaatgggattgctgggtcaaatggtgtttctgcttctagatttttgaggaatcgccatactgtcttccacaatgattgaactgatttacactcccaccaacagtgtaaaagcgttcctatttcaccacatcctctccagcatctgttgtttcctgactttttaatgatcaccattctaactggcatgagatggtgtctcattgtggttttgatttgcatttctctaatgaccagtggtgatgagcttttttttcatatgttttttggctgcataaatgtcttcttttgagaagtgtctgttcatatccttcaccctctttttgttggggttatttttttcttgtaaatttgtttaagctccttgtagattctagatattagccctttgtcagatggatagattgcaaaaattttcttccattctgtaggttgcctatccactctgatgaagctgtggaggagctctttagtttaattagatcccatttgtcaattttggcttttgttgccattgctttttgtgttttattcatggagtctttgcccatgcctatgtcctgaatgatactgtaaaggcaatttctttattcctgaattagtttttgagtgcaagataatgtgtttgtcacaatttatatttcttccagaaaaactttttatatttagggaatattctttcttgtcatttgttttttcatctcttctttgtttttgtagtctttgtgactatcatgtattagtttcctattgttgttgttgttctgtcatttttttaaaggagatgggtttttcttgtgtcatctaataaaggagcattgcaggcaaggatagattctccatgcttcaaagtagtgcatttggacacagggtgatatatccatgaatccttttagcctttatgtctttccagacaactgtgattggcagctgccagactcttcacaatacagcccctttcctccaccctggttctctaacatcttactcatcacattactgtatctggatagttcctttgtttgttggttcttccttgatttattttactgtcataccatgttcaggacatatctttttcatcattccaaataattattggttttataaatcagaatgggatctgtaatttcaattacagagttctgttagtttcacttgagatctgtagctgtagcactactcggcttcccactgggccttcagtcttcaatgtatttgccagtcctttctcatatattgtgttttgaattacagacaatagtttttatctaagacaagtttggttttatctaatacaggtttctctctctttctttctctttctctgtgccacacacacacacacacacacaaacacaaacaataagatgaaaggaaaaagaaagaagtgagatttatttttattcattttttaaatggaaactcaagtaactcaaagctcacacttgaacttactgtacattaccaatgccccactattattttcctaagaatctagcatcttagattcattttcatcacaactgaggcttcaggtattcacaaagttgttttcttctactttataaagtactaagtgagatgatatttactatgttgtaaatgagaaacaaggtgaaagatttgggctttaagacaattttttaaagttctgttaagagtcgttacatatctccttatgaatcataaattcaccctcaattactactggtcacttatgaccatgtgatatgcttggagacttcctgaatccctgctctaaaaagcttgagtgtatacacaacacatgttttctatctttattcagtatgtcttgacatctcctcatttaggaaatagcttctttctttcaaaagtttatcctttttattttttgccctaaaggcaatcaccttttactacttccttattctctttttctccttcccctgtatcttagaagcttccatctctgttgagcctccgatcagcttttcaatgttccctctggtcccacctaccaaaaagtctgcactcacacccccagcccttcagtcaactctgccattctgttttactcttttcaaataaactaattgaatagctaggcaacttaatgttattgtttctattttactgataagagattgaggtgataagatgttaagtgatctagacttgtactataaggccatctcttaagagaaaatcatctccctacaaagatttccctgttacctgcatagcactgattgccaaatgtacaaatatggatttgatttatcacactgctagagagtgccagggtagcttttatggaataattttcaaagtgacatctgaattaacacctaggtaatgagatctggagctacgaaggttctactgaagagaacagaggtaggaatgagcttggccaactagaggaactgaaggaaggccagtgtagtccaaatgcagtgaaccaagggaagagtaggtaaagatgaatttataaagatgcaaaggccatatctctgagggccaagtgggccttcatacaggatgtggacctccttttaaatttagtaggaagcaaggtttgcagagatcactctggctgctccgtgtagaccagtttggagactatacaatgacccaagttagacggggtgatagtttagactagagcagtgatatgtactatagatgatcatattttgaaggtacttcaaggttcttaggcaaatgctgttttatcaatatctcttgttttccctgatgtatgctcttaaattgcacccttagctgaaggagtgatttcttgtgtgtggtaacaataacatcctccgtttgtagaatattttttattcttcaaagttcttggacattatttgtggcaaggacaatactgatccatattttagtcataaaatatttaaatattaaaagacagtgttaaatgaagttttaaggttgacacccaacctatcaaatttaagaatttgataatatagtttgagtctgtggattaaaacaacatgatataaaactctccattgaataaacgttgcttcaaagctactttatgaaatttaagtgcgagatctgggtaaaaggacatgagctgcattgactgctgaagtaggactcaggagtggagtgggtatgaagttgaaatggagggggataccactaggagtataagaaaggacattatctgagccacagatcagccagacagacaggtctacacagacacagctgaaggcctctgagtgggcttctgatattaggtacaaaaatttaaaatatttatttttgaaagcagcattaaacactaaacatgtttttgtgagaaaaaaataagacaaaaatcctcagtgaaactcaaacaggaaaggatcaaagaattcataatttagactctatttccatttagtttgtcatcttttctcaaaaattacatttacctcctggcattccacgaatagaatattgagttgggttagcttttcaggatcggaagttttgtgtggaagtgtctgcagtttttttggttcttccccatgatctctgatactgcacatacaaaaatggaatttcaatccccatgatctctgatactgcacatacaaaaatggaatttcaatcctggttattctccagctgtaccataaacaactctggtagcagaggaaaaaagcctacactctaagaaggagccaggtttatgccctacacccctgtttacatcattggctggcagataaaatgtatgctgagagaacagtcgttaatttaacaattcaaacactgccattccaagacatttttgcactgtagctttgctatggaacaaaggcataatgaataacatttgttttggaaagagctgtggggatgcgaattcttcctttattcattcagtaaatagtattgtgtggtcaaccctgtactgtttggatagcgaggtggtagagtagcaggacagaagcagcgccttttgcaccatagatagacaatgaatacagcattaatgtcatgaagttcccaggtacaaggtaagccacgctttatataacctaaacttctctgaatattgaggatcccctaatacttgctctttcgtctctatactcttacagatcatctctcattaccattttatttgtactttctcttcagcaatgtttagcaaagtggttttgttgtaagtggtataatatgacattgcagagaagtgcagccaggagagagtgctaatggttgcaatgaagacatcttattgcagttggttaaaattgttcaaattacctgttacttgataatataccaaagctggtatattaatttaaattaattaaaatcatctgcccagcttactttaccacaactgtgtcttattctgtctttttactgacaccttgaatatgtgcaagttctccccctttctcatagaaccaagtatctgtgaccatctttatctcatgccaaacttatgaacactgaaacagttccctgtagtcatccaagcagattatgttttaccatgtgggaaagctcttttatgaataggagatgaggtttatttttctccctactaaaagtataacacactcttattttctaaacaaaatataatctccttaagtatataggtgaatttgcaagaaaataagggaactttttacaggtcaagcaactagtgaaagtggaaatgcagagagacaagcaaacagctgtcaactgttctggggcaaatgctgatctcacaagcccagatcttcagctttagcagcatgcaggctactggagaaaaaaaaaaaaatcctgcaacctccagaaatgagactttatagtagagatccctgcaaaaagtgggacttttggatctattccacattcaattttccatataatagaaaaagagaaaacattctccaagttattttatgaaactggtgtaaccttagtacccaaatcagataaggacagtacgaagcaggaaagttgcagaccatgttcactcatgagtttaaataaaaaattaataaatggaatattaacatccaacaattgtataaaagacaatatatcatgaccaagttaagttaaatccaggctttcaagtttaacttgacttgcagtcagtgagtaatgtaccaatctacagtagctgattaaaggagaaaaattatgtgatcatttcaatagatgaaaagtcattcaagactaaaagtccttcataatttttgagaaagaaattccagtaaattatatggaaaatatcttaacccgatgaacttatataataaaaacctaaaggaacagtcatgcttaacagtaaaaaactgaaatatttactttaattccagggatgagaaaatgtatctattatatcatcacctctgctcagtattgttttggagattctaaggagcaccataaagcacaccaacatggcacatgtatacatatgtaacaaacctgtacgttgtgcccatgtaccctaaaacttaaagtataataataattaaaaagaaaaattaaaggtataacatttggaaaatagaaaacaaaactttcattattagcagatgatatgttctacatagaaaatgcaaaagaaacttcaaacaaattattagttttaataagtacatttggctgggcacagtggctcacgcctgtaatcccagcactttgggaagccaaggcaggaagatcacctgaggtcaggagatcgagaccagcctggccaacatggcaaaaccccatctctactaaaaatacaaaaattagctgggcacctgtaatcccagctaagtgggaggctaagacaggaatcacttgaacccaggaggcggaggttgcagtgagccaagatcacaccactgcactacagcctgggtgacagagtgagactccatctcaaaaaaaaaaaaagaaaaattaataagcacatttagaaagacgctggataggtttaatatacaaaactcaattgcatgattacattttaagcacatctctgtaaggaggctttgagaataattgagttgtggatgcaaactttttcacatttaaaactttgcctgaagtgcatcttctggctgtaaaaggaacctttaaaaataaagcatctgggggacatcagattaagatggaggataggaggcaggactggcttgcagctcctgctcagacagagagagcaatatgtgaatactcacatcatgaacttttgctccaagaactagtgcaggaacatactaggaaagtcgagagagttcacagaccctctgaaggaactggatcactgctgcaggctccctgagacaccaaaaatctgtgtctttttgcattatcaacaaggaggctcatggtctgaggcaagtcctcagccctggtcaccagctgcctggaaatagactcggtgctgttggaggggtatgatgggagtgagacaggcctttaggactgcaggctgtgtgggagtggggtgaggcttgtgactgccagcttttcctcacttccctggaaacctatatggcttagcagaagcagccataatctccctgggaatgtaactccattgaactgggaaccacacccctatcccacacagcacattcatcaagccctgccgaaggaggggctgagctcagacatgcctatccctacctccacctggtagtctttctctacctgccctggtagccaaagacaaagctcatgatctcttggccctgcccaccacctgagaaacctgaatacttaaccagatgcccctaggggaagtttgcatcctccctgtagaaccacagctgatgtactcttgaaaacaccacctcctggctagaggccaatcaatacaaaaccagcatactaaacaaaaacacaaccaaggatcctcacagtgtccacttcactcccctgctacctccagtggagcagatgctggtatcaacagctgcaagagctgaaaatggatcatatcacaggacactttgctgacactccccagtaccaacccagagcctggcagctccactgggtgggtagacgcagaataacaaaaacaatcactatagtttggctctcaggaagcccctctcctaggggaagtaggagagcaccacatcaagggagcactccgtgggacaaaagatctgaacagcagcctttgaatcccagatcttccctctgacatagtccacccaaatgagaaggaactggaaaaacaagtgtggtaatatgacaaaacaagtttctttaacacccccaaaagatcataagcagttcacctgtaatggatccaaatcaagaaaaaaatctctgaattgccagaaaaagaattcagaaggttaattgtgaagagaaaggtgaagtctaacttaaatcaaaaatgtgatacaggatataaaatgaaaaatctttagtgaaacaaaaagcataaataaaaaacaattacagcttctggaaatcaagaacacactcagaggaatgcaaaatacactggaaactctcagcaatagaatcaaacaagcagaagaaagaacttcagagctcgaagacaggctttccgagttaacccaatccatcaaagacaaagaaaaaagatttttaagaaatgaacaaagcttccaagaagttcaggactatgttaaaagtccaaacctaagaataattggtgtttccacagaaaaagagaaatctacaagtttggaaaacatttttgagggaataattgaggaaaccttccccagccttgctagagagccacacatccaaatataagaagcttcaataaacctgggaaattcattgtaaaatgattatcccctaggcacatagtcatcaggttatctgaagtctagacaaaggaaagaatcttaagagttgtgacgtaaagcatcaggtaacctataaaggaaaatctgtcatattaacagcagatttctcagcagagatcctacaagctagaagagattggagtcctatttttgacctccttaaaaaaaacaattataagccaagaattgtgtattcagcaaagctaggcttcacaaatgaaagaaagatacagtctcttccagacaaacaaatgctgacagaatttgccactaccaagacagcactacaaagactgttagaggagctctaaatcttgagataaatcttctaaataaaccaaaatagaacctacttaaagcacaaatctcacaggacctatataacaacacaatgaaaacaaaaaccaaggtattcagtcaacaaatactatgatgaatagaatagtatcacacatctcaatagtaacattgaatgtaaatggcctaaatgttctacttaaaagatacagaatggctgaatagatgaaaatttactaagtttttgctattttcaggagactgataacaaataaggactcatataaacttaaaggggtggaaaaagatattccatgcaaatggacaccaaaagtgactaggagtagctattcttatatcagacaaaacaaactttaaagcaatagcggttaaaaaagacaaagagagacattatatgatgataaaaggactaatccaacaggaaaatatcacaattgtgaatatatgtgcacctaacactagaactcccaaatttataaaacaattacttctagacctaagaaaggagagagacagcaacatattagtaggggtctttaatactccactgacagcattagatgagtcatcaagacggaaactcagcaaagaaacaatggacttaaactataccctacaacaaatggtcttaatagatacttgcagaactttctacctaacaactgcagaatacacattttattcatcagcacatggaacattctcctggatagaccatatgacaggccacagaacaagtctcagtacatttaaaaccattgaaattgtgtcaagtactctctcagaacccagtggaataaaataaaaagaaaggaaccctcaaaaccgtgcaaatacgtggaaatgaaataacctgctcctgaatgatcattgggtcaacaatgaaatcaagatgggaattaaaaaattctttgaactgaacagtaatagtgacacaacctatcaaaacctctgggatacagcaaaagtggtgctaagaggaaagttcatatcattaaatgccaacatcaagagtctgaaagagcactcagacaatctaaggtcacacctcatggaactggagaaacaagagcaatccaaacccaagcccagcagaagaaaatacataacaaagatcagagcagaactaaatgaaactgaaacaaacaaacaaaaaatacaaaagataaatgaaacaaaaagtttgttctttgaaaaggtaaaattgattaactgttagtgagattaaccaagaaaagagagaagatccaaataggctcagttagaaacgaaacgtgagatattataactgataccacagaaatacaagatattcaaggctacaatgaacacctttatgcacataaactagaaaacctaaaggagatggataaattcctggaaatatacaaccctcctagattgaaccaggaagatatagaatctctgaacagaccaataacaagcagcaagattaaaatggtaataaaaaagttgccaacaacaaaaatgtccagaccagagaaattaatagctgaattctatcagacatccaaagaagaattgaaaccaatcctattgacactattccaaaagatggagaaagagggaatcctccctaaatcattctatgaagccagtatcactctagtaccaaaaccaggacaggacatatcaaaaaaagaaaactacagaccaatactcctgatgaatatagatgcaaaaatcgtcaacaaaataatagggaataaaatctaacagcatatcaaaaagataatccaccaagatcaagtgggtttcataccaggaatgcagggatggtttaacatacttaagtcaataaatatgatacgccacataaacagaattgaaaacaaaagtcacatgattatctcaatagacacagaaaaagcattcgatgaaatctaggatcattttatgattaaaatcctcagcaaaattgttatagaagggacatatgttaaggtaataaatccatctaggacaaacccacagccaacattatactaaatggggaaaagttgaaagcatttcccctgagaactggaacaagtcaagaatgctcaccctcactacttctattcaatatagtactgaaagtcctagccagagaaatcagacaagagaaggaactaaggggcatccgaattggtaaagaggaattcaaactgttactatttgctgatgatgtgattgtatacctagaaaaccctaaagactcatccaaaaagcttctagaactggtaaatgaattcggtgaagtttcaggatataaaatcaatgtacacaaattggtagctctgctatacaccagcaatgagcaagctgagaatcaaatcaagaactcaacccctttcacagtagctgcaaaaaaaaattaaataaattgttaagaatatacctaaccaagaaggtgaaagacctctgcaagaaaaactacaaaaccctgctgaaagaaaccttagatgacaccaacaaatggaaacacatctcatgctcatagatggatagaatcaatattgtgaaaaggaccatactgccaaaagcaatctacaaattcgatacaattcctatcaaaatgctaccatcattcatcacataactagaaaaaaccattgtaagactcatatggaaccaaaaaagagacctcatagccaaagcaagacaaagcaagaagaacaaatatggaggcatcacattacccaaattcaaactatactataagccatagtcaccaaaatagcatagtactggtataaaaattggcactagaccaatggaacagaatagagaacccagaaataaacccaaatacttagagccaactgatcttcaacaaagcaaacaaaaacataaagtgagggaaatcatcccattcaacaaatggtactgggataattggcaagccacatgtagaagaatgaaactgggtccttatctctcaccctatatgagaatgaactgaagatggatcaaagacttaaatctaagacctgaaaccataaagattctagaagataacattggaaaagcccttctagacattagcctaggcaaagatttcatgaccaagaatccaaaggcaaatgcaatgaaaacaaagataaatagatgggacttaattaaactaaaaagcatcggcacagcaaaagaaataaacagcagagttaacagaccatcaacagaatgggagaaaatctttacaatcaatacatccgacaaaggactaatatccagagtttacaggaactcgaacaattcagcaaggaaaaaaatttctatcaaaaaatgggctaaggacataaatatacaattctcaaaggaagatataaaaatggcaaaaataaaaaaggccaacaagcatatggaaagatgcccaacatcactaactgtcagagaaatgcaaatcaaaaccataatgcaataccatctcactgctgcaagaatggccataataaaaatatcaaaaaataatagatgttggtggggatgcagtgaaaagggaacatttttacactgttggtgggaatgtaaactagtacaaccactatggaaaacagtgtgaagactccttaaagaactaaaagtagatctactgttgatccagcaatcccactactaagtgtctattcagaagaaaagaagtcactataccaaaaagatacttgtacacgcgtttatagcagcacaatttgcaattgcaaaaatatagaatcagtccaaatgcccaacaatcatgagtggataaagaaaatgtagtgtgtgtgtatatgtgtgtgtgtatatatatatatatatatacacacacacacacacatatatatgtatatatatatacacctatatatattttatgactgagtagtatttcattgtgtgtattcgatatattttatgactgagttgtattccattgtgtgtattttataaaatggaatactactcagtcataatatatacattttctttatccactcgtgattgattggcatttatacatatatgtatatatacacacatatatacacatatacatatatatgtatatatacacatatatatgtatatatacacacacatatagatatacacatgtgtatatgtctgtgtatatatacgtgtatgtatatacacatacatatacacgtatatatacatatatacacagacatatacacatgtgtatatgtatatgtgtgtgtatatacatatatgtatatgtgtatatatacacacacacacaatggaatgctactcagtcataaaaaggaacaaaataatggcatttgcaacaacctggttggaattggagactattactctaagtgaagtaactcaggaatggaaaaccaaacattgtatgttctcagtcatatgtgggagctaacctatgaggacacaaagccataagaatcatacactgaactttggggactcgggaaaggttgggggtgtcaagggataaaatactacacattgggtacagtgtacgctgcttgggtgatgggtgcaccaaaatctcagaaatcacgaaagaacttattcatgtaaccaaacaccacttgttcccaaaaacctattgacataaaaagattaaaaattgaaaaaaaaaaaaaaaccaaaaccacctcaattccgtttttacatactgtcaataaagataaatataattcaataaaaaagaatttgcgatattaacagtagtataagggctgtaggcataaactagattgtggttgatatttatgccatttatggaaaaaaattaaagattaaacaaatggagatatttaccatgtttatagataggataaccagatataaagtatcaaattctctctcaatttgtctacacgtttaatgtgattacaattaaaatctcaacaaattgtttttattcactcaagaaagttgtaaaacttttctgcaaaacaaagcaaaaatagctaaaatcttaagaaaaagaacaaggtagaagtacttactttaccagataagtaacttatttttaagctaatgattaagacagagtcatgttgaggaaagcaaaagaattattatcacaaaattcaggatagtagttaactttggaggagagggaaaaagagaatatttgggaaagtcgacagtattggaaatcttttttgaactgagtagaaaatacatgagtgatttttattattgccatgcatatgtgacctacatcattacatataagtcatttaatcataaaacagtttcaatgtcatgttaaaaatcattttaattctaaaatatgttttattcttttaatatgtaccatcagacttccgtaatcccataattgggagatattataagtaatggtttcctaatcctgactgataatcagagaactgaaagagttttaaaaatatagattttatgactccctaacggtctgttaaatcagaatcttgctaaatcatatcttgggtcagggaatatggtgaaagaaaaaatgattggtagtgtagtactctgttttaaaaatcaaacatccactcctctcccatttgttattgtttctgtttaattctcctggtgagtctaatgatcaactagttaagagaaccactgattttctagtttctcttgtcccccaatgtaagatttttctttctgtgctatcctaaaagacaatttgtctcagcttatgtatttctataggcgacaagctcattaagcaattcttcaactaatatcaggttcttattgttcaaaagtgttaatggtaaagaaaaatgagcgagatactttttgtataactcttagcatcccgcctcatacctgccacacagtaaaggctctataaatattggctattttcatgtttattataaccatagtaatcgatgatgggtcaaatcctagctctctgttatttccaccatttagccccagttctgctgtctggagcaacagaaaacaggccccttttttctaccatgggacttgatgtttaaaagcattgtcctgtcatcttttaagcttctctactttttgcagaatttatgaagttcttataagtgttcgaagtataaattgaaaggcaaacacctcacttttcacagcacacatctcagagtttattgtaggacacaacagtagtgtgtctacaaaactggttacctgtgagttaataaggaagtaatccagtcagctgaaattacagctgggcttctgagattttaggactgccatgggattacattcagcacatctaagcacacatttctctagctgaactaataagttgttactttgaagagattagggtataatttagttttaatcaaggatttcctctctttaaaaataatataatgaaatcagtaattttatagtattaatgcataagagattgtggatttgtagtaaatatttaatcctataaagaaattgttattcctgatgttatgcacatcacaaaaactcagaaattaccttcctaaaaatatttatagatgattatttttgtttttctttttgtcctgtaacagtttctctcccttctctttgcactagtcacttacaacccattatcgcctgcttaactgatcttcttaaggttcctatccctcatcctccaatcaagtcaagtgataatttataaaaataaaagttttgataacagaaaaggtttggagattttttcccattggaattattctgaaatcagctccaccttcttgaagtagttcagggagacttagcatttcttaaagaaaatggttgacaaccggaatattaattgttttgttttgacttttaaatggctaatggttattacagaatgaaccattaatcaatgcacatactatataaggattctatcaccttgcttctgcttccttagacaaaacagatcatcctcacagctgggcagtaaactaggatcaggtgaaggaaatatctgaaggatatagctctatctaaaccagacagtaaattgtattaaagatatttgtggcactagtcagcaagtacattgtgaaaatgggagcctcatcgcacttctaatagatatactaagagtgaatgtaaagagtcaactcagtgtggtcaagcaatcttagtctagaaaattatagcgaagtgaaactgtacgtcaacagctcttggcttatgaaattgctctggcaagaacacaattcatgaatgtcagatgtctataactttggcttgtgtttagatcgccaaaagaaagcactgtgctgaggttgttaaaatataacccattcctaatggaagataaaacccaaggtaccctaagtagcaaaaataccgtgggccctaaataaaagtttggatctcacagtagcagagaggaagcatcctcatgcaatgcattgtaccaaggtaaggtagcagtggcactttattgatgatgatgatgatgatgatggtgatgatgatgatgatgatgataattacaaggatttgaatgttggttgttccgaacaaaactcatgttgaaatttgattcctgatgtggcagtgttgggaggtgggatccggtgaggggtgtttgccatcataaatagattaatgctctccctcaaggtgagggagttcttgctttcctgagaatggattagtttcagaaaaaagctggttgttaaaaatattataattttcttattttctttctctcatgtcctcagttgtcatgtgatctctttgcactcctttttcatgttctgccatgagcaggaggagcatgaggccctcaccacacatagctgcccaatgttgaacttaggggagggagaggaggagaagaaactgtgaaagtagaaataagcctactggcattttacaattaagtttttgagggaatggaataattcatctacgttaattatccagataactgaagtacccattaaagatacatataatggggataatttggagataattttgattagatatttttctaaaaatttgtacatctctgacttcttaaacaatattcagaacacaatatatgtcttttcttaaaatgactcaatgcctgtcatgaatatcattcactactgtagtgatcaagagaagcactctgaaaccagactggttgggttcaaatgtaagctttatatgtgtcagttgtgtgattttggaacaaaatacttaacatctctgtgttttagtatgctaatgtagaaaataagcataatagtagttccatttcataagatttattgtatggctttgtctcaggctatttttagtataaaagaatacttaaactggaaaattattttaaagaaagaggtttaattggcttacaattctgaaagctgtacaagaagcatggcaccaacacttgctcagcttctggtgagggctttgggaagtttacaatcacagtagaaggtgatggggagccagcatgacacatggtgagagcaggaaaaagatagaaagaggaaagaggtgccacatactcttaaacaaccagctcacatgaactcagagcaagaactcacttatcaccaaggggatggtgcattcatgagggatgacccccgccctgtgatactaacacctcccacaaggccccacctccaacactggagattacgtttcaccatgagattttgaggggtccaatagccaaaccatagcatgattcagtgaattaatgtgcgtatgtagctataacagtacctgccaaataataagggctgcataaatgattattattgaacatgtcaaagttgtttactcatttattcattcccgtaggatttattgagcagctactatgtgctaggtgttattcaaggcatttggtaataaaggcccctgccctcacagagcctgaattctaagtagaaatgatagataataaaataaacctaagtacattatgtgtatgatgtgtgtatgatggtcataagaactatgaaaataagaactaaaccagaataaagggaattggaagtgctgaggcagggtaaattttggcagggaaggagcagtattaaatagaatggtaaggttatataagtctcattgaaaagatgagtttttaaaaatcttatgtatcacatacaataaatagccataaactatagtacttttgaggtaaaataactttttagttctctcacttatatattattttgcccccaatacatttatgcttatcccatttgtcaacacaggcaagccaaaatgacgcaagaacccttcctctgtgtgacgcaagtctccaaaagagaaacattaactcctttatgcaaagcaagtccatggctaacaaaccatgtcacctaaactttgactgccttgccctagactttatcatggctcagtgctcctgtcctgaaaggaagtctctcttgggtactacaaactagtcttttaggccctctgctcctcctcccactctactgtgaatgttcagctatatggagatttaagcacctgaggagggaggatttcagagtagaactggaagcacgatggggtaaatgtcttagaaacccaaagaagggaaaagggctcttgtatttgaagttctgtattaactttatttgatatttgcgaggagagtataagcaacttgcaaccacgattctatactccagttataaactaacccaaatggtctagggattcaggcatagagtgaagtgtatcctgaactgaccctttacattttagtgttttctttttggttttttgtttttttttgagacagggtctcactctgtcactcagggctggagtacagctgcacaatcacggctcactgcagactggaacacccaggctcagatgatcctccctcctcaatctcctgaatagctggactacaggcacaggccaccatctctagctaactttctgtgtttttttgtagagacaggattttgccatattgccaaggctggtcttgaactcctgggctcaaacagtcggcccaccctggcctcccaaagtgctgagattacaggtgtgagccaccacaccaggcctacattttatataaatgttttatgtgtacaaatatctagaaggttctacctcttaatatcggctaaacaacgattacacattttgattttaatgtcaacatgatccaacaaactagtgcaacttctttagaattgggatagtcaatttatctattaggttgaaataaataagataaaatgagataatacaggcaaaaagtatctggtagatgttaacatattttatttaaggtgtgtgtaagacactgtttcataactactgaatatttttgaatcaattttctctaactatattaactttgaacaaattatttaactgctgtgaaacacaatttcctcctctatatgttagaaataattcctacttgaaaagttattgtcagagttacaaagaatactcatgaagaatctcgtatgctacctgacatatagttgttgttccagaaatgaaataaatatttattatattatgcaaagaaaacttactatatataaaatatatatatatatagttaactgcattaatatatatatatatatatggtctaacaaaaccagtgttaatttttcttgtttgttatttagagttatttctatattagctctctaaatcagttactttgtcactaattagatgattaatgttcccatataacaagcatggtcataaatgaggattgtgtggcacaaaatatttatttttgtactgaaatgcaatgctatgtcaaaattacttcatgatgagagattcaagcatttattataaaaatctcttcctttttgaaccattggatatagttttatatattttggttatatgaaattcaattatttataattccatgcatttatgcgtcatcacatgtctctttatatgtttatatgtctctttaaggtcaagaataaacttattttatgttctctactttaagaactatgaatttctgatattttaccctacttaaaagctgactagttagtctgccacagttgcatggatgctggcagaaaataccataatcctgatacaaaggtcagagacaaaggattttgttattcatggcaaagcagacagcattggcttcttgtttgcaatggtttcccttgtcccagttcccacaggatgacttggaggtgggcctttgtggatgcaggacacgcggtggacttaagcaagtcaagccaaactttgcttcacggggagacattatatttattacactgatcagcaaacaaatctgtactctattccacaggagtagatgctacaaaaggcagtcagagcctctactagcaagacgtaaagaaatgcagggcattcatgaagaattgtctggcagcactctatagcacttagtaggctaggtatcatagtagaaactcagtgaatgctgaagtaaattaatttgaccagggaatcatttcaaaggagcactgaattgaagtcatcactgtaaattacgcagctatttatgtgaacttctatgctggcttccctttcaactgaagttctaagaaagatactgattttaaagaactcaaatatttctataaatgttatgtagaatgatgctaagggtccatggcaatcaaagatagagataaaggggaatgaaaattcaattagtgaagtgacaaattataggagttccttactgggatattagcaagagttatgattagttgtgtgctggtaaatgtttaatacttgtaggttttattcaagtaggaaaaaaaagtcctacttggtagcatttgccttttttcctagtatcaagttatcctactatgaccagtttcaagctatcaatgtgattatctctgaatgcggagttagggaaatatgtctacagttttctcttcatctagaaccgtgggctagctccagtgcaccactggttgtggtgtacaaagtggaagtaataacaccaaaagttcactccccaacaaagctccatcctttgtcccagtgttccccatcaatatgaacagtgtcaggtgcagtgctagtgggatttcatgggatatccatatttggcagatctaacattcattgcttagtctacagaagaatcaaaggaaatgagcttgtatgacaactctcaaccctgtgagcaggactgaggtcaggatgcagcgttatttttcaacccttccaatgctatcattattgatgccaaagtcttctcctccctcttacattgtccctgggttgtaaggtaagaaacaggagattccgttttgctggcttattcactcccacgacccatttattttatatggggtcctaattgtcagtagctcagatgctttagcttacacaaggaggctaagtgaccaagttatgaacactaacatattttgggaccagcacttgctgactggtacaacattgctacctttgttccattatcatagtgcttgaagtttacaaacaaacttgacatgttctctttacctcatttcccaaggtgaaataatcacaaaatggtaagtagctaagctttcatcatgccaaactgctgaggagagatccatgggagaggtgttatggacaaacaccaagcaggcatgcgcccaaaggaaaaattcaggtagatgtttgtatcatttttatgttactattttcagaaacatgcctgattttaagtgactctacttacattctactgttcagatgattcttatctaagtccagagaatcatatacagtcactggaaacagctcccacatcaatgtatattgaaaaatgactgttaaattatgtacacaataccgtgctccttgtgggatctgggaagaataaaaaaatatgtacacaataccgtgctccttgtgggatctgggaagaataaacaaagtcttcttttgcttctccagccagcacaaccaaatatcccaaatctacatagtttttctcccttcttctccctcaacctcaattagatctatgtctgtttgtttgttttaactactggatttaaaaagtgcttccagaatacagtactagtttgacagtcgctagcagagttgattacacattaaactaaacatagatggatatgtcctctttcagacagctaaaattaccttttggttgggtgtctgttttggaaagctcaatttcagttccagcaactgtacacctgaaaatgcaaggcatacccattaggaacaaacagtactttttctctatttaaaccctgatggccttgaggaggcaaactgccactatgctaagcacagtaagaacaacattttggattagagacataatgaatctatttgtttttcaatttttagagaatcataccggttagaataataacctttgcttcaaaccccgaggcagaaaagaaaacttggacaatcttctaatttctaattactcaagaccttcaaatgtgtgtctatatgcttgtttttgctttagtaagaagtgttttaaaagatgaatattccacaatgtttacatatattgaagcattaggttataccctataaatatatataattattatttgccactttaaaacttttaaaaatgaaaagaattctttcattcattaatttcattacttatttattaagtatttaatatgtgtaaaatcctatactaaatactagagaggaaaagtatattttatatagttcctattttggaagggtttttaatctagtgaaagtcaaacatgtgcagacagctttagcacaatttttaatgtgtattataaaaggaataaatgtagtgcaatggtagcatggtgaaatgggttctcaactaattgatagttacttaggaacatgcagttaagtcttgttaactttgtaagcttctaatcatttgcacaatcctgggaaattacccctctgggtacattcatgggttgcaggcaaattatttttacatggagaacatacatttattcttgaccttaaagacgcaagttgttgaagagatgtgtgatgatgtgtaagtgcatgtaagcataaagcactgaattgcatgtaaccaaaaatagataaagctatatcaagcagttcaaaaggggaaagatttcttattttgtagcagataggtagattggggaagacattttgcaacttgccaacctaacaggtagtattgctggaaactttcagaggtgagggaattttctctaatccaatggcaccagaagtttaccagccaaaggcattgagatcacatatccaaggaggcaaaggcacagacggagctaccaagggagagaaataacacattgcaaattgatggtcagagaaacttttaaaaattgacactacaaattattatatcttatccttgcctgtgtggatcaattggaatccctccaatacccattccctaattggcagttcattaaaacagtacctgatgtacagttgttgcttttttaaaaattatattttaattataccctaaaaattccataatttcttttaaaataatgagacaacaacggaataacaaacaaccagagcttggctctagttgtctgtgaataggctacttcctgatgagatacacagcccaggagttttctttattcttttctttcgctagtctttaaaatgagcaggacctgaaagggcattcttggtactgtctatcaaagctaaactactcggtgagatgtgtctttagtctgagctaaagtctgagttatgtttttcgttgcagtcagctttgaactgtgaaactatataagaggatgcaagaaacattgtctaataataagaggggtgggctgtgaaagtctgacaaccacttaatagtgttagtagtctctgctgtcaggtactgctaattttcattagtgatagaagagggattattaaacattttagggtttatatatgcagcatacttctaaaggatagtgtgattaaaaggaataaagcgtttcagctttaagaaatgtagtttctttgctgttggagatttgattctacttaatgactttaaagtaagctattaagaagttggtctttcattaattatgaatgatcatacttttaaaaactatgtgtaaatggctgctgagattttcctgagattactacaaaaattagcttcaaatcaaggaacattaatgcacacgatttcatatttactacagctttgaaccacagaagtgtgacttagatgtttaaaagctaacaccctaaattgagaccctaaatagcatgaattttaattaaagggattttttttcaaaaaaatagtggatgctattattatgagaaagttttggggctgcattttttgttttctgttctgtagcatgtaataatgtctgaggctaatttaggtacacagaacattatggagggagtaaggtttttggtataggtaattgcaagctctagaaaagtctgtattttctatttgacaaacaatgtgtaaagaaaatgagtcctagaaggtacatattgtaattgagttgttaaaagttaatccctgacactgacattgttcccaagcctaccattgagaaaaccttcaggagactgttgaaagctgcatttaggcttttttacttcctcaactcattataccaaaaacctaggaccatttggttatttgtttttctctgaaaaatatttttcattactggaaatacaatttgaaattccctctctcatcaggatagtgtatcattcatgtcgtctcccactctttgaaaactttaaaaaatggcattagctttaaaaaataatgtaaaggtgaataatgaggtagtcaccacttctgaaaccatgtttcaaaggaacaaaggtttgaaagaaagcctgcctaaagtgttaaggagcattattgagctttaataggtcaaatgcacaagaaaagagaaagtaatttagtagaatacaaagcctctccttgacagtgaggccatcttatctttaaaatattatggcagtttgaattgggacttttaccagagttcatgaagtggcatggagggattgagaaaaatagtggtgaaattacctcagtcaagactctcattaagaagcccattaaggaatccaggattatttcaacaatctttgagaccacttctctgtctcctttatttgtcctccaatccatcatgaaaagcactgccagactagtcttcttaaaacatcattttaatcatgtccgtttcatggctaaatacctacagaagatagatgcagccattttgtccaacataaattgaaactgggataagctggagatggggaaagtggttattagaaagtcaacaaaaagagttccaggcataacacaataaaattcacaacaaatgtacatggtgatccaaatataaagatgcaaatgagagaggatgtgaggatgagagacagtgagtgtgtacatgaaggaaagtggacaagattggatatctcttggatactagaggcaaaggaggggtaaaggacaggactgcagcgaaagcctggagccccgattatgtctagcttgctgccaataatctgggtatcttgcacaagcatttattttcttcgcagctcattttccacatccttaaaatacaaaaatattggaatatagcattttttaggttgcttcaattctataactcagattagctgttatttagtattttaaacctctttgtgaaattgatggtaatacacaaaacagagacgaggaaacagctaaaaaatgtcagggaaaataattggttctggaatggatatattgtcttgaaattgctggcatgtttgtgaaactatgtgaaaacttttaaaaaatcgtttattgacagccagtgtgttccaggcactcagcagaacagacatactccttccctacttcaatggagtcacttcctatacaaatttactagagagaaagcaagagagggcaaatatgacacagagagaaataaaggaaaacatttaaaaatgatgggcaattcaacatgccacttagttcagtattttattaatacatgcccagagtgagcgagatgaaagacattaatattctatgccctatttaagtttcatttttcccttgcctcacaagcgtgaacattgttgttccgctgagggtaattttatatatttttcatgcaaccatgatctctgaacttaagccagttacatcatcttatgttcaaccaagggatgagtgatcatgacaacacaagaactatagccatactggtcttactgtgagatggcatgttggtttctaatgtggttccctccaaagagatcatcaggttactttagagtactatgtgttgtttccaataaagaaaatcattctgctttacagcaacagttaaggtatctaggagttaatggagagaagatgtgagagtctggaacaattagtactgaggaggagctttattctttgaagtttatttccattttgagatggggcttagaaagatatttgagaggatcaaagtagtgtttttcagatattagggttcatagaaaaatgaacttggtggagtcatctgtgagactcttgtctgatgtgaaattaaataactgggactaggattgtggataagggcaaggcaaggaagtagctcaaccaggatgtggcatcatcagagctaaggtgccaaccaaggatcagtagaggaaagaaagtctggaacaaagcgtagtcagaagaggaaattaacagagccaaaaatacaatagggggtatgatcagaactttgtcgacctgcccttctattcttttaactctctatgcagataggtacctacaagttcatgtctgccagaggctctttcattaatctgttccttagtttggatgattgtaaataccacagggcagcaggtgggccagcacacattcaatcaactttaattttgtttctgtctacacaagtctctgatcaaataattgctaccagtaatacataatctacttatctgtattatctccatcagtgctcccaaagatgctttaaggcaagtaatttttttcattttccgcagtagatagattcatagaggataaaaaatacttactggcctaggaaatttcaggctcttatcttcttccctatgacttaagttcttgctgactaaccctctttagtgtgaggtctctgacttctgccaggtccgtaggcttccatcttgctctttccaggcatcatttctgggacaaaaatctaaattttaaaacagaaccatggactacttaatgtcacatccctctaatgtcaagacctattcacctgaacctcaacttttcattcatccttgctacatgccagaactagttctaggaaagtagagatgagtaatatcattttattgatttttaaaaaatttgtattatagtggagacattccctgtgaacaaacaaaatgcagttttataggggatatgacagaagacttaaaacaattgttctcagacatttttctgctccagttcaaccaaaaagtaggacatcctcctgtcagtaacaagtgtttacctttcaacccacacatgtgctggcaacacatttgagggaaaacagacataattttctcctcctctttctcccctcattccccatctgtttccactgagaaatcctgaagttaagggttacagagatagggaagagggttacctggggatagggaggagatacttatggatcagtgagtgtgatattactgtcttacttgaatggtaagtaggtgttagcatttgctactcagtgaggaggccagtaccagtagagggaatggtggagtaaaaacagagaagtgtggaatagtatgatgcctcccaaaaacctacaaggagttcaggatggctggaacaatgaagctcaaagacagaagttgaaagagatgagctatgagggggcaattaagcctcactgggatgtaaaggggtttgttctatatcctgtaagcaatcagggatactgaatataaaaatgacatgcttagattttgtgttatggaaaaatcactctgttggcaatccaaaaaatgggctggagaaaagctgggccattaggtcagaatgcaagaagtggaatagggcactattgatgaggagcttcaggagggggacagatggcaaaacatcctattgtaacaattctacaacatacatttttaatacattataaaaaatagaaatgcatcttaatgggacgtaaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaatttgaaaaaactactttaaagttcatatggaaccaaaaaagagaccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccacatatctacaactatctgatctttgacaaacctgacaaaaacaagcaatggggaaaggattccctatttaataaatggtgctgggaaaactggccagccatatgtagaaagctgaaactggatccctttcttacaccttctacaaaaattaattcaagatggattaaagacttaaatgttagacctaaaaccataaaaaccctagaagcaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgtcaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacagtgagataccaactcacaccagttagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactacaaataccatttgacccagccatcccattactgggtatatacccaaaggactataaatcatgctgctataaagacacatgcacatgtatgtttactgcggcactattcacaatagcaaagacttggaaccaacccaaatgtctaacaatgatagactggattaagaaaatgtggcacatatacaccatggaatactatgcagccataaaaaatgatgagttcatgtcctttgtagggacatggatgaaattggaaatcatcattctcagtaaactatggcaaggacaaggaaccaaacagcgcatgttctcactcatagatgggaattgaacaatgagaacacatggacacaggaaggggaacatcacactctggggactgttgtggggtagggggaggggggagggatagcattaggagatacacctaatgctaaatgacgagttaatgggtgcagcacaccagcatggcacatgtatacatatgtaactaacctgcacattgtgtacatgtaccctaaaacttaaagtataataataataaaaataaaaaaaattaaaaaaatgcatcttaataactgatggtttattaaaaatattggtagccaagcaaatgttgtgagtttcattgcctgcacacttgtaaatgtagttaaaagtacactgggaaagaatcactttttgactgttttagtggtggcattgctaaacaactgcaatgtcttattgtttcattaaaaaaataaggataattaggggaagggtaggaggcttgtttgcctgttttggtgcttttggtaagattgagaacctatcaacatcaaaacctgtagcatagtggtttgctacttgggatgaaaaagacaataatggtgtattattttatgtaatactaaaccacagatgctcttgctggcttagaggacaatattttggaaaacgtcccacacgttgacaattctgatgaagtctaattccaaagatttagactctgaatcagaagtttaagaaataagttaacaatttattttgtgtatattttcccttcatgtattgacaaaaatggtagataaataacaaaagtctatgtcatacatagatttttcgtgtcagtttatgagggacctaaatttaaattctaattgctaagaaggcatagtgtcataatttaattatttttttcacaatgttgtataaaataatgaagagagatggtgttatagctctgatgaaatatgaaatcaaaaaatcgttaggataaattgtatgtggaaagtgaatcaccaattgtacaaacataaatattcattcagtgttgacaataattgaaaagagaagggaggataacacactctgaatggctaatatttagcaggtggaaattatatggagtctataatagtcatcaggaaaattatattatatatataaaatacataacgttaggcaaaaatgcaaataggttttcataggttatcatcaaataactaactaaataaaaagagttgtttgtaaaagtctaacagaataaagttgtattaaagaagagggatttagaatgattggttatcttataccttgctttaatgttccataatgctaaaaaaaataagattaatcacatagccctatcgaacaattgttttggcaacacagaaataaacagaaacactgcattttctcagacccacagtcttcaattaattcaagaactccttcagatacagagtatacaaattttctgatttgtaatagaaaatagccagtctgtgaatattagctaaataactatcaactgtcctcttgtggaatggcaaactgttgtcccaaaatcagaaagatttttatttgaaaaatttgcttgatagttttttgggaatttttgttttattttaaattttaaatttttgtgagtacatagtaggtatagatattcacaagatacatgacatattttgatacaggcatacaatgcataataatcacatcagggtaaatgggatatccatcaactcaagaatgtatgctttctttgtgttacaaacaattcgatcatactatattagttatttttaaatgtacaataaattattgttgactgtagtaatatgaaatacaagattttatccattctatccattatatttttgtacccattaaccattcccccaaccctcctccacccacccctacccttcccagcctctgataaccatcattctattccctgtctccatgagtacaattgttttgatttttagctcctaccagtaagtgagcgtatgcagtttgtctttctgtgcctggtttatttcacataaaagaatgacctccagttccatctatgttgttgcaaatgacaagatctcatttgtttttatggctgaatagtacttcattgtgtataggtacacattttctttattcatctgatgatggacatttaggttgctcctaagtcttggctattgtgaacagtgctgcaataaacatgagagagcaggtatctcttcagtatactgatttcctttcctttgggtatatacctagcagtgagattgctgggtcatatggtagttctattttcagtttttgaggaacctccaaactgatctccatagtgcttgtgctaatttacaatcccaccatcagtgaacaaggattcccttctctctatatccttgccagcattcattttgcctggtatttggataaaagccattttttactgggttgaggtgatatcacattgtaattttgatttgcatttctctgataaacagtgatgtttgagcacattttcatataccttcttgccatttgtatgtcttcattgagaaatgtctattcagatattttgcccatttttaatcagattattagatttttttctatagagttgtttgggctccctatgtgtattctggttattaatctcttgtcgcatggatagattgcaaatattttctcccattatgtgggttgtctcttcacgttgttgattgtttcctttgctgtgcagaagcttttaaagttgatgtgatcccatttgtccatttttgctttggttgcctgtacttatgggatattactcaagaaatctttgcccagaccaatgtccttgagagtttcccacattttcttctagtagttttatagcttctggtcttagatttaagtctttaatccatttttatttgattttcgtatacggtgagggataggagtctagttttattcttctgtttatggatatctagtttttctagcaccatttattgaagaggactatcatttcccaatgtgttttttggcacatttgttgaaaatgaattcactgttgatatatggatttgtttctgggttctctattctgtttcattggtctgtgtgtctgtttttaggccagtgccatgctattttggttactgtagctctgtagaataattggaagtcagataaggtgattctttaagttttgtgtttttttgttgtttgtatgttttgtttttgtttttgtttttgtttttgctcaggatagctttgcttatcctgagtcttttgcaattccatttaaattttaggattttttattctttttctgtgaagaagggcattagtattttgatagggattgtattaaatctgtagattgctttgggtaggtagtatgggcattttaacaatattagttcctccagtctatgaacatggaatatttttctgttttttggtgttctcttcaatttcttgcatcaatgttttgtagttttcattataaagatctttcacttatttgattaagttaatttgtagggttttattttatttgtaactattgtaaatgaggttactttcttgattttgttttcatattgtttgctgatggcatataaaaatgctactgatttttgtatgttgattttgtatcctgcaactttactaaatttgttgatcaattctaacagttttttggtggaggctttcggtttttccaaatataagatcatatcatgtgcaaacgaagataatttgacttcttcctttccagtttagttgcactttatatcttttgtctgattactccagctaggacttccagtactacgttgaataaccgtggtgacagtgggcatccttgtggtgttactgatcttaaaggaaaggttttcagtttttccccattcagtatgttactagctgtgtgtctgttgtatttttggcacttttaatgtgttaaggtatgttctttctgggaatttgaaggcttttatagtgaaggaatattgaatgtcatcaaatgctttttcgatatcagttgaaatggtcatatggtttttgtcctttattctgttgatgtgatgtatcacactgactgatttgggtatgatgaaccatccttgtgttcctgagataaatcatcttcggttatgatcaatgatcttttcaatatgttgttgaattcggtttgctagtattttgttaaggatatttgcatcaaattagtgttcatcagggatattggcctgtggctttcttactttctttttttgttcatgtgtctttggctttggtatcagggtaatactggtgttatagaatgagtctagaagtattcacttctcctacattatttctcagagtagttagaataagattggtattagttctttttaaaatgttttccaaaatttaacaatgaagtcatcaggtcccaggcttttctatgctcagaggcactttattgcagcttcaatctcactacttgttattggtctgttcaggtcttgaatctcttcctggtttaatttttgtaggttttatgtgtttagtaatttattaatttcttctaggttttccaatttattggcatatagttgctcatagtagcctccaatgatcctttgaatatctgtagtattgtttgcaatatttcccttttcacctctggttttacttgtgtcttctttttttttttttcttatttagcttggctaaaggttgtaagttttgtttatcttttcaatagctttttttcattgatcttttgtattatttgttgaagattagatggttgtagatgtgcagtcttatttctgagttctctgtctttttttttttaactagtaccatgctgttttagttactatagccttgtagtatagttggaagctggttagcatgatgcctccagctttgttcttttcgcttaggatagtcttggctatttgggctcttttttggttccatataaactttaaaatagcttttgctaattctgtgaagaatgtcaaagatagtttaatgaaaatcgaattgaatatataaattactttgggcagtatgcccattttcacaatattcattctttctatccatgagcatggaatgttgttccatttgtttgtgtcctctctgatttccttgagtggtggtttgtagttctccttgaagaggcccttcactccttgttagctgtattcctgggtattttattctcttcgtagcaaatgtgaatgagagttcactcatgaattggttctctgcttgtctgtcattggtgtaaaggaatgcttgtgatttttgcacgctgattttgcatcctgagaatttgctgaagttgcttatcagcttaagaagcttttgggctgacaagatgggttttttagatacaggattatgtcatctgccaacaaaggcagtttgacttcttgtcttcccatttgaatacctttatttctttctcttgcctgattgccctggccagaacttccaatactatgttgaataggagtggtaagagagggcatccttgtcttgtgccagttttcaaagcaaatgcttccagcttttgcccattcagtataattttggctgtgggtttgtcataaatggctcttattattttgaggtatgttccttcaatacctagtttattgagagtttttaacatgaagagatgttgaatttgattgaaggcctttttgcatctgttgagataagcacatggtttttgtttttagttctgtttatttggtaaattacatttattgatttgtgtatgttaaaccaactttgcatttcaggatgaagccaagttgattgtcatgggtaagctttttgtgtgctgctggattcagtgccagcattttattgaggatttttgcatcaacgctcatcagagatattgacctgaagttttcattttttgtcatttctcttctaggttctggtatcaggatgagagtggcctcataaaatgagttagggatgagtccatccttttcaattgcctggagtagtttcagaagaaatggtaccacctcttttctgtacctctggtagaattcagctgtaaatccatctgatcctgggcttttattgatttgtagtgtcacagggtccttggagtgtcaatttgctagctggaaacctctgttgccaccaggaccttctgcttgagtattgcttatgaccacttaccttgttccatccacttgccccagccaactgtgcttggcttacgccactggcccagatcctacaccagccaaggacaagccaggtgcagagtggcaaggggtgtgttggagagcaagcctggggtccagccacggtgtaaaaccaagctgaggctggccgctgaggcagggcaggcagctccaggcaccagcacacatgttggctctgtgagaaggtgcagctggaccagatgtactccatgtggcttgcgctgtaggcacctgtgtctggacagagggatcatggtggtgcctggaagcttggagacatcagaaactgcagaactccttaaagtgtgtcagacccctggctcagggagtccccaggtctgggatcctggagggcagcagctcttctccttctcattacccacagcgtggcaagcagggaagggtagggggcatgtttcagccctgtttatgttacaactcttttagtctcaccattcagtgggtcctgagtccttatactttgtccaggaagaatgaggcacgcaaacagctggagggtgagcagagaagagcttcgtggaatggcagaattgttttcaggagacccaaagtgggtagctcctttcctcaggcagatcgttcttatttctgtttaagtctggctgagttcaggtttttatgggctcagaagggaggaagtgtgtgctgatcggtccatggatggccacgggcgggcctggaaaaagcaccataagttctcactcctggctgtggactccacccagaactggcagcccagtccccaggcttcaagccatccctcgcttgaaggtggggtttcaccacagacccaaccctttccaccatggagcctgcctgctgccatcaacgtaccattcatggcacccaggctgcttgtgccaaggggcacctgccagcccatgctgagccacctgcagcaccccctccctcccttcctgagctctttggtgcctaaatcttcagagggagaccgagggggcaggggggtagtgtgtcaggacttccctgagtgcacacacaccagccaagtcatgacagcattccaggcttggcttcagccttgttccaaaagtggccccagggagtgagatcaggcacttccaaacctgtggggacaagggggcttcccgggcccccaagagctcagggatgcccatgtccagcaccacagcttaggtgagtacagctgtgtccagactaccactggtaatgtgctgggtcagtcttgaagccggtatagtactgggtcttgcccaaggcctgtcaaccactgactggctaccacctatgttcacttaaggccctgacgctccacaataagcaggtggtaaggccagccaggcttgtgtccttcccttcaggatagtgagttcgctctcattgctggtgggtccagagatgccatccaggagctggagtctgaagtcagaaactttaggaatctacctggtgctctattctcctgcagctgagctggtacctcaaccgtgctacaaagtcctactcactttccatctcctttccatataagaagacgtgtctctccccatagtcaccactgccctaggcccatagtgagtactgcctggctacagtcagcgttcattcaaggcccaagacctctttcgtcagcttgtggtgaatactgccaagcctggagttcttttttcaaagcaatgtgctcccatctggcccagggaaggtccagaaatgctgtccaaaagccaaggcatggaatcagggaccccaagaactctgggtgctgtaccccactgtggccaagctggtacctaagctgcaagacaaaatctccttcacccttttctctccgtttctcaagcagaatgggtctctccccattgccatcacagctgggaatgtgcttggttacaccaaagccagcatgtctctgagtctcacccaaggcccatggcgagtactacctggctacggctcctgattattcagggacctagggtattttagtcagcaggtaatgaatcctgccaggactggattcttcccttcaaggcagcaggttcccttctggcctagggtgtgcctagaactgttgtctaagagccatggcctggaatgggagtctcagaactctgattccttattctgctatggctgtgctgggttccaagttgcaagacaaagtcctcttgctcttccctctcccctcctttcctcaagaaaagggaaagtgtctatcccagacctgtgagctgtgctgcctggggttggggaaatgggtggtacaaagtctccctgagccacctagatggtgtatctctagttcatttgcccaagtccactggctctaagcatagcacagcacgaggattttcagtccttgtacctagactgcctttcaagtttatttaggacccaacagcattgtagccttttagtggtgaggcttgtcagaactcaggatccaactgctgggatgggctagtccccacttgctagggctggtgtaaatgctccttctgtgggcactggctgagttctgcctgttgttgctttctgctgtgacaggacagcattgagttccaatgttccaacgcaaagtcctgcaattactgcattctctctccctcaagcactcagattctctttccatgccatgtggtcactgccaagggatcagtgaggggtggcatcagtaattatacggtgtcattccgattctctccagtgcctcttttagtgatatgaagttaaaaccaagtattataattgctcacctgatttttggttcttatgaaggtgttttttggtggatgcttgttcaatttggtgttcctgtggagaagatgattgctagaggcttctattcagccatgttgctccacttccttgaaagctgacagtctttttatttttaatcaccttaccatttgtttattattatttttaaatgattggaataattgtacgtatttatcatgtacagctttatattttgaagttcatttacattgtgaaatggcaaaatctagctgattaacatatgtgttacctcacatagttatatttatggggtgagtacacttaacatccactccattagcatttttccagaatacagtatattgttatgaactatattcaccctatttacaatagatctcttaaactcattcctcctgtgtaactaattttctgtatcttttgaccaatatctccctaacctccccttccctgccatccacctcttgtaactaccactctattccctagttctgagatcaacatttttaggttgcacatgtcatcaagatcatgtggtatttgtgtttctatggatggcttatttcacttaacataatgtccttcaggttcatccattgtcacaaattgtagggtttttttttaagactgactagtattctattgtgtatatatgccacattttctttatccattaatccactgatagacacttaggttgatttcataccctggctatattgtgaataatgtggcaataaatataggagtgaacatattttttcactgttggtaggagtaatgaattatatggtagttctgttttttacttatttgaggaatctacacctcattttccacaatggctgtattaatttacattcccaacaacaatgtgcaaaggtccctttttctccatagcatcaccaacacttgttatcttttattattttcatgataactcttgtatcacttgtgaggtgatatttcattgtggtttaattttgcatttcagtaataattagttgtattgtgtatttttttatatcctgcttgatagttttcacgtgatattttcatggtgtcttctcaaatttcttttgcaatctgtatatattcaatatgttatcagtcaattttgagtgaaaataataattaatctctacttaatcagtaaaatcaacttttattttctttatctaaatatgaagtgtcttaaaattacagaacatatgtaatttgtatactctattttgcatttattttataacaagacaattaactgaacctgagtcaaggcacatagcaatatactgtacatctcagattttattaaattcagtaaactcattttaatatcattatggaaagaactgagaaacaaaagaaaaccactgaaaatatttaaagtatgttggctaagagtgtatattttaaaggtctcgctacaaaaaataagtgaggtgacaagtatgttaattaacttgatttaatcagcccacattgcctacctatatcaaaacatcacattgtaccccataaatgtgtatagttatgatgttaattaaaatattaataaaaactttgtaatagagctgatattgaatttgagcatgcttgatttagactttaaaataatatccattttgtcattttatgcagccattgactttccaactacttccatcgatgtcttcagttttttatcctgtctgtaatgcctatagtctaataagtctttattcctaagaagaacacttgaatacttgggcaggggtcatttgaggaatactgaggctattttgtacaatgaaacagggttgtgatctgaagataatactttcctgaaatacattgaaaaaatatccaaatgatggcaacatccctggatcaactggtacatgtgtcttatttcttcttagcaaaatgcttattgattattaagaacattaagtctgaggtaaaatgatcctgcagtggaaatcaatctctgcaatatattagtttcattaaatacaaaataatattaattgtagacctcagttcatatgagttttagagatataggatatcccaatcagataagcagtggagcacggtaagtcataaactgtgggctcaaaccttggcactgccatttcagatcttaataatgaccttgggtatgattttgaaggattctgtcttcattttcttatttataaaatgagagaaataattgtacctatacctcataagatttaaaaaaataaaatgagttaacataagtaaagtgcttagaataataagcactctgtaaatgttgggtacaaatattagcattatatctgtcacctaataagcaccaaaaaaaattagttatccttagtgagttttctgtctacagtcaatgacatcttaaaacaatcaactatacctaaaagggctgaaatgaaacagcttcttttcttatcagaccttacctttagagttacttgtctgctatggtctgttctgataacttcatctgacttcttgttcatcaagtctagacagtttcttctggattttaactgtggtgcatgaacttaagatcttgcctagaaagtaaatgatttatttatatatgaatatttctactatttactagtttgtgttacttaatctctccaagatcgctcctggtaagaagcctcccaataaacattacaaaaatagtttgcatttatgtagaccttatctatatttatcaagtgcttctctattcatgaggtgaggtcagtaaggtagactgttttcgaagtcatggtttgtgataaaattttatattattacttgatggataggcttatcaaagtttcttgtagtaatgatgaaaatataaaagtataaggaaacataacctgagaaggctatgttttgaggctatctgtgaaggttgagaaagtgttttcattgtcttgcaattttccaaattataaaatgtaagttcagtgaaattcagtggtaaactcaaaagaggcagagatgaattttggatacatgtctgctcacttgggcttgttattctgcagtgctcatatttgtcctaggtccttggatatctctgctctgatgagataagcataggagtgaagtgtcaggcccaataatgcacatgcttataactgattcccaaatttgtgggtaaataagttcgattcaagattctgggtgtactttgaaaatttgaattaagtttcatggaaaggaaaccataaaagaaataatggttactgataaaagaaaattcacaactcatttatataacactttgcagtttataaatcagtttctcaaccatcatctgaattgaatgtgtttctttacatagctatgaaagttgcattatttagaagtcaaaacatttcaaaatacttgaaggtttatagttaacatgattaataggtactgtaatgggaaaatatttattcatgcatgttttagttcattattgatactgttcacagaggagagaaagtagaaactacttggaatgatagcctaatattggagcacatgaaactggaagaatccttctagatacccattcacttagcctttttccatgtatttgatgttttgaatgtggaagggtcaagtatgaattggcagggggtgggaaggaatatggaaagatgacaggagggaagcaagaagttactgatggagtagtgctgtgtattctgaaggtggggcttaagaaaaaaagtttatcattcttttcccttttctactccacagtctcttgacattcaaaagagtatgtcaccaatgattctttcttgtgatgtacattctcaaactttgactcactgtgactagcacagcccttaacctagagagtgttaattgtcattattctgggcaatgagggaaatcatattagctattttatcatagaattagtggagaaaggggtcttttaaatgtcacctttctccctgaacacattctcttcagttcttttcttctctcttttcttccatctttcttgacctctgcttcacacgtattctatttctttatgatcaaaattaagggggacatttagttgaagtgcacgactctgaaaataatttgctcatccttgacatctttcttacacatttgcaatggttttaatatttcacgctcactgcatttgatcctcacttccaaatatatgttatggcatcattactatgcatttattaattcattttatctttattactactttgttttcatttctattgacatgaattttatgacacatttagttacttgttagtagtaccatgttagtagtagtggataactgaagaagtgttggagttaggctcatgacgactaagaaaaatccattaagactaagtttccttatattaagctaagcagcaagaacatagaggccatctctctgctgacggaaaactggactataaaatgctattaatctgtcattagcctttgtagcctgttgcaatgacagagatgcctagctattaccgaggggcatgaactgtgttgttcatggtgaataagctgaccatgggcaagaggtcagcaaggggttttgtagttcaagtaagcataaggagaagctatcatcagtaatattagcatcttgttggttatattaaatgactggatttaatgcaataaaaagtcaaattcaatgtatcaaactcattccagagaaacaaatgttaatacctcttagaaaattattttaattgcaaaataatacatgcctatttaaaaactgaatattatcaagtttataacagggatttttctctttctctcacccattttcactccacagaggtaactacagttatcaatttcataattatttttctagatattttatgtgcgttcataaacatatatatataagtttagtacactcccatgtcagtatatatatatatatatatgggagtgtactaaacttactaatacgcaaacttgctttttttcactaaacatcttatgggtattttttatgtatgcgcacatatatttacctgtttcactttaattattcttcccattgattcatttaatcaatatgctattgatgaacatgtaaataacctagcttttattgctattatttaaagatgcaataaacatcgttctacaactacttattttaattctgtgcatttacctgtaggatgaattcagataaggggaacttgcggtataagggtaattaccaatatcttaaatatgtccatgactccttgagacattattctggagtttaatttgtgaagcagaagcacacaataactggtatttttataatgaaggtaatttatttagcaccatagccagaccaaacttgcaccaaaaatggtttgcttctgtttcctcctggaggtaagaagttccacagatcttacattttgattctttcctctgtgatactaacaggaaacagtgtgtccatccaggccatgtatatcttaaattttcaactatccaagaagatgagtcgtcagcaaatgtggtagctacagtcttttttcctcactcaacaaagtcctagaagcttgtatctttgcagctttgtgaatcgtttgaaaactatggtatccaggtcatctttttcacagactttataccatgaacagtggatgtttttcttacaagaagtcattttacccattgcaattattggttttattttgtctttcagggctggaggtggactttatggtattgacagcatgccggatcttcgcagaaaaaaaactttgcctattgtccgagatgtggtaagttacaactgtttaattctcttcgattgcatgtgtggtttttttccttactaaaatgtaatgtccttctcattcactgtctagcctgtaaatattccatggaataaaaatatatgaggccagatgctacctgctgttatatttattattatttctttaaaatctattagatggaggagataactcaaacctttgatagcttttgatataagtggaaattacaattaagtgactatgaccctaataattggagcaaaaagaaatcacacagcataccaagcaagtgaataggctttgatgtgtttagtgttatgaatgaccagaagtttaattcacaatgcttgaggctttatttaaacttcttcaccttaatacagtggacctgaatactttatacagcaagcagataacattaatcaactcttcattttattatattaaagtcaattctagctaaattaataagctcttctatttaaagaaaatcatggttcactttgggaggccgaggcgggcggatcatgaggtcaggagatcaagaccatcctggctaacatggtgaaacgctgtctctactaaaaatacaaaaaattaactggagtggttgtgggcacctgtagtcccagctactctggaggctgaggcaggagaatggcgtgaacccgggaggcggagcttgcgtgagccgagattgcgccactgcactccagcctgcgtgacagagcgagactccgtctcaaaaataaaaataaaaataataaaaaagaagagaaaaccatggttttcaagttattaacatcattattacttctgatcatgactctgaataaatctgtttcctatattgaaatatgctgcagccaccttgataaatgcaaaaaattgaccatggcctacattagattgtaaaaaaaaaaaaatcatcgtgaaaaagtgtctcttctatcatccaaaatatcttcacattttatgggcatatttttaatattatatgtgatatgaaaaatatattttcccccataaaaagtaaattttctttcagcaacaacgtacataactttttacatcagtaatttttaattttgctaagaaagccttcatctgaaggccaccactttggttttaaaatatgatcctgactgaaaagatcttatactggaaagtataacatgtcagtacatttagttcaaatttctgtcttcactatgtggaaataattgtaaagtgttaggctaatttaacattgttatactcttttcctacctttcatgtatctaattatttacattttgtttcctctcacttctggaatcttcaggccatggtaagtgctttgctatttatttaattaatattttgcagtcttctcaaacatacactgcacttactcatggggtaaaagagggcaagaatggagaaatgaaaagacagacatacaagaataagaagtttgttctgcaagaatttaacctctggttcaattctgaaagagaaaattatgtatgcaacaggtgcaaacacagaccaaaataggatacaagtatagttttagggaatatatttttcaaagatgaaacattttcttgggtaaactcttggaggtaagtcttcaaggtaaatgtggagatgagtggagagtgacattcttactcaggtgtatgctgaattttatttgagttaatgactttgtaatgctgaggagatatgtatatgaccagatgggtctcaggtgatcaagaatgcattattccacaatgacatccctttgctcctaatgggataacagttttactgttcccatatggaggttctgatttccaacgttctccatagcactgctgagtttcttgtatttcatatattttgggtaggagtagatagtggtggttatggttctattttatgtggtgaggaaactaaagggacttgactcttatttaagatcactcaagttaccagcatcgagtgaagaaaatgaatctggatataacaattctcggtaaattaaatgaacacttagaaaaaatatcttgaatagatatggaagaatattctagggaactatgaacaactcaggaaccatctaatactaattatgattcagggccatcaccaaagtcaggctggctctctaccaaaggttatgtattctgaatgaatatatcacaaccaccttgaggaataagaaagtttgagaagcctcttgctagcctgaggtggttgagggggctggtcatcttaagactggtcatcttgcctttctgggcctcagtttcatcatctataaaatgtaggggttgggtttgatgagttgtgggatcgttccagttttaatattgtataagtccatattctgggtgaatcggctgattaccaaaatggcaggtccttactaactaaaatatgaacagtgatagcccatattcttgcattttcaccttctgctgagcagtatatgcacgtcaacctccctatgtattaataagtcataattctgtttgttttagaccctggctgcccggaaatctggactctccctggctatggtgattaggacatccctaaataatgaggaactggtaagtactagatattgctcataatatctaactagatattgctcataatcacaagggagaaactgttctgcttgagctactcatctgtgatgtttagtccaatgttccagaaataactgggagcatgaggaaagcctgactccaaacaaacttcctcagggactcagccaatcattgtcttctcctcaaatacttataaaccttcctatctttacaaatgctgttcaattctaacatagcttccctgttattctccctgtggaaaagtcctactgattttttacatagtttaagttttgcctcttttacgaggttttccccaaacatcttccatcttcctccccttccagctgaatgattaatttcctcctcaggacttttataggttttttttttttttttttgagacagaatctcactctgttgcaggctgcagtgcagtggcacgatctcggctcactgcaacctccacctcctgggttcaagcaattctcctgcctcagcctccctagtagctgggactacaggtgcttgccaccatgcccagctaatttttgtatttttagtagagatggggtttcaccatgttggccaggatggtctccatctcttgatctcatgatctgcctgccttggcctcccaaagtgctgggattacaggtgtgagccaccacacccggcccttttatagcatttattcataacctccatagggtcatatgattacgagtgaagttggcttggtatgagtcccatctgtgccacttaactagaattattatatcccacaggttatgttacttcttcaagcctgagttctctcatctacaaagagaggtgacaaggaaactgagaggattaggaagtagatacatgcttaacattcagcatagcttaggttataataagcaatacatacaagcttctgttttattatttttattacaattattttgattattttgcatacaccttttcttttaaactctgatatccttgagggtggcactataacttgtttgttgttcttgttgaatgattctaccactatggcttagcacactgtctggcatgaggtggatgtttgtaaattctgattgaatgaaagaaccacactgataagaagatacaagtaggctgtaattatttaggtcagggattcttaaatccggctcactggaactcttgagggagctttaaaacatacagtgatggggtctcattctcagccactctgatttaattggcttcaggtgtagtttgggtgaaagcgatttttaaaaaaaattcttgtgtttggtgcctggcatgttctgttccggtaaatgtgtcttgcacattctgctggggatttacttgagacagtttatctgtgtccctccctatgcctggagactaatatatcctacctccccaattttagcaactttgtcattcttgtagaataaaaattctgccacaaatattatattacccattttaactttctgtaacttaacatttaaacaccatttttatgtctatatttctcattcccttccttcttctttctgtcattgtcatctttcatccaaatgtcaatctttcctgggtttttccatcagcaagctcccctacccagtacatatcagtaaaacaaaacatattcgtttgactatgtggaggctacaacaagttgatacattttctattgtgccacaggagaaaaaatgtaattgcattctcagagtattattctttctttctctctttcactctttttgtttatttattttttgcagacagagtctggctctgtcatccaagctggagtgcagtggtagggtcatagctcactgcagcctcaaccttcagagctcacatgatcctctggcctctgccttctgggtagttgaggctaaaggcatatgccaccacactcagctaatatttccttttttttttagagacagggtctcactctgttgcccaggctggtctcaaactcctgggctcaagcagttcttccacctcagcctcccaaagtgctgggattaaaggtgtgagccaccatggcccccacctccttattcttatctgttagatttatgatgccatgtaatattttgagtatagtttgggcacaagacaaagcagacatcctctggtgtaggagaaagctgcatattgcttgctgaatctcaaagcatctagtcttcttttgagtaaataataaagtctgaagaattttattgataaactcctacactgtacctttcttatgttttaaaacatggtatttgatttgaactatgaataccaattcatttgacaagttaacaggaaagcatagaaattagtggaatgctagtgtattttctgagtcctggacagggaacatatcctcgctttaaggttaaattagctattgatctgcttttcaacaacttaaaaatatcacctttactcctttagtttcagaaggcttcagtaaaaaaaaactgtgttggtgttgaatggatgaacagaatccatcagttatgtctcagattcgtaaagcccatttccctgggactcatgcctcaaaaagtaaatgaactatgacttctgtacaacaggcatattaaatgtcactattgacgagctgtcgcattcagtcattacacaggcaactaacataaatgctggagcaaataatttgcacttcttggtgctgaaaatctttctaggcacacttgatacaaaagcataaaatatttgcttttatgtgaagggaaatggcttggtgatgtggaaaatatcaaatggtaccacttctattttaattaaagaaatgtacactttgaagctcagtcatcttttccaaggacagaacagacactaatgcctgatgcaggatgacagtgggtcacctagcactgcctccttcactaacgctctgctggccatgggtgaagcatcgccagtgcccccatccatcaccaactccaccttacccatgaggcgctattaggactgattgagaatctcagcttaataagctgttaaggattatgatttctgaaaatttccatctagcttagtaacatagggaggaccaaccaatctagcatctaaataccatagcagtagtctccctagcactccgctatccatctctgttttagtttcacagactgataatttcttaggtgtgaatctgacagtggggcaatcaaagtatatccattcggtaattcaatacatgcttattgactatctgctatgtgtcaggtgttgtttcagactggaaataaagtagcgaacaactcagccaaaaatctctactttcatgaggcttaccatacagtgggagggggattgagatacttaattttgtatccactcttgctgcaagtcacatggaagcttctagtaggcaagatcgtttaaaccaagatagtctcagatgaggtttatgggaaaccaggtagagggagaaatgaaaatgactaagcataagagggatcctagagccctgttggttctgtctgggttgatgggcatgttaaggctggcaggcttctaggaagtgttcattctcagtaaggggaagtttgtctaggattcagacttcgtgaaagggactgaaaagaactagatgtggaggtaatcaggagatcaaaccggagccctatttctagtatgacactagaaagataacatggaaggagaaaactgctcagaacacctctctgagacttcaacttcaaccagagctgtaggcttacagcacacccaggtacttcagacccctgctcaggaacaggaacactttcaggccacctggataagttttgaagtgaaaggggcctgaattagaatctcaactccacctctcactagctttgactacttgtttcttctcaatattcttcaccttcctgagataactttgcttcatcaataaaatgaaagtaataatagttacctcacagtttgtgagaattaaaagaaatagcttatgtagaaagctctttgtttagtcaaacccttcccattcccccttttctctttatacagtggccggcatggcaggtggccatcagcgcagtagggcaggaacttgtgatcggggctgcagaatacatgctgagtctaatgcctccctgccctctttgcacctgagggtaattttcctttccaggaagtactgacatggaagccagcaataatgacaccaaagtaaagattatctcttgtctgcaagtattgctgttggttctgttattcttcataagcacggactttgacttgagatccatgttggtccagttctacaatttaccttctgtagggcctagggcaagttatggaaactttcatgtccttgattttcttatatgtttactaattatatcatatttttgcatctactttgcatcataaggtaaaaatgactatgtttttctgtgttcttgaacaattttggcatcattattaaactagcttaataagataagtgaggaagatttcctttttttccttctctgggatggtttctataaaataagttctgtatcttgaaggactggcaaaacttgtcctccaaaaccacctgaatatggtacttattttgagagtaattttttgactgttgaatcaacttatttaatatagtgattatgttccctaagcattcattcttgagttagtctagacaatttatattttttcagcaagttgtcttgtttttctaaatttttgaatttaataccatcaaattgtttatataattatatcatggtttatacaaaaatgtgtgccattttatcctattattatttatgtgtattttctctctcttttgtaaaattaaaactgcaggaaatttctctggctttgctttgttgactccatattatctccttgttttctatttcatttatttatgctcttgtcatttttagatttttttattctttgttttcactctgaaactacttttctaagttatagagttgaacatatagttattgattttaatggttcttattaactattgcatatacacaaagtaatatttacaacataagtgaataatagtaataataataatctaaccatgtatccatttttgatgcataagtacatactaaaagttagttaattttgtgattaacaatttttcaccacacaattttccatggttccctgactgactttgattggttacataaaaggacagttacatgggatctatttataggaatggtcagccccctcctcacctttgttttataaaatccgaaacattcttctcttttttttccgtcaacttttattttgagttctgggatacatgtgcaggatgtgcttgttacacaggtaaatgtgtgccatggtggtttgctgcccagatcaacccatcaccttggtattaagcccagcatctattacctattcttcctgatgctctccctcctcccacccccaccccgacaggccccattgtgtgttattccccgccgcatgtccacgtgttctcatccttcagctcccactaataagtgagaacatatggggcttggttttctgttcctgtattagtttgctgaggatggtggcttccagctccatccatgtccctacaaaggacatgatctaattccttttttatggctgcatagtatttcatggtgtatatgtagcacattttctttatccagtctatcattgatggacatttgggttgattccatgtctttactattgtgaacagtgctgcaatgaacatctgcatgcatgtatctttacaacagaatgatttacattcctttgggtatatacccagtaatgggattgctgggtcaagtggtatttctgcctctagatctttgaggaatctgtcttctactatgattgagctaatttaattcccaccaacagtgtaaagcattcctttttttctgcaaccatgccagcatctgttgttttttgactttttgataatcaccattctgactggcatgagaaagcatctaattgtggttttgatttgcatttctctaatgatcagtgatgttgagcttcttttcatgtttttttgactgcatgaatgtcttcttttgagaaatttatgttcaagtcctttgcccactttttaatgagattgtttattttttttcttgtaaatttgtttaagttccttatagatcttggatattagacctttgtcagacagatagattgcaaaaattttcttccattctgtaggttgcctgttcactcttattttagtttcttttgctgcatagaagctatttagttaaattatatcccatttgtcaatttctgcttttgttgcaattgcttttggcgtttttgtcatgaaatctttgcccatcactgtgtcctgaatggtactgcctagattttcttctagagtgtttatagttttggggttttatattcaagtctttaatccatcttgagttaatttttgtatatgatgtaagcaagtggtccactttcagttttctgcatatggctagccagttctctagcaccatttattaaatagggaatcctttcctcattgcctgtttttgtcaggttttgtcagatggttgaaggtgcatggtcttgtttcttatttctctattccatttcattagtctatgtgtctgttcttataccagtaccgtgctgttttggctaccgtagccttgtactatagttcgaaggtgggtaaggtgatgcctacaactttgttatttttacttaggattgtcttggttattcaggctctttttggttccatacaaatttttaaaaagtttcttctaattctgtggaaaatattcatggtagtttaaagggagtggcattgaatctataaattactttgggcagtatggccattttcacaatattgattcttcctatccatgaacatggaatgttttttgatttgtttgtttcctctctaatttccttgagcagtagtttgtagttctccttgaagaggtctttcacttcttttgttagttgtatcgctaggtattttattctttttgtagcaattgtgaatgggagtctgttcacaatttggctctctgcctacctgttgtttgcgtatagagatgctactcattttttgcacattgattttgtatcctcagactttgctgaatttgcttaaaagcttactcttttggactgagacatggaattttctaaatataggattatgtcctctgcaaaaataatttgacttcctctcttcctatttgaatacactttatttctttctcttgcccaattgccctagccggaactttcaatactatgttgaataggagtggtaacagagggcatccttgtcttatgctggttttagactcataagaatgcagtctccaccccaagcagtaaatcttagactttccacattaaaatggctaaagtttcccccagtgtagaaatccatagtatttttagtttcatgtatttatcaaattaattatctcataccactctcatcacttgtatacatttttattgaaagtttgaattgggaaaaaagaacatttatagtgcataaaatctatcatattttgttttcagattatgttctgtgtcataacaaagggcttatgttatattgtgctctccttgaattaaggaatcatctacgttattgttctgccctctttatttggactcaccccataagtttcttaggacaatgttaatttatatctgttataaagcaatagaagtgaaagaaaactacttacattctcacatagataggatataacttttagtctttgtttgtactttctgctacaaaaaaatcacctgaataattttagctcctatagtcaatcagttttataggatgattacttagatgagcaaatcagcactgaaattatgtctgtttttatagtcaggattttatcctagcattgctctgtcttcatgtttataacaaatttcaaaaagatcatattatacctaatgtttggtctgcaaaaattctgatgtttttgtccagaaaaaataacacttatacttcaccgaagagtagatatatttttttctggaaagcgtacatcaagtatatgaaaaatggctcaaaacaagaagcatttttttttcttgaaagtatcaaaatgtgatatttgggggtataggaaaggtgtggcttacataatatcacaaggaggattatttcctccacaggatgaggagggaaatagaacttcataggttagtcactggttaaaacagaaaggaaaaaggagagaaacaatgtggcaaatggaggcagacaagctttgttcatgttataattattaacagttggtagattagaatattgatggtctgaaaacactagtcattgctcttggcaggtagcctgattcctttaaatctcaggctctttttagtttcttcaggtagtaatcaatagaaaaggcaattcatttccttccagtgtcctaattgttccaaaagtgacatattagtgcaacttactttaaattcaatttttggagaagaaagttctaacaaaatatttctctagggtgtgagcatcctccccagtgtagtctatatgttgtgcttgcctacaaaggcttatcagaatgtgaaaacattccttactcatttctacaggtaaacaagatgtctataacagcaaaaaaaattgccttcttttttggaatgacttaagcaatgtgaaaataatgtttttttttttttctaattgcaagagtattacgtcctgtctatacataaaaaagaatatgggaaggatatgtatcaaataatgcctaactttaaaaagctaaattgaatatttttattatttatatcagtgcctttgtgttttataaattatttttacaatgagcatgcactttattataatcttaaaatacatattttttagaaaatacatttttattgtagaagatttgcaaagttgtagaagatttgtaaagtttagaaacatttaaaatagactagcagctgatgagaacacatggacacctagaggggaacaacacacactgtggcctatcggagggtgggggtgggaggagggaaagcagcagggagaatagctaatggatgctgggcttaatacctgggtggtgggatgatctgtgcaacaaaccaccatggcacatgtttacttatgtaacctgcgcatcctgcacatgtacccttgtacttaaaataaaatttggaaatttaaaaagttaaatagataagcagcaagtcactcattttgccaaatcctgctgtccttgggtcctaattctattaattaggttttgcttgttctaggaatctccatgtgtctgattccaagttgtttacctaggccagagaccctctcttgataacatactcagttccatccttctccttcagctcttatttacagctgattattaatctgcctgcccttagtgttacttttctgtttaatggcttttcatcccttcaatctgattcctaatggtaaactatagactttcatttgcttccatcaatagcaaattttggggtttccccttattttcccctgccatgcttttatttaatgcttctcgctcttttcaccttattccacacaaaaacccacactttttccctcttatagtcttatttcatcttgcctgattttgctgctgagaaaacatcttgctccaagatgcattatccccctgaaatacaagaatcctctattatgagattatttttatatgcttttcctacctattaatttcatgttcctaaactatcaactcaacatatactttgctgaaaaaagagtgttttcgtatggcatttatttcagagtaattttcagctttgataaatacatgcccatacccccgaaagtcaagaatgaaaaggactcatcatttccctaaaatgatgagatcttattaaaggggatatataccctctagtaggttgtctaatgttttaatgtttttctctaactttaatagctcttaaatattgggatttgtttcagtgccccattcaattgcttttcaatgggctgtctagtaaatgtttcatgttttttttttttatttttggaaattagctttactctccctttacatgaaatgaattatggctccttagccaaaccaaacaaaacattttaatgaaatctgctcagctgtttattcagagcttttacttgttttcctgcagtatgcttaattttttagcagagttacttatttttattactcctactataatctatggacttagagtactgactatcacttgacttcagtaaaaggaaagtggacatagggaattagatcatatatattaatcatttacttaatcttgaaatatgtgaataagttcatgttcaaaaacaaccttattcccaactctactttctaaatttatgtaaggtacattacttacttttcttcctttcattagcagattctgttttattcccactcagtattccatgtaattagaatattttattattctatttttattattttattgccattaaaacaaacgagttgcctgatgcaattgcaagtatataaattagttcccttcctaatttttcttctagaccacaaatgctacattacgcacacaaacacacacacagcccctcagcccagttagaacgggagactctgtctgtgggtagctaatgaaaaatctgttatgccaaggattatttcatttattttaatgatagtgaagatactcactatgctagatattaaagaggaggcaaaggtgaataatacatgcttctaattctcaaagaactcttaacagttctttataagacatctttattatgaaatgaagccaggagatttacttgcttcagacactctttattgagccaggagatttacttgcttcagacactctttattgaaaagtgatggatccagtttttctatctgaataaaccctaatattaggatcttccacttgagtgatgcccgaatttgaccatactgctgctctgtagactcacttgaagtataaagagctctggattgtccagccccttatctaatagcaaggatggatctagccattcaaaattagaaacatttttactgaggctccgttccctggtaggggacctcctagtaccattaccaaacatattctgggaaaacacagagtgagaggaatgtagtaataaagggaaatatgctgttaccatactgtggaattgaaagttagtcatttcaacactgtgggaaaatattctgaaatgagatttaaggataattaattcaaaatataaatgcttcccttctagtatgacttaccagctagactcttcctacagggtttatgtaaatatccattcattatgcatcaggcagttgtgtgaaattatctgtaaatgtaacctctaagagtgctggtctttctctcaggaagtcacctgctttgtgggatatgagaagcatagaaaaggactcatttaaccaattctcttttctattggcctgtgtttattgttgttggtggtttgtttttttttttacatccagcatcaatactaatactaagtgcttatttggtgttttgaagcctgtagactacttctgttatcattatataatttgatcttcaaagtaataccattttaagcagagcagaggaggagggtgagtcttagagcccttacatttctccgtagattacaagattcataagtggcagaacgtttattcattaaaagaaatgtacctctactatgttccagggacagtgataagctgttcaggcactaagaagaaaaacatggaagacagttcctgcttatagaggccccttttaaatatcatgtagttgggcctaggagaactcagatctcctacctacttgttcaatagattttttttcacctcactaatgacttgtcattaaagagtccttccatatgctattagaaattatttccttttaaaatataaatcaccatgggagagtgcctcatttgaccttatctactactgatgctttcttatgaattaggtgataagatccttccccggtgataggtactgaaagcaaatttcctgcagattgaattacagaagtattccttggggctgaggaggggtgaagtgtcagggaggacaagggggtcaggaaataacggcctgggtagaaagtaaaagaggcgttgggtttacagcatagcagggacttagacattctcaactaattagacctgtgtgctgctgggaaagaagctgcagacagtgaagcccagtccagtctggaagattagggagttctttgtgtacagataactgaatagggccctaaaacattgagagaagaataggttagcagagttattatgcttactgtcatcatgacttgaatcagtgatccaggggctctctcaaaataccattttcagagaaaagtgataaaatggtttgttttattttgaaacaattcaaatccactgacttggcggtgcattggtaacttctctcatgttcacagaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagtgagtacttggtttggctgaaaaagtggtatgcagagcctgccttattccatctgtttcatgttagatcacttcaactcttgctggttgtcaagaaatcctacccgctcccctcccaccacttacacaaagatacacatactgtccatcaaatcacagttgatgatgcattcttacagtgtggagctaggtgctattagaatcctcagggtgagtacctggagtgaaattgcactctcatccagcataaaccttcaaagtgacttcctatctattttcttttttgtcttttctttctttctttctttttttttttttttttttttttttgagatggagtctcactctgtcgccccagctggggtgcagtggcacgatctcaactcactgcaagctctgcctcctgggttcacgccattctccggcctcagcctcccaagtagctgggactacaggcacatgccaccaagcctggctaattttttgtatttttagtagagacggggtttcatcctgttagccaggatggtctccatctcctgacctcatgatctgcccacctcagcctcccaaagtgttgggattacataggcgtgagccaccgcgcccggcccctatctattttcttactcatacatcataatagttccatgaggtaagtgggaatatgtaaaatcaggttccccaaacagggatcaagatatgcttctgcatttacagcaactggaattcttttttcgagcctatctggtgcctgcctggcaggatccatgtccttctacagttcctgcacaggccttggaaatgggatgtcttgggtttgaatgtcaacaacatatgtaacttaccagatatgtgactttgagaaaatattttaacttcttgaggctttatttttctccactctatgggcaggaataacaaaatttaccttagagggttattggaaaggctaaatgtaatagtctctgctaagagcctggcacacggtagatgctccataaatattaatgacctttccatcctttcacactcttgaatgagtacatgccactttggtttttatgacaagttaccttaaatttttcatttccaaaaaaatcctttatttgttactttaggtctagaaatgctaatgcatcacattgtaaaatacacataattgacttttcactactttatttatttggtagtgtcacttaaaaattgccaaaaagttatatttcaacatgatgttcatttgcaaatcatattttttcacatctaaatattgtgccctctgtttgttgtttatagggatgtagtcaatgtaagatatgtggattgcttgacactgaagggagaagaggaaaatgtcaaagattaaattagaaatgctgtcacagctgacttgttgtagtcacgatcacatacattcttaagttttctctatctgattagtattctccatacaagattagatcagattgaggctgtgttaatggtaacaagtgcattctttaagcaaaagaagtggtattctttatttgaaaaataagaagtatagttaagaataattattttaaaggaagggggattgacttgatattactcatttaatttacatgcaaaatctcataatctgattaaaattcagcccaactgtttaaaaagtgaattgcgtataggcatcttaagaaataagcatattagggcaatgacatttaagaaaatagaaaacacactgtcatctaagaacaaatggcttaaattccttagagaaaaaaatgatgccactcatacctacgaaatgaattcttcttctagtctttcagaaaggacagatgctacccattcgttaaactgtagaaacatgttcataatctatttccatttcttaaaacaacatttattattttatatttgttaaataaattatgcaatccaaaattttcattgatgttattcattaaaatgcacacataaattggaagaatcaaaaatagtgcagaacaatgaaggtgggtatgcatgccccagggagggtttttataaatccatttttacttttttcctaaaattgacactctcatattgatcagaaagaggtcctacaagtatgtatacttaacttcataactttccatgataactatcaataaaatttgaaattctccctacagaatcagtgacattaccttaagaaattgatcttcttcattgttttaagccaaaaaaatggcaatggtgacactatatatgagataatttcatgaatgccaacactgaagaaaaggaaagaataaaaagctaagaaaatcagagttagaaggtatagctaattcagccccctttaaatgtaagacagttctatgattttctttataaaatggccattcaatctcgtaacatttccagggaaaatttcaacccttggtaggcagtttaactcatgactttagaatgctagttcataaattaaaatttaagccaaggagtctttccttgtaatttctacccattacgccatatcttacttctggtgaaaatatttaatgaattctattaaatatgacagtttttcaagtacttaaattaattatctagttttctataggtttctagtactctttattttgctaattcttttctgagtaattacagtctatcaacacacacatgctaaaagaaattaaattctctacatgtggtctgaccaatggcccatgcaaaagagagagtatgtcaagttacttcaaattgatttaagttaggtgtttccttaccatgaagtcttgggtttgtgacttgtgcaccttcagtcaagtggaattagaccaggtgatggtgaaatccaactcactgctccagtgcttccttgtgggttcagagatgcatggaaatgtccagtcaattccccaaagagcttcatctaacaccctctctagctaattgtacttgatggtagttcatagattttaccaccttcttggcccaaaactcatagacacagggtggtaagaaggagaccaaatggaaacagggagaacaatgagaaaagagacctgatttatactccttcaataaaatcagtggcagcagccagagttcacctgctttttctttaattagttcatttgcgtctcgtcgcctaaaaagacatttagaattcttttttggaaaaagcatttggtggtgaaataatttaattataataaatggaggagcaggttgtgaccctgaattacgttaacataacgtgtaaggaacttgctgtagcacctcagtggtggttttaaactagaaaaaggccgtgttggctgggatgagggttgtgtgcagagtgagtcatatgtaaaagagacatcatatgtaaaatattttccttgattatgttttcagtgtagaaaaaagacagctacagagattggaaaaaaatgcaaataatcatggcactttccttacacatctccaaagaaggaatcccagagtcttactgaataagcattctgcctacttttaattcctaactagaaatttcaagcacctgcataaggccagaaaatatttcacgaaacgctcagcaaagaagcattttgtgagatgtgttctttagttctacgtgctttctactgacattatgttgaacttatatgtcctaagacaagcaattaataaattcgtagcattaataaaacctgtttaacatactcttgtttgcaaattagatattgattctcctttctttgttgccctgttatcacattttgaaatcacattttaagacagtcaaatatttgcatatattgagcaactattgtgggtaggagttttattctgggctctcagagctgcaaagaaagtaagtggtatttttcctggactcaaccttattttctaatacataacttagatgaacagatgtgaacatgtatcttggaaagttttgacattttactctttcaataacaattttacaatatatgtttaagtaatgagtactcaggaaacttggaagtaggattccttttatccactgctacttaacacacatttaagcaaaggagctgcttagcaaatgtggttaaactaatgaatgaaggaacaagaactacaactagaaataacctgttgtggtttaaatatcatctttccatataggcatacgctattaaaggagcttcgagattagtgagttaggaaactcagtctactgctttggctgagttcagaagatttagtgtctcatcaaaaggatcaagcgaatagcgtaagcaggattagaactcaggtctctgaactcagcctggtgttctttcctaacttataaataagtttgcaaagtcaatcctagggggaagaaaaggaaagttactgcattttattttcagtgctgtctcactttttattatgggagaaagcacatagggtacccctgaatttgagacattctatgctgcctgctgtagcctccaagagttccccgccatgataactcctcaggacccgccatctacagccaaccgccaataaatcctcaatgctcctgaaataggaaaagttcccatgtcctccttgcagggcgtgtgatggggtgtagctcgcttcttcagtgccccgcttctcagacttctaggggagtatacagatgggtagggagccccacggcagtgtctagaggtgaatgtttatagctgaagccccagtaggcatatgttacagggtgctctttaagtttagcttcccgtaggtggcctgtgttagtcaactcaattagacccctcccttatcgcaaggacagagggctttctgtatcccagggttcttgctttggtgtactggaagaattggatcacaggtgggcttggagaatgagtgcaaggttttattgagtggaagtagctttcagcagatgggggagccagaggaaatggttttccctggagtcaggccgcttggaggcccaggctgtcctctgactgccctggccaaactccaccacgttctgttagttgatagtctgccgacgtgacgatttctgtcctgtgctcttccactcggcatgctcccattggtgtcctctcaacatccagccacttgtgtctttttctaccaatgtgttcgtctggatgtccagccgcctgtgtgttcctctgctgatgtgctcctctccacatcccgctgcctatgtgtttgctggctagagcattagggtttttataggcacaggatgggggcgtggcaggccagggtttcttgggaaatgcaacatttgggcaggaaaacaaaaatgcctgtcctcacttaggtccctgggcagaggcccaggcgtggagccctagccagagaccaagcccttccccttcaggcacttccctgacccccttccatatcgctaccacctctctcccagcatgttattgcattgacttttcaacaacactaaaagggaaatgaatgcaatggtcagttccttaacccaaaggaatagactaataatggagcattttcaggtgatggggttggctgctggagagagactaagaggatgaatatgctttgcataatgccgtagaggtattctatataacatactcaatggatatcaatgcatgttttttcatagtattgagctatttaaaaataatctgacttccagtcttattgcaactataatgtttttaaaacttccctgggcatcattttcctcatctgtgaaaacagttaataatacttgtcaatgacctccagctagagaccaccaggaacacacccgtagttttaaaaagtgtgttttattacttattactgtgagggagaacatacaccaggatgactatagggcatctcggcaagatcgtgctagaaaacagaggtgtactctggatggggtgttatgtggaagtgaggacaattctacgatattgtgtctgtaaacatctaatctagaaggaaggcaaagtagactgaagccacagctttacagtagtcccaccttattcgtggtttcactttccagtttcagtcctccgcagtatggtccaaaaatattaaatagaaaattctagaaataaacaatgtataaattttaagttgcacaccatttttagcagcatgatgaaatctgccatccttcttggaaggaaagtcatccctttgtcagtgtatccatgctatagatgttactcaccccatagtcacttagtagctttcttggtgatcagattaaaataaaataaaacaatgacaacgacaacaacaacgaaaacactatacaataaagatagagtttggtactatctgcggtttcaggtattcctgaaggctttggaatgcattccctgaggataaaagagaacaattatacttcctaaagcaacaacaaccactcatattaattaggaaagggaatatttgatattttgtggtttacgcagtgctatgtttttgtctatgcttaggaaaaataaggaagcggccttgtttgtcttactttaacactgttgcagggtgaccacgtctaagtttggcgctctttgaaattgtttacgtccaaggaaagaacaatgtagcctagctatgagtaccaggccagctctgaacaacactgtgaactagttgtgttagcaaagttcctagaagtcagagtctagttatgaaaaaatagaaataaatcttgttttgaaatttttggtgtttaattttcttttgctttgtatttttttgaaaagtatatgaagaaatttatgaaactaaatgtgatacaaagaaaaatatcttcctcctgccatcactctcttggtttcttctctttccttgcttagtaaaaatattttgaaaattgagcacattttgaatcataattaatttgttcccctaaacaatatagatagcttttgactctgtgatgactgggcaacctctagaaaatgctgatgagatgtagtacctttaacatactgttatgcgagcacattcctgattttgtattttcaaaacatgcttgttttcgaacttgttctaaaagtatgcatataccaataatgagatgattgaatatggtggggatggtacaggcagaagagaaaaaacagtttggcagttttttgtaggctcttggtgccaggcttcctgacactggtcattttagagaaggtggtagttccttggggagtgggctaccttcttgtattttcccactgtcagtgatagagttacctacaggctctcacctacaggaatgggagatgacgctatgttagatctgtgatcctccaattacctactgttaaatgtcagtcctttgttgtttgcgaaaaataaggagtgtgtggctttgattctacaagaaaaaggagcctgctaacttgaagactgggggagttgcaggtctgttccttgaaaagactgaaggcatgttaaaagaggagggttcgtattatcttggatataaaacatctaaaagaaatgggtagggaatggcaactgaatgtccacccacatgatttcatgggggcaaaaagcagagagacaatgaaagcaggcccacctacatgtttttactgggaaataaaagaaaagcagtaaagacccatttcccatgtcagagaggctcctggagaaagaaaggaatacaaaaatccctcaatatcagaccctctgaatgctttcaatggatgttaaccacccactttctttgggtccatcagtctcaaatgcaggtaaggctttatggatgtcaaaaaaataaataagttattttctctagtttttttaagctcaaatttcttttatctttaagcccttccttggccctcatctagcaaatagatatagagcatccagcatactgcagacaccgtccgcgtgagagttttccagttgtttcagaggtcaagtgattatgcagctcaaacccctaaaatttcttactaatgtgaaattattattatttttttgagacaaagtcccactctgtctcccaggttggagtacagtggcacaatctcggctcagtgcaaccttcacctgccgggttcaagccattctcctgcctcagcttcccaagtagctgggactacagatgtgcaccaccacatccggctaatttttttgtattttttttagtagagatggagttccaccatgttggccaggctggttacgaactcctgacctcaagtgatctgcctgcctcggcctccaaaagtgctgggattacagatgtgagccaccactcctggcctgaagttctttaataaatacctatatcttcacctttttgacatgctgaaatcactatacttattccattactattattaaagctatatgtgttatctcattgaatcctcatactgttaagggagacactactactattcctatctgtttttcagatgaagaagctaaagttgagagagataaactaacaagctcaagactaaaaggttaggatcttagtctgtttcagctgcataagaaagtaccataaattggggggcttataaacaacataaatttattacccacagttctgaaggtagaaagcccaagatgagggtttcagcacagtcagggcccatggagggcgatcttccaggttgcagactactgacttcctgctgcatcttcacatagtagaaggggcaagtgagctcccttgagcctataaggccactaatcccattcttgagggctctgctttcatgatctagctacttcccaaaggcctcatcttttaacattatcacatcggagattaggtttcaatatatgactttcaatgggatgcaaacattcagactacgccagttagttaagtggcagatcaggattcactcaagattttctcctctacccaagtgtattagtacattttcaggctgctgataaagacatacccaagacagggtaatttataaagaaaagaggtttaatggactcacaattccacatggctggtgaggcctaacagtcatggcggaaggcgaaaggcatgtcttacatggcatcaggccaagaaaaagaataagaagcaaatgaaaggggtttccccttataaaaccatcagatctcatgagacttattcactaccatgagaacagtgtggggcaactgctgccatgattcaattatctcccaccaggtacctcccacaatacgtgggaattatgggagctacaattcaagatcagatttgggcgaggacacagctaaaccatatcactgaagcattgataggtactgtgcacttttaccttatttaaaagtgatactctttatatatttcttccatttatagttggcattcatgttcttgctttatgctgactatgtaagtgcacgtggcatgtaggttaaccaaattctgttatctaatgatgggaatacagcctctgttttcaaagaattgcaaatccaaacccaagggccaggtgtattttgtcttttcataagatttattccacaggatatttatcattttatattcaatttattcctgtggttttttttttccagaattgtggccttagggcaggagtttgcaagaatttcataacacattaaattaacccagagccaaagtaaatatccaattatgccaatcattttatcttcggctcccccaagaagtatttcctctatttattgagtgtatgctagtttccaaacagtgtgtgagacacttggaatacacatttaataaaatttgggccttaagaggtagcataaggaatggacatatatgcaggtagctatgtcaatggtgattgttaaatatgaaagaattttgtgaggcatttgcttggaatcagctgttagaaatatttacaccacagaaatctgctaatactacaaatcaggtttgggtttttttgtttgtttctgtaggagaggagagaaaatgtgactgttgagtttaaaagacctctatttcctgttgagataagatcatatgctgagaatggagggtaatggaggtgaggtaggtgactttagagtagaaatgttttggaagagctgttgagaaaaatagcaaaaggaaagaactgagaagaaggaagaacactgaagttattatatacatatctatgtgtatacatagatatgtatacatatattctatatataataaacacacatatatgtatatgtatgtatattatgtatatatgtgtgtatgtatatgtatatacatacacacacctgtagttttcagtttttatatatataactttatatatgtatgttttatatataaagaagttatatatagtcatataatcaaaatatatatataactttatatatgttttatatataaagttacgtatataacaacttcaatattcttccttctatttttagattatatctataaattctataattatttgtagatactatctatagatacttcttcagaaaaaaaacacaaaaattgtaaattgccatataaagatggtaaaattgttaatttcacctgaagtttagatgttttgtctgataaaaattaaagaaaaatgagttctagttaattgtcccattaaattacgtagaagagaaccagtttgcccctctgtctaaggttgaattatggttgtgttgtccataattatattgtcttatctgtcaagtaattatttttaaaagtatcaatgatgcatttcatttggatattatactctataaagtgcttttagtttacattatctcttttgatctcatcaattgttgatctctggttggcatattactgtatttcaatgacactgctagaccttctaccacacgctttgaagaaagactcatgtaaaagcaaatttaaagttatctctgatgacttttagataaacaaataagcctgaagaaaaataacccaaagggctggaaattcatggcaaattgtaactatttaagaaagagtttcattagaaacataagatatgtgggtttgataaagcatagggcaatggaaagtacttgtaaatcagtgacaaaaatttattatgaatttgtctctatctctgagctaaacaatctaagatgaataattttcttctgatcaaaaatgcaaaagtagaaatttttgtttgtttgttttgttttgttttgttttgttttgttttgttttgagacggagtctcgctctgtcgcccaggctgcggtgcagtggcgccatctgggctcactgcaagctccgcctcccagattcacgccattctcctgcctcagcctctcgaggtagctgggactacaggcgcccaccactacgcctggctaatttttttgtatttttagtagagacagagtttcaccatgttagccagatggtcacaatctcctgaccttgtgatctgctggcctcggcctcccaaagtgctgggattacaggcttgagccaccgcgcccggccataagtagaaatttttaaaagctacatattttttttctagaaataacagagaaaatgcttaaacatatgtctctattaacctgctgtccaccgattggcaatttcagtttattgctcttgtctgtacatattagaatagatattctataataacagcaataatacataagaataagtgaaatttgaaagctaatgctcaagctttcctaattatttttttaataacaagaggcagtcgttaaggacagaagtctgattcctttagatgaaaaatctctttatattctagctttgaatttggcagctattgtttgagcatttattgtgtgcatggtagttagatgggctcttcctgaatttagaaaaataatccaaagtatatttaactctccatgactttagcactccttcctagagcctttgagagcattaatagcaaaaataagaatagctgtttggaaatttgggagagagtcaacatttttatgacatttctaacctttaggacattccttgcctggctgtcacagaccaaacttttgagtcactttgtgtcttgcagggaacattttccagtcaccactgtcctttccatttagtgaatattaactacttgaataaaatatgcctatcagatagtttcaactatttactccagcctaagctaattttactatttaagaattatggactgtgtaaaccaatattgataaattaaaaacatattaattgcatgcaatttacaaatttgtagctattctagggacatgtttcaacagtgtagaccatttacaatgtccttttaaatcatctttagtggaattcattcttttttttgtcttccttttttttaaatgtcgtttaggtcctcaaagtttaaaataaaagataaagacaggtagactgctctttctaccactggaatattcatatcttttagcttcctctattcacactcattattaggaatatatttttccactctaggaaacaggtattacactttcaaataaatgaacatttacattaaattattgctgtcaaattgtatatgaatttatcataagtaaagttaatagttgacctttcatctcttgtcttactttctatacttaaattgggctcaacattcacaaattaggttcaaagaacattactgatattatcttttattgtagaaattgtgcttgcctataaattatcccatttaatctctaaatagtttatgagatattagtatgcctatctcagaaatataatagttcagaaaaaaatgagaatacaaattaggcaaacttacagtcatgtcaaagaaaattagagcaattactacctatgaacacaagtctttcgattattttcactgtatttcagttgcttctgtaccaaaaaaagtttgattttagcagtggcagttcctgtagacactggtacatgaccttttgctttcttactttaaactcactaaggaattgtggaaattgaaatcatggtccgttattaacttgtgtaatactgggcaacccagaaggccatacagaacaataagactatctagccagtagcttaaggttagggatccaataatggaattttagaaatctctcactgacagaatgatttgtgttacaaacaaaaatgcccagaaagttgagaccagtcatgaaaaacaatgtcccagaaataaaaaaagtttttagtggaaaatgagtattcagtcatttaaaagctctggatatattagagaaagagagttcgagtcggtgttctatcagttacattataggtcatttagtctagtagtgtccaaatcttctttaaacagctcaatcattttcttcccaagtaaaatcttacattctattttaatgtttagcaaataacagtgatgtgtttgaattattgctttccaagtgacatttgccacttatattctatctatttctcaattttattttggatacccattgaagaaatatgtgtggtatgtaacacatttgattgtgtctgttctgtttgctgcttttgaattctttttagaaaatttaaaccaaatttttgcacaacacctaatttagttcagtaatacaaaagaaaagcctgggaatcataggaggtcaatttacctgccaataacacaaaggagtactagttgttgtgaatctcagcatagcagttcattatgatatttttctaaaaagccacctgactccacagaatgaaagcactcattcattctcacttcctcctccttttcctccctcctttagccatcaaaaagtaatggcatttccattcacatcaccattgatgtttccatcataggagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacaggtaaaaataagtcttcttaaaaatttgtattgtaaattgagatttttatgtgccctagaaataactgctaataataattataggtaaaataaatggttattttttgaatcatgttaatatgaacaagactagttggtacttcacattttgaaaatacatactagataagtgaaataattttagtctgtgtcttgttctaatcaaaatttctttcataggaaaaagtttctgtttttcaatatattcacctgcagtgtacaagaaatgagcatttttgttgcctaccagtgataaattataacagtagctaataatctgttcagttaatctttttaaatgagaaaagcgatgttattttacttactcctggctcaacatccctcatccatttggtcctcgagtcaggacaatttgagtttaatgatatctagtaaattggacttctgaagttgcttgtaatgtcaacagcgagtgactgtgcagcctgttaacatttaccaagactcttcacttactcattttgtatttacaagataaagaaagatgctttctcaactatgtagagttgatcaatattgacggcagactcataaataaatcagtttggattacaggcctttgaattatgttgggtaatttttcatataagtgtaggtgtatcttcctcattcctctgtacatgtatgcagtaatgtgtatgagtatatagctaatatgtatatgcatgtgtatgtatatagctacttttcattaaagacaagggcaaaaattacagattttaatgttgtatatttatttttattaaatttttttaaagttctgtgagtcatgagaatgaaagcaatggggatgcatctataagcccaaagaaccaaatgacagaaaaattgtctttgttattattattttttgtttctgaggactctgtatgttaaaatgtttattttggtttatttcagtggtttctgcacagggtctacaggcaaaagataaaacagggtctagtgatccatatgttacagttcaagttggaaagaacaaaagaagaacaaaaaccatttttggaaatttgaatccagtatgggatgagaagttttatttgtgagtatataatgtgaaacctttacaaatattaaattatttaacaatgaatttaagacaggcatacaaaggatgcaataattatctcattttttaataatctcttacccaaaagtaataaaaaagtaaaagtaatgttataaactccttcaatactctcataatatttattatttatccttcatctttggaagcaagtgaataagaagaatacttcaaatcaaaaaaagatggcatgactggggtggctttgcaggagataaaaaaagatacacaacatgatctataacttgcgatgacccaacatagccagaaatgtaatcttgatttaacagtatcttgacatctgaagatttatatctaaagccagtagacttagagcatctcctggcccatcacttggggtggaaccatatctacattagcttatactattgagatggttgatgataactgttataaccttgcacattccacgagggcatttatttttaaacctcttacatcttttactgaaaagcagaaactcatttttctctcaaaagttcttttttttaacactcctttgtaaaaaaatgaatttcagttgttatttggtagaagtaaaaattcctacatgagttaaagacagtcttttttctttagttctctctttgcaaatgctttaaacaggaatctcattaccatggtaggtaaatacacccagaacatatagcttatttgggaatgtgggcaatattgtgtaagaagtagagtttcttgcatatatggcctgatgaaggaagtcttaagaaataggtttggaaaatcaattggaaccaaataacagagggtactgtagaatgaactaagggatttggaggatttctcccttcagagttctgggagagattagtatccctttacgtgttaaaatagaagacaagaaatcaattggaagttaaaattaaatttcctgttggagtcacgtaaatgaatatagcaggaaaggaacaacaaaggggagggatgaagactatggaaaactggaaaacaggtgattcccagaaaagaaatggcttccgttgccatgcgatcatgtagacaagatgcagctagagcttccagtttttcaggaagctggatatctgaaaccttagaaacagttttattgaggtgtaattgacattacataaaatctacacatttaaagtgtacattttgttaagttttgacatatgtgtacctcctgtcactacagacaagataatgaacatatccatcagtgccccaaaatattctttatgcctcatggaaagtcatcccttctgacttcccgtgtgcaaaggcagtctctggtttgctttctgatgctataggatacttttcattttgcattttctagaatttcctataactagaacaatatggcatgtaatgctttgtgtggttctattcattcaacgtaattattttgagatccatccaaattgtagggtatgtcaatagcttatttctattgcttgttagcattccattttattaatatatcacagtttattttactattcacctcttgatggatattttggtttgtttccagtttttggttaatgacaacagagtgacccatatgttaaatgaatgactcatgctaaaactgacatttgtatgtaaatatttgtgtggacatatgtttttatttctcttgaataaatacctagaagtggaatgaatagctgaatcacgtattcggaatatgtttattccgaattaatttaggaattgattcatctttttttaacaaaacaaaacaaaacaaaaaaaccctgatggaattttggttgctttaaagcactggctaagatttccagtatgatgccaaatcagaggtaagagcagacatcttagtctcattcccaatctcaagtggaaaacttcatttcttgattaactatggtattagctgtagctttgttgtagatgccatttatccagttaaaaagtgatttttctattctcagtgaactgagagttttgaccagaaatagatgttgcattttgttacattctatttctgtatctattgagatgatcatatgattctgactgtcattttaatttttttttgctttttcaataacaaatctgcagttgtccacatttttgcttctctgtgtataacatatctcccctactcctccaactgcttttaaaatattttttcaactcatttgtacaattggtttatgatttcacatggtgtaatattcttcctttttctagtgtttagggtttgtttagctgtttgggactgtgggtctacagttttctttcaaatttggaaacatttggtcattatttctttaaatattcattctgctgtctgtttggaggctctacttgaatacatattaggcctcctgaagttgcctcatagctccttgacactctgaggacttttctttctttctttttttttaaattttactttaagttctgggatacatgtgcagaaagtgcaggtttgttacataggtatacatgttccatggtggtttgctgcacctatcaacccatcatctaggttttaagcccagcatgcattaggtatttgtcctaatgctctccctccacttgcgccccaccccccaactttacttaattttttttttcttatttttttcttctgtatttcactttggattgcttccattgtgtgtgtttaaattcactaagctttgcttctgtaatgtctaacctgctaaaatctaagccactgtaattttcatattaggcattttcttttccatcctaggaaatcctaactgggtctttgcatcttccatgcctcaacttaaatttttgaaaacatgcagtatttatgataactgttttgatgtccttccctaccaattctaacatctatgtccaatcttggtcacttttgattgatggatttttctcctcattatgcattacatttttctgctactttgcttgcctggtaattttagcttgaattgcagacattgcaaatgttactttgttgcttgctggatatcgtagcatcctataggtattattgagcttagttctggacatacttaagttacatggaaatatttttgtgctttggatcttgcttttcaaatgtgttaaatgggaatgaaatagtgctcaatttcaggctaattattccccatataatgaaggcaagactcttcagcatactcttcctactaactcatgaattaggaggttttgtcttctgcccagtagaaattagtatgatttctaggactggctgtgtgttgggcactattgcatcaaacttttaaatcttaatctggccttgggcagtttctttatgtgcatgcacttatcattactcaactcatttctcaaggggacccctgtgcagattgttgaaatcttccttctgttcagctcttttatttttgatattatgccctgtgacctctagctgccttggtcttccccaactttcaattctgtctttcaactcaaagagtctaatggactctaccttggtttctttttttttttaattttttattttattttattattattatactttaagttttagagtacatgtgcacaacgtgcagcaaactatctaccttggtttctattccttgcacaatgattggaaaactccctcaaggcaataagctgaagtaatcatagggctcactttctttctttctttgtttttctctctctcagggatcactgttcatcactgacatatctccattatattgaaaaccactctttgatatattttgctcactgcttgatttttttatgtgggagggtatctctggtccctgttaatccctcttgactagaatagaaagtctggaaacctgaatttgattgataagccaaaaacaaaataaaacagtatgagagccaacatagggcatgtcaaagagaataaaatttctagaaatattgatccagttgtaatcagtaaaataaaatagaaatatttattgtattattttaatccttcaaagggtcctccttgagaaatcaactgagtaatgataagtgcagccaaataatgatgcatgtgataaaactacctaggaccacccaagtacttgatgtgacaattcgcagtgctcatccagaccagggctagtgcttgttcccaccagactggctaaaatgcatcatagttcatggggaaagtacacagaagtacacaccggaatggaccattaaactatgaattatctgtattattattggcagttttcatataattttccatgttgtgtgcctggtttccttttgataggaggctctatctgtactggcagtaacaatatatgtattttttaaacatcatttcaaagaagaaattcaaatttaacactgtacctggccatgcatgaactatatataagtacataatatttcaaaatattttccactttactgataaaatatttattaactttaagtgaagctacacttgtaattcttttctatttgtctcctttttaaatgccaacttttttaacattagttctttctgtcatcagtttcctgaattctgagattttattcttattatacaggttctatatcactggctccagaaatactattttgaagctaccagtgcatgttttcatttatcataaaaatggcatgagaattgcagagttaccttttctttataaacggttctcttttgcagaaagaaatgagttcacagtgaatttatgttcagacgttgaaaaatgtatacacatcacagatgaactcatccataccttcccctcccctgacagttctgccctgtgaactggggtggaaaaatatatactgacattctgaaaataagatgttttattaatagtgtgactttaacttctgagctttagcttgtctaatatgaaaaatagggataataatacatacctcacagaattgttgtgttttttgaggtagatactatatatgaatttcatagaacttgttaagtgttaaaaatgatagctgtattattattagcattaataacatgattatatctttgtgctgagcttcaggtctttacactaaatatgacagtaatagtcccatgccaaaaaagttccaacttgaatagtgaggccaagggagaaccaatgaataggttgctgtaaaaagaaaaaaaaaattctactaaaataagaatcagagaactgagactgggaaatggatctgagagatagttttgtccaacttgctcacttcactgatgagaaaatcaaagctcagatgggttgtagtacattcgacactacaaagtagtgccctgttgtgaagccacaaataagatacaagcagaaattgggaagtgtgattttttttccccctacatccaaactcttcacttgaaaaattgctgcagacctaaacaaggcaagcaatcacaaaactggtaaaatgaaaaggtagttgaaataatttttcaactttgggatttggccttaattatccccccattaattgcactttaatgccctctagagattttaatgctaaataatttcaattttaattttatttatcttactttaaaacaaagagtttgaatttataatctttaaaatactatagatgttgtgtgatttcagaatggggcactctggacagcatttggagagaacagaggcataaccaattaagcccttacagaaatctgagttacaaggggttgtaaacaaatgtttaattcctaaaatatcacgtgaagattaattaagataacacatatgaaagcactttgaaaatgataaagtgtcatataaatctaaggtgctggttatctttgctctttgatactgaattgtatagttgatcatttcataattaattatgaccttcaatttcactttcctttgctactgttaatgaaatgtcttatgcttatcataaaccattccctcaggaggaaaacaagtaagtctctctcagtgagttatagagagaaaatgccagtatggtctgccagtttgaataagaaatttgagagttaggagatgacattttcttcatatgttgatgctgttctctgaggactctatagttgaggccttggtgcctcctttttgcaaacttctgaaataaaaacaaatttcatgctgactccctgcaagagttgaggtaggtcataaagctgatagtagatatgtgttacttaatctgtttttaatagatattaaccattggagtaaagaattaagttaatgaaagtctagtcaacaaaatgcctgtgataggagtgcaaatgtgtcctcatttatagtagcattgaataggcatgggaatggtagttaagtattctacgtatgtaaccgactggacaatcagctccacttacttcttggagtatccatttaattccacctaatttcctgagtgaccgttatatgtaaagcactgtagttaagtaccatggaaagtattgacttaaagagtgattccacgttatacaaaaagctctctggccaacaagattataaacctgaataccagtactattctgggtctaacatgtttctggaccaatccttaacctctttgaatctcagtttcgccatgggaaatgtgctaaaagttattccccatcttgacagacagtaacactaaactcataatgctgtagtttagaagcatgattgttttggaccttttgaagtatatggcagccacgttcaattcctagctacccagatgtggtgcgcagagtgcctcaggcccatggctctccaccgtgccatgtgctgctcagccggggctgagtatcagttaagcataaactaagctctataaaagataatttatttaataccatatttaaaatattttgatagcacagcagactaatattttaaaatgacagcctgaacataatcatgcatctgatttattgcctagattaccagcagtcttttcctaggctatgtgggaagggagtatttcctcagttgtctgagccattttacagtgatggtaccaacatcagcaagtcatttgtcacagaagatggttccacagtttctaaagcaaggagtttagtcacactttatgggattagaatttatttatttatttatttctcttttttttctaatcattgcctacattgtgattatgtctagcagcaggaaaataataataaccaattctactgttcgcttgctaaatgagattgagccattacctatccacatacagcgaagccaacagaacagaatttacattatcactgcttctcactagaatctaagggttttataataaatagcggaaggagttatggagagatctaaattgaatgtcataaaatataaacttagggtcaccaaagagaattaattcacagtcagtaaactagaaaatatcaaatcaagatgcatgtttagagctatcactgtaatattccataggcaggggtgcaaggtgctatgaacttgacttagttttaaattgagaaccaaacagaacttaaataaaatctcccagatctttagggagcagttgggggtacaaacagcaatctttgtgggtaaaaaggactgttctgcaggaatctgtctcagtcagaggaaagagaaccctctacaattaaactagtacatggaaaacggattaggtgaggacaaattttaatatatgagaacagaaagtccttgcagaaaccaggaaaagccaaacaaattgtcccaagggcagaaatgattatgcttgtttattcctctcttcttctctgagagtttattcacctatatctgtttttccatctttccatttgcacacacactcctttcactgtgtccctatctccctcctttccccgcttttccctttcctcgcttctctgcacactgatctgattcttgatcactactcaatagattttcttgtttttcacttccccatggtatatcatagccttggccatgtgtttcccaactctagcactcagtttgctgctggaaacctatttgggtttttcaataattagctcagttcatctttacaaagcaccatacaagtcctgggttattggtctatcaatgattggaacatcttaaaactatcacttgtatgtttcatgtgtggaatggagaccagggaagtcttaatggggcatgctagtcactcatttgtgggttgaagcaatttcccctgagtgtagtattacactacaaccaactgatctagcagcattttcaagatccgaaaactaaaatgccaatctatctctacttggttcattccctcacttcttggatgtaccccttgtgtagaccacctattttgaaagcagaaaaagatcaacacgctagtactgtccctggccaaactgggagtctgcagatccctgttgactcagatccatatggtgtaaaattcagctttctgagcatttttttggttagtatccgccccaacactctgtagataaataattcgttgaacatgtatttaagtgtgaggtactctccacagtgttacagacactgaggtaaatatgtaagacacatgattttttttgccccagagctttcattacaattggagtggagatgatgctgaggctaacatcgtcaacagggggagccagtcctagggaggtaggggagaagtggtcagttctgcctggtgctgccaacttgacttgacaataggatagatatttgactccaaataaaagatgtttaaagcaaggtaatatttgaaagctgggcaaaagaagttttaaataggtaagcaatgtgttgaagaaatattaatggcaaggaagaaatatctaaaacaaaacccaaatcattgcaaatatcattataattataggcatggatatttgtgtggtcatttactgtatctcaaatcctatcatatgtataatacttcacaactaatcattgtcattatgattgttgttatcattttacaaatgagaaacctttgggagaccaatagatttttgctaaataatccatcccaacaagcaaaatggaagaaacacaactcatgcctgtatcttctattatcacataaatatccacttaaaggtgtgtactataaactctaaagcaaccactaaaaagagaaaacaaaaaatgttatggttaaaaagctaataaagtagacttttttttttttttttttttttgagacggagtctcgctctgtcgcccaggctggggtgcagtggcgcgatctcggctcaatgcaagctccgcctcctgggttcaccccattctcctgcctcagcctcccgagtagctgggactacaggcgcccgccaccacgcccagctaatttttgtatttttagtagagacagggtttcaccatgttagccaggatggtctcaatctcctgaccttgtgatccgcctgcctcggcctcccaaagtgctgggattataggtgtgagccaccacgcgcggcctaagtagacaaattttaatatcaaaaatgataaatcctataaagggggtaaaataaacaaatgggggaaaacagaaagcaaatagcaagatgatagactaaaacttaaatatgccaatgatcacattgcataaaaaacatctaaatgccccgaataaaaggcagagattgtcagattgaataaaaaagcaacatgcaagcatatcctgcctgtaagaaatacactttaaataaagacacaaatagttatactactcgtaggtaggctacttagaacactttgcccaacaagaacagaattatctatcattttgaagtactcacaggagatttgtgttgatagcaaataaacacatgaaaatatgcccaatagcattagttattagggaaattcaaattaaaactatgtgaaaatcacatcatacttagtataatagtatgttctttgtcccctagtattatttttttctgcccttttttgaaccacttgaatattttttataattgtatatgatatagtttgttgggttatttatatctcattattttgttattctagttattgctttagagtttattatgtatatatctttaagttataacagcctaccagtaatataatattaatactacttcacatacaatatgagaaagttataataatacacttctagttgtctcctctatacctttatcctgttgtcactaagtgttggtgagaattctcatagaactggaattctgttgttggtgggaatataaaatggtaaaccacttgggaaaagaattcattcctttattgaaaagaaaatatgtgtccatacaaagacttgtatacagatattcatagctgcttttttataataacttaaaactgaaaacaaccccaagtcttcatcaataggtgaatagatatcaataggtgaatagatataagtcgtggtaaatccagagactgaaatactagttaatagtgaaaaggaatgagctgtaggtatacacaatatcttgggtaagtctcaaaataattatggtaagtgacagaattcagacaggaattcttacagtataatttcatctatataaaattatagaaaatgcaaaatgcagactaatttccagtgtaagaaatcagatcagtgttttcctggggagtaaggaaaggaaaggatgagaggaactgattacaaagaatctcaaaggaacttttggagaaacttttgaaatacaactttaattatgttaatcatggtgatgattatataggtgaatgcatatgccaagacctaaaaatattgtacatttcaaatgtatgcagctaattgtattttagttataccccaataaacagttgaagaaaaaactctgacaaaaaataactcattcactgtgttagcagagtcagtattccactaattacaccccacaaattcaagatgatataaaattgctgcttctactatgatgattatgaccacacagtaatatcagtgatcctgaccaccaccatcctttgtggtctggcattaatggtttacagtgttcaacacatctaaaatctaaaatacagtatcatgtgcatttacatccttacatttatggctgagaaaaatgtctcagacttttgtgaaattgtagatagtatagccagaaccccaagttccttaatgggctagttaggatgtaatactgttgtgaattttttatacgttactcattgagttctatataaaaagtcattactcaaaattaaaagaatgtgctatctcaggcatatctactacttgcctttaacatttttccccattagtcttacgacatttgagaccatttttgatacagtccttccaaatttttatgtactttatatatgttactgtaattttcctcacctaagttttgagctacttaaggacaacctcctaaaataattttgggtataaagtaagcataaaaatatgtttaataattattttcaaaagataatttctataattgatttttttaccaatgaaagcatcttctataaacttttactgttaatttaaaaaatttatttgcactattgcttcactcttatttctcctttgttttcaatgacattttcttccaaataattccaaagacatgcctttcttttctgtgcacgatactcaaacattatgatatgaactcagatgttgacatttttatcagcatctccacaatgttttcctgcctgatgaaatgttaagaatgcctttagtcttcattatatgtttgttattttctttcagttatgtttctacccagtaaactttgaagctgattttgactagaattggactgggagggacaataaaatggatagcacttcttttgacttagttaaagcactaaaataagaagtaggaagtaacctcttgagcttttattatgattagatccatatcatcttttttcaccctgtccttacagaacaatgtataaggttaagaaagaacaagatggaaacctaccactaactctgggggaacatttggcatgacttttcactgcaagatgatgcctaaggcgccctctggcattcataggtttattactttatagaactctactaattggcagataattaagtatatgtgctgggaaaatttcatcaaaaaggagacattaactttatctttttaatattgctgctacaagggccatatttaaaatggtttaagacatgctttaataaatatttaattttaagcaattatttgttccttgctttgttccaaggatgaattaaaacaaataattcagttgtatttttcaattgcctgttcaatcacaaggattgagatgaaaccaaatgatttgaacccaatctatttcataatatgagagtaatgttgtagaaaaaaatgatacagttgggggaaattaagtagctgataaattgatgaactggcactccaggcgatctcagattttggaggctactctacagttagagtcctttaagtacaagtagtagccggtgcacagtcagagagaaacaatccccttagataactttctgtttatggaaaagggatcagcgtggcatgcaactcaaaaataactcttatgtcaatgctctctaccgacctaactttccttaccatctttggccactccatcctgacctgagacctctgactattttgcctagtttttgctgtgcctttttaaatattggcacccaactctcttttcaccactttttagaaatcttaccctttttctttatcagccactccttatgagtatggatcttgtgattttagaactccaagaaaattcttaacagccagaagtttctttactgctccctactttagagtcacatgtcaggttaatattctcatgtgagcttgaaagctttagatttctttgagtagacaaaattaatcccctatctggcgagagaggaattgggaagttccctgaggaatggctgaatttctggaaaagcattcactaatgtctaaatgatcctctctaggatcaatgctgttctcaaatgaatcaaatttagtatatcttgatgatcccagggcttcctcaactttgtcgttaagctgtacaatgccgttcttctctccatctccccgacactgatctcttcagtatctttaataatcagactaggttttgtgaatgcactagttattttttttaaatgtaatatctttcttatacttgcaaagcacatactggattttcagttaggacacatccttcttcatcatgcagaactggtcattacacaatcgagccatgtgaaattcttgacatttgacccttttgacctataaaaatggaaatattatatggttcaacctaaagtaatcgctttcatcagaatgatttctatgtgaaccatcagtcttacctctttatcacctagagcacagtatttgttatactttttaaaatataagctatgcttatgtttgatcaaattgggttgttttatgttttattacacaaacttttggaaatattaaatacattcaaacaggtgtctggtaaatttttcattcagatgttcataaacatatttattcaactttagttcttatggcacttaagtttgcattttaatgataaagggcaatactgcagacagatgagtaccagtgccaaaatatgacaggtgttgccaagtgttttgtggtatttgtgcagtgacttggcattttcaaaaattccatctctttgcatttttcacatctagcaaaagagcccagagaggactgaggaataaccaacattactatttgtgaattcttaagaacatttgctccgtttgagataattggttgaagcttagacttaagtggaaaagttaattggaatgtgagatttcctaacatttctccagcagttccttggtgattagtacaatcttctttgtataagcctgtactgtgctgttgtattgctcatgtttgggatgagagggatgttagttgacagtgtttacttttgtgattgcctctcccgattcaagtttggtgttcagataaagtctgtttgggaagctgatggaaccacaacttgttactggcatttccatcattgcctcaaagtttcttgaaagatggcagctcttcttttctagcaaggaaggtgggggaatagctaagagaaaggatgccaggtgtctacagaaatgaatgctgactgatcctgttttcttgccaaaaataaactctggctattgattttgtttaactctttttctctggcaagaaatatttattatctccctagaggtcttttagatgtgggaatgtgaagcttttcattagaatgtttttctgttcagataggctggtaaggaaatagaaaagtattgcatgaatatttatgcctgtattttgtttactgtaggatggatgtgctccctaaaagtcaatataatataaaaagataggttttcaatgatctcatcagcaaatattaaacagtaaaaattcttagtgttaatgagagtacagagaagcagatagaagggtaagcacatacgtgtttctggataacattttagtaatgtgtgtgtatacagatatgcatataatatgcacacctttaaatctagcaaagctacttttaataatttgactaacatattttcacaagtttataaacatatacatatacaaggggttctgtggttctgtgtagtattgcttccaacagtagataaatggaaactacttaaatgtctatctactgtatataggggaatagttaaataaattaggacacagtaatataatgaaatacaatatacttattaaaaagaatgatgtgtcaggatgtacccaatgtgttaagttaaaggggtaaatgatatgtacaatacgatcccatatttgtcacaattcaaagtagatacatgtatctactttgataacaatatatcaaactttttaaaggcaaatactaatactaaataataactttctattaaaatattgacaataacattcagtgagtcaagtaatgaactggatacagctatcacaataagaattgtgctcattgcagacggaaattgatagaggagagttccatatttctgaaaaacccattgtctctctctctctctcttgctctctctccatatatatgtatacatacaagtatacatatataaacatatatgtatgtatatacatacatatacatatatacatatataaacatatgtatacatacatatatacatatataaacatatgtatacatacatatatacatatatacacatacatacatacatatatatatatacacatatatatatatatactttttaaaaaaattgtgacagagtctcactctgtcgcccaggctagagcacaatggcgcaatctctgctcatgggaacctctgcctcccaggctcaagcgattttcctgcctcaggctcctgagtaactgagattacaggcatgtgccacgatgctcgggaaatttttgtatgtttagtagagatgaggatttgccatgttggccaggctgttctcaaactcctgacctcaagtgatccgcctgcctcagcctcccaaagtgctgggattacaggaataagccaccatgcccggccaacactcaatatttttaaaagtctttaaactatccatatacttatacagactgactatataagcattaaaaacaattataatagtttataaagtgctattatttttccaaaacttttatatccacaattttctttccaattcactcattgttactagtgcaaaatgtttattagtctttatacagaggtttccttttctgaaataagaaagttggatcatacactccagaaaaatgctttgtgtttaagatttattatcaagacacaaatgctaagatctttcagaaaaggacaaagaaatactgaaaggactgagagagagaaccaaagatatacttaaagctaaatatgtagttgtatgtattttttcatggcattttctttatgggtttggcatgtggtgtgctggtcatttgcctttcagctcttctattccttaactgctgttatagttttctggtaatttacagaatgcaacagtgggagaaattaaaaccaccaactctcagtcaaatacgaagttgaaaagaatgcatgcattcattccagagatacttacaagtattgcttatgtatctatacactccaaagtgctatactaagtgatacacatgtacacattaatccatttaattcttacaacagtattatgaggtaggtatcattattattatcaccattaaacagaagacaaaaccaaggcaaagagattaagtagtacaatagtcaacaagtggtggaaccaaaagtgaactctcatttttattttttttcttgttaagttttactgtggtataatatacatatgatacaatttattcattttaagtgtgcatctggatttgttcatgtagcctaatgtttttgagtttcattcatgtggggtatgtctcagcaggtggtttctttttaataatgaatactattccattgtatgggtacactacattttgtctcttctccagttggtagaggtttgaattgactctacttttaggtattatgaataatgttgcttgagcccttaatcttaaccagtattctgaactacatctccatcatatgagtgatttttaggtaactactgtaaaaaattttgctatctctagttctgatcatgtatgtagttatatatacagaatcataaatatatgaacacatgtatacatacatatacacatacatatatatcatcaattcaatatgtatatatgtgtaattatgatgtgggatatttctcagccccttcgccagacttgtagaaggggcgccctctctacttgtcccactgcgctcaacctcttgcaggagtgagcaagtgagcgtgggatatagccagctgctctgagtataggagtaagccccatgtgggacctgtggccagaccaggtgtgtcacttcaaggggaacatggcactgcccaggtgagggtgcccacgaccccaaaaccccagagggggtgttacagtgcttctttacttttgttgtccatggatggtggtgtgttagcagctcagttggccccttgcctcatcatgtggggtgggtgccctctgctgacaagtgcaaggggccagtgtgacagccttttcttcctacctgcactcagtgggtcccaagctcttgtctggtgtccaagaagaatgaggtcatgtggacaattgaaggatggtgaaggtggagaattctattgagtgatgaaaacagctctcagcggagaggggagctagagaggggacaggaagttcaggtcatctttgctggagtctcattgtctctccctcaaggtcaggccgtctctcctctactgactgaatctggggtctttataggcacaggatggtgtgtgcatgctgactggtttgtgagtatgcaaaaaaggttaaagtgaagacctcactcaaaggtggacatgaaaacgtagaaaaccaattaggaaagggcaggtatgtataaaatagatgaagggtggggatcagtcagaggatagcacatcaaacaggaagacaagttctgaatccagtccaaggatttaacttgcaactaggctttcaggctttaaactgtattcagctttgaggaggggtttcacctgctacacaaccctatctgcctaggcatctggctgcctcctgtcactatcaattatatacataccttcaacaatatgggtatatatacaaatccacataaaacgatgtatatatccaatcatatatatacacacacagagacataaatatatatacaaaagaatataaaatttaagtattagaatcattataatccctacattataagtttttttgtctcagtgatccattgtaaaaatttccacattgtaaaagatattgctaaacctaaatgtttaataattgattatgattttattgtatcagtatatatacattatttaatcaatctcctgggttttataattaggaaattagaatgtattatattttatatatctatgttgacatgtcctttgctgttaagggtggaatatatttatacatttgaataatgtaattagttacaagcagttacctgtaattaaaaatctaagtgcctagaacatttctatgtgatatatatgtgtgtatatatatatgtgtgtgtgtgtgtgtgtgtgtgtgtgtatgtaatatttaatccccttaaaagtaattatcattacttcagttttatcgattgggcgcagaggctcagtgcaactgagcaactttcccgaagtcgtattgctagtgagtggctccaatggaatttgaactagacaggtctttttctaagctagttctattattccatcatgtctaatacatattgaccttgaaagtgaaatacaaaaaatgtgtaactaatactgtgaatcacagatctttgaatattatagctagaataagaaaaccacaaacaacagcaacagacactgttccagtccctttacagttgtatgatcttttgttcctcattacaaccaatgactttagagattattgatgtttagctctttgttctatggacgggtaaatttttagaaagaacacatatcgccacttaaataaaagtcagatttgggaagataatttccttattaaaatatcaaataaatatcaaacatacatccaaagtggatcttgtttcttcaaacaaatagtttaatttctgctacaataattatgccactaattcaaacaagtatatttgtaatatctaatgaggaattaaaaagagagtataattactcctacctgtgatgtttctcttatttattatgcaaacgattttgaatacctacttgctgcaggcactagagcttggaacaaacaaaaaactcccaggacactttcacacagggatgaatctttatgtgggttttgaaagacaggtaagtgttcaccagaggagtagggaaaagacatccttaatgaggaaaaacatgaatacagggtttgagctgggaaaatacaaggtgaaccaaagaaatggtgaatagaaatcaccacgagcacatgtgcacacttgtgcacacacacacacacacacttctaatttcttgagagaataatctgatctgcctgttcgctgatatctctcttcttaagtggtctctcttttcgtagcaaaatgaacacggggtattttcctaaacaattttttatgtttattattttaataattatattttacattataattttgatagtattttaaaaacttagtattcacttactgttattattcaactgttttaatgttatttattagtcatcaaaacagctgttaaaacaagtttattctgcaactttatctgcggagaaattattagatataaacatataatacaagactttgaaagatttataatctaattgtgggttctagaaggtggttcagggaaattaatgtagtttataaggtcatattttgccctttgtttctatgatctgttaaaacataagtgctttcttcagtcaacccttaaaagccagtgcatgaactcctcttttccttttccaaaagtcatgctaataatataattcctttcttgttcttattttcattgtttcctatgttattgacttctgaaatggatttacagtgccttaatactacaaagaaaaactatgagagaatttaaagtgttgaggactctttttttttttaaactccaatactccaataactaaattgctcctgttaaatgtaggtgagaaaagtttctctgcatcaacactgggttttgaagtcagagtttgtccatctactataatagaatttgaagataatagtgttagggatcttcatgcaataacaagtgagataccgatattgcaatagaagtgggttacataattcatgatcaatcactaataggaaatgtgaaagttgagtgtcttatagtatttccatttgctgggtcagagtttaaggaattaagctgtaactagagaatttaattactgtttgaaaggctgccgtggctgctttgcctcgagatggctctggcaggaggtttctgctgatgattttctcaactgatgccctgccttccaggccgagctagaatgagatcattcataattactagaagatatttgaaactacattttttattgtaacagaaaaaatataaataataaaataacatttttcacaaattctatcacctatattttgatattttgatatatacgcttatagcttattttaatgaatatatatttttatatacgtatatatttattaatcatgtatattcagtagttacttattttatttatttattttttttaagacagagtctcgttctgtcacccaggctggagtgcagtggtgttatctcagttcaatgcaacctccgcctccccagttcaagcgattctcctgccttagcctcctgagtagctggagttgcaggtgtctgccaccatgccaggctaatttgttttgtattctaagtagagacagggtttcaccattttggccaggctggtctcgaactcctgacctcaagtgatctgtccacttcagcctcccaaagtgctaggattacaggcgtgagccactctgcctggtccattatttattttatcagtatatcttttaataaaagctggtacaatactattttaaatattacaggatctttttacaattaaaatatgtagctagaaattttagatattcttaacaaacgtgatttctaatggtgacagcacttactattgagatttttctggtatagttgcagtgtgaagtatattttagttgcttcattagatctagcccaactataagtgcagttttcaatatttaacagctctcttctactatactacttcagcaatgctgttgtattccgagatggttacttgggcaggaatttgtttttttccattgaagtcaggcaatcaggctttactgactatgaaagccatgagcgtttctctaggtagagcgatccatctcatgatgggttaaactctgataacttggccaaaaaaattttgctttaatgataggaaatatctatttagaccatatctaggagactctatatctgaaaatatttgcaaaggtggaataagcaattataaggaaattagtcattttgatgactgccaaaaggaaattggccaaataagtgattggctctgcagagcacagcacctgtaaattagaaactaaaatcaaaacaaaacacagacacacatacaataatactgaggccagaaaaggagtatatttttctttaattttgaatggaataaaagaccttattcccatggaaacaaaaccagctctctctttaacaatgaaaacatttaaaattagaaatatgaatcactctttaagaagagaattatttttaattaaaggaaaactgcaaaacaaataacttggctctagcagtactttatttatcaagtttgtgcagtaaaaattcttaatttctgttgataaaagaaaagccaaattcacaaactggtaaaccctaaacccggggtcttggttaaaaaattattcagttcagaaatggtttagtgagactatgcattctcccactattacacatgatagatttttttcctcttgtatgtgaggatatttctcttgctgtcaaattgtttactacaagagcctaccatttcccagctaaaatgcaaacctgtatattttcataaaagtcaaggtttgtgaaacacattttaaatagctaaggaataccatagaacacagcaagtataaaaactaataagagttcttaaacttatttaaatttatttcagatataatcaaacaaaatgaacttactatgttttttattcttttcctacttgatccaatcagaattgcattaatctcacattaagccacagctttatcaaagaagacattcatttatttcattcaacaagaagttcagatataagtatggtaactcaattatcccttcaaagaacaaagcttattttatcttcctattttaacatttttagtgaagcctgttctacatccatgtttcagggtagtaaagggagaaaaaagaggagacagcatcagaatactattgctcatatctctttggaagaactttgtctaatgtccatctctagttgcaggagaggttgggaaattgcataaaactaaaaaagggaaggaggggagtggtttgaaagattgttgtatgagtgtacttatagcatctgccaccaacaacctctttagcttctcagcatgtatatatgacttttctacatgtatgtttactttaaatgaagtgaattcattctcttcctttcaatgtaggtaatctaaaaattatattcagttactgcatttagcttgaagtccaggatctttctgtagtctcttcacaagcttcaggtttggttctttgtagatcctgggacacaaattaaacactatgtatctttgtccaacactcccaatgtattgtggagagaaaagaaaataggatgacagcaatttaaaatttctgatttagtaagacaggaaatggaaaatacatagtctttgtatgtagcaaccatagagtcctgctggacaggtatattcaggacttcctggtcctagcaacagaagtagtttctgggttagtcaatcttgtatgacctgctactttctagatgaatttcgtttatcagtttccctctactagtttgagtctacatatgggtaaaccttctttgctcattttatcagtgcctacactcaagggtgagtactgtgaaaggtgaaagtaaattaaaaagggctccaaaagaatgaaaagtcattccattatctgcaatatccataaatgaggaccatcccaggaaatccaggcatgtggtcttcctagctggggagatgctctacttggagtctttttttttttcttttaattgctgtgagtgcagggacccaggaattactttaagcacagctgtagccagccaaatgtgagacacattggctaaagtccatctctagttgcaggggaggttgggaaattgcataaaactaaaaaagggaaggagaggagtggtttgaaaggttgttgtatgagtgtacttatagcgtctgccaccaacaacctctttagcttctcagcatgtatatatgacttttgggcagtactgtttcctggagaatttactaggcttccaggagacgggctctaagacaattttatgagcaagtaaccacgtaagcctggacaattttgtctcttatctcttggctcctctgttctgatcaattcatctcccttaacctaatggctgcagcctcagttcctgaaaaataatatgccagggtgagaatgcaacacctttaatttggtttttgccactaagctaccattcattttgactcgaagacctcttaaaggatggtgctggaaaagccctagggcaacaattttatctatttctgaagttgcacttagaagcctctgcttgtacaggtacctttttgtgttcagaatcagctggcttttctcaaccctgcagagttccaaattatgatattctcagtcaatttatattgcaggacactagcacatgaccctcttttgaacatggctgctctcctttgcatctctacctataaactgtctacattcagtttgaatgtatctctgtgtatggtagtatattcttgaaagggggaaacatttgataatcacttgccaacattctgaattttatttcccaccattcccactaataaaaaagcttcaggtggcatggtggtcaaagtttatagtgagcaagatttgaccagctgttttgcaattgcgtatcaaaatgtatcggctttctagcccgaggtgattaaatcttcactctctgtgccagcatctcctccacagagtcagttctatgtttttagactctgttacttgccactcccttcatgctttaaaaattattatgttagtgagtattcttagttgcaaacaacacagtccactttggttagtttaggctgagagattatttgtagactactaggtcactcaagaatgactgtagaggttaaagtactagcttctgaagctactgtgtgggaactgggtcaaattatgtggtgacatttctttggggaaaacaccgatcaatacttttgcccctcgggactaaatagtactgtgaaaccctgtatcacagtactacatagcatccactgttgggggaaaaaaaaagcagttcccatgatatgggcactgtacactgtaccactttgagtttacaccttgcttgaatgcagggtaaatacctggaacatagctacaaaggaatccaggagtgtgagttatctaacttcagtcttcagaagatgagcaatacaaggagggatctagtcaaaatgaaagcagaatgctcgagaggctgggcatccatacatatgcttctccaccacagaatcataaactgaaatctccagtttcaaacccatcacaacacccttacgtaatcttcaacatttgaaacagcagcctcactcttacctttgctctgtgaagtaaaactgtacgtttctgacagtttaaatgtgaaacataatgacaaacttaatattcctcaaaaaaagctgtttggaagagaaaaaatgtaagagctggccagtctttacggggaaaaagtagaaccaatgttagttgcgacaaatattagtaatgtgacaggttaataagaaataattagggttcagggcctagagaaatgctctgtgctattgttgcaactcttctgtaaatctaaaattattctaaaataaagttcatttaattaaaaaaatgaaaaaaacagtcaaccagaaatgcacagagactcaaactcccaagacaaattgcaagtacacttatacaaggaacatcagtggtcatttatagttgtccttcatctattggtatcccatttattttgaacagaaatttggaaagaaagataatattgtctctccctcctttttctatatcatgtatatgtattatgtagaaagacacatgcatatgtgtgtatgtttacccatatagttactactattttgtatggattgctatttgtatgcatatttaaccacttaatacacctttaccttgcttttatagcaaaaactagaagctcaaaaaaatttgcctcaaaatgagatggatattttttcttgtgaaggaatagattctagaaatgtttaccaatctttattatctagagcttgctatttattgtgcctgctatttgcaggtaaaaaatgcattagaactctgtcttccagggcttacataaactctgatgatttatttatcaaaaaatgacaaaaagggacatctttctgcatttgcaatgtattgagagttaagtttaagatgataactgtatcttttgctactctaaaatgccttctatctttttctaagataagaatgaaataaactagtagttgtgtctttgtttctacttagacttttcttctttttgatagcaaagaacttagaatgttagccacttttaatataaattttgggtaaattaccaaaagtgttatcatccaaatatgcttgctacaataatttcaggtgtgggttcatagttatcttgggaattctgagtcaatgggagacagctgtgctcttactattccaactgctctccatggttgatagtgagctttgttagctgctccagacacaatgtcatggattaattcttcctttctccccacaatttctacctcattttactaataaaatagctcaaacttagatatttttatgaatatatttctaagaatgacaaaattattttttcttcaaatgtaaaagggattttattttggtgaaactttacagactttagtgaatatttgttgaaagatacatgccagaaattgtcaataatagatatattaaacataggctctaacttcaaaaagaacgtggaacttgtggaataatggcgtcttatagctaatatggatgaaacattgcctggcactgtgctaactgctataaggtattatctaccatttcccacaagaattttctaagacaagtgttattaccccatgttatttatagataaagtaactgagatttatagaagttaagttaggtagacatagtagttctcaaccctgtcagacccagtgaatcacttttatgtaaaataattcataatgacctattttatgctgaaacaaagtaacgcatgacttaacctatctatagatgtaatttgaaaaatcagtataatgttccaacttaaaatgaaggagaactaaaagtattctaatatgtattttaacgtgtaagggcttggatacaactaccctagaatacatagtagacactggctttcactgttgatagaattaagatgaatgtgaccatttcaaatgcacactgatacaaatactataaatactacagttcaaatattatagttcaaatactttgtgtagtttcgacacaggtgatgtaatttttcaaaatggaaaggaagccttggtgaagttcttaacagcaacaacaaaaccttctttgattagtgattgacatgctagttcctttccaggacatttcagtgtctagtaaatcatgcaaaagacatggtgtttctacctaaaagaattacatcctgagctaaggtaatcatcaatgagttaagaaatttccttaatgcctgatgggtcattttaaatcatgcacactgtcctgtacatggtggggtatctaaatctctagcctattccactgaatgccagtaacgtccgtgaatgttcgtgaaaaccaaaaatgtcccagaaattagtaaaatgctctgtgttgaaaactcctatgttaagtagaaacagtggtgctacaattcgtatataggcccatcagattcaaatattattcttgtatgtgctgtattattttgccttataagttaatgaaagagacattatactcaggaattctcaaatactttttgcaccatgaacctgttgggaagtctagtgaaaaccatagatgtcttttcaaaatgtactttttcatataaaaataaaattcatagaattaaatcaattatattgaaacacagttttagtttaatgataggtacaaataatattttaaggttcataacacttagaatgttatatgtaagtatctgtggttgtattgatgacaaaaatgctgctgtggtttgttgcctatattcataattgaaaatataaagatgatctcttcctctctctatatattataaaatatgttttatacatatatctatattaattatagataatatatagattatatatagagatagatatctatatctatctatatagattatatagataatgcatatataatatgtatattctccttatatgtgtgtgtgtatatacatatataatatatgtattttaatccaagttcaagaatgctcagaactcatccatgaaccctgagataaagcacctgtgctagaggaaatcatgtacaggatacacagaaagcaaagagttgattgcaactaaatggttcaataagttgcaggaaaagtgatatacatcagtttacttgcagattcctaaagattgattggttaacaggcaaagaagcctagggaagagtgtatacaaaaaccacagtgtcagaaaagaccataatatgtgtaggcaatactaagtagcttgcctcaacaaaagagggtgaagaaaacctggaaattaacgatggactagaatgcacagtttgttctttaaatcagaaggattttgctctaattctacttgatttaataatatcttatgtgcttactgggatttttagtttttcaagtccttcagaaaactattattgtcattttgtagtctgtgaagtccacattctcaacacccattgcaataaaattagctttatttttatggtgaagaattttccaagcatggatatttttatcaagataactattgtcaataggaaatatggcataagtgaaaatatcacaagcaaagatttcttacccatatttgattatatctaaatcagttaaaggaaataggatggaatgggatttgattttcccttattaacattatttagcttttcttcagtatagttgcattatgtgcctgcaacatcccatggatagatgaaatgggttatctcatttattatgtagtatattatgcctttctagaatagatagaaaataaagtactaacatcaaatggaatttagagcagttttcaattgttgttaacttatccacatttattttcagtgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttaggtgatttttttttttatctacttgaaaacgagttaaataaaacccctgaatacctgtggcatgtattacattcccatataagtaaaaataaccaatgcctttccaggacattctgttgaactttagatgattcatttcattgacaagaaaaggctattcttttttcaatactgttgaaagactttggtaaatttgaggtgaaaggagaaatccctttccaagaactacctagatgtcttttagagaaaaatgttattgcattcttaatttttaatgtatgaaatacagcttcacaaacccttgccaaatacatgcgaaacaaataacctattatttaatgctatttgacttatttccttcttgtccattaatgaaattttggcaatgaaggaaaaatgtattttgaattgctttcaaatgacggtataacagtaggctttagttgacaaagtcaagtaaacatgtgaactcatgcagactctcttgatgaagatactgagaaggtgattaattggaatgatttaaaaaattattatggaaccagaaattaaataaggtaagttttaatttaacttttactagaataaaataataacatagaattttctgtggtgatttaatagtagtaaaatatatgggtcacctcagtttctgcaaaggcacgatctgaagatgtcttaatcatatcctataaagtgttttaattaaacttttgagggctggctggatatgaattaaagagttgacacattccttgggttacaaagagttaccacttaggataccaacatatgttaacaaattaaaaagtgcttttgactttaaaaaaatctgcatacttttagtaatgaaataattgacaaatggaggtcacattgaattcacaaaactctagattatagaataattcaatgaaagagatatttaatttatctgaacacagatgattcaagttaaactaagaactaattattaaaactatcttaagaaatcttccttaaagaagatttgtactcttatgtattggagtagaatttttacctctgctataatgagccaccccccaaagcttgttttaactattaaatgacttcgtatatgaaaatagaattactaactgagggtaaatttcaggccattaactctgtggaacattcacaaattatttctttatgaaagaggtttatctttatatggacttcttttctgtaatacgttaacatattcttgggtcgaggcagtaaagttgtaattcagaacagaaatttctccaatgtattcttttaacaaaacatatatgagtacctggcacagtggctcacacctgtaatcccaacattttgggaggtggaggagggaggattgcttaaggccaggagtttgagttcagactggacaacatagtgagacccatctctaccaaaaatttaaaaaatattagccaagcatggtgccatgtgcctgtagtcccagctactctggaggctgaggcaggaggatcactcgaatccaggacactgaggctgcagtggactaaaagattatgccactgcatcccagcctgggtcacagagtgagaccttgtaaaaaaaaaataaatacataagaagaagaacaaaaagaaaaaccatgtaccagactatattcagaacttgctgaggaatttgaatatgctgctattagtaaaatcagccatctagctcttatgctgaaactgtccttcagtctatgagatgaaaatgtgatgaaacgcaatattgtaagtctttacctacccaccctcagtagttttttgccctcattgctgatgtttaacctttgagagtgtgtacaggttttaccttttttagctttgtgtaaaatccctaaatacattctatccaaacaaataacctatttctattcttgatacaaccctccttatcacttaaaattcattccactacacaaaggaagttttgactgaaagcctttggtgtccaagcagagcctgcttcccaaagatccttagggatgatgacagttaaaaatcaaagaaccaataaagctcccctggatttctggaaagaggtgtgtgaccaaaaaagaccctaggtcttgcatttctcttggccccagcagagaatttttatttttatttatttatttatttttgagacggagtctcgctctatcccccaggctggagggcagtgtcgcgatcttggctcactgcaagctccgcctcccaggttcacaccattctgctgcctcagcctcccgagtagctgggactacaggcgcctgcaaccacggccggctaatttttttttttttttatttttttttattttttagtggagacggggtttcaccgtgttagccagaatggtctcgatctcctgacctcgtgatcctcccgcctcggcctcccaaaatgctgggattacaggcgtgagccatcgcgccgggcccagcagagaattttaatatttcttgagaatcaactccctctcaaccagtaggaaaatcgcttatgatcctggcacttagaagggaagaatctttgcaacacaaatgacgattaaagaataacagtgaaaagtcagcagacattccacaagagggaagtcatcttcatggtttaactgtaccttatacggctaaagatacagctatgtttagaaagagggccaatttaaagtcctccgcactgactttgtgtcacttacctaaatcctattttcatttgtgaaatgggtcagattgcctctgtgttttgtatctgaaatgggtcttgaacttaggaccctccactacaatcacagcctagattatgcctctatttatcgcaaagctattgctcagtttataccgaacacgtacgcacgcacattttatggctaaattgactatatgttgtttccattcaaataaacagtccagcacttataagttagcctagggtatagactgtaggtctttataaatcactgacaatgaaaactattaacattttgttataaaccagaactttggctcatcttttcaagtacaaagagaagaaaccaagtagtgacagctttcagataaaataatttcctatttatacaccgtttttcttgattttgattgccaaataacttatttaatttcattgtataaactgatcaaatacacagaaatatatgagaattgcagggtcttctgattagtttttttatttggaatatctgtaagacgcttgataattacaataccacaataggcaaatatttttaattgtatttaggggaatcatagttactttttttgcatttttaaatagagacagggtctcactctgttagacaaggtgaagtgccctggtgtgatcatagcttagtataacctcaaactcctgagttcaagagatcctcctgcctcagcctcctaattagctaagactgcaggcaagcaccaacacacctgcctaattaaaaaaaaaaaatgtagagactagatcttgctatgttgcctaggctggtctcaaactcctagcattaagtggtcctcccaccttggcttcccaaaacactgagattataggcaagagctaccacatatggcctcatcatggttacttaataagcagctctgactcagaaaaatagcttttagctacttaagccgtttttttgtttttttgttttttagcttttgagaggtcgtatgagaaaaacattattgtcagacatgactgaccaattgcctttttgctttatcagagaaaaggacagataagtcagctgtatctggggccatacgattgaaaatcaatgtggagataaaaggagaagagaaggttgctccatatcatattcaatatacatgtttacatgaggtaaataaatggaattttactaatacaaaatataagaaatgttcttgattatggattataaaacagaatatttggtttaaaaatcattgaatttgtagagtggttcctggagttctgactctatactacagcaggtgatatactaagatatcataaattctatgtgttgtattacccctgacgaacttgtcatctaatgagagtttagaacaagcctgtgaggcaggtgtgaataggcaataagatgataatgcataagtagatacaaaaaaattaatgttcttccaaagaggaagaagagtgttaaaaatattgattgaagaaatgagtcatgccacatattttggaagcattaaatatgtagtagtttggtattgcaggagaggatcaaatcgtaattgtgtttgagaactccgagttagagttcagattttattgaagatttaattaggactctatttataactagaaacataaaaatgtggtgctgttttgatggcttttgggagccaatgtaataagcagttaatttttcttcctgtttctgagtacaacaagcagtttcatacatactgcacagtcctccgtgttaacctctctttctacaaacatgtgagtatggagaaaatgaagatgtggttactcacccaaaaagtagggcctagttggcttggagagaggtaaacaccacccaacatcaatcaaaagcacagtttcaccagttcccttttgtgtctcagtagagaagcacagacaaatcatcttgggagtctatcaaatgtttgtcgctgagagcttagttagaggtgtcacgggagactttctctgatgcaaatgatacttgtctcatatcaaaaaataggtgaagctgaggaatgtactcttcttcatgtgtttcaaagtaacaaagtaccttcctcagaaaaagacaactgaaagatagttctacttttgtgcatattattttttctacatatattcatgaaaatttatacatgtaaatatttataccccattttactaagaaagaaatgaggaaccgtgtttaaatcgtgtgtatattacacacgatttaggtataggacctaggcttaatttcataatcacagttttgtggttagtgatattattccctcaagagagatggttcatttttcagaccaataaaaagaaatcccttgaactggcatgatggagaattcgggccttaaagtgtgggcagagaagatctgcagtcagagaaacagcagtacacttcactttacaaagtcttttctactggtccaagaaccagaaagaactgaaatctaagaaaaagtccttcagtttaccctggctttatcaaagtagcagttgctaaacttagaagcaaaaaggaattgagagtagtaattttatttcgttacaaaattctccaacattcattttcaacctcgattcattgccctgactcttaccattttgcagcccaaatcctttagtatcatttacacagctaaattttgccttaacatagtcaaaatcagattattcatccagggcactataatttactcagaatgcctgaatgcaaaatacgctctatcatgtagaaatgttttcaggcaaaaacactcacttccttctgcaaatggtttggtatgtacaaaatatttgaatcattgattctgtgtagacccacccaactttactatctaaagtgccttaggaaggtactttatcactttgaacatgaataagggtacattcttcagcctcatctcatattttttgatgtaagacaagtatcatttgcatcagggagtcaccagtgacacctctaactaacctctcagctgcagtgtaatagaatctaattctgagaatggaacttggcgatgtatggtttaataagccttccaggtgattctcatatactttaaagtttgagaacctgtgccttatttgctgaggaaactaaagccttgatttttcctaggttacaaagcctgttactgtcagagacctatccagagctattatgacatcttgtcctaaatattaaactatgtccttccttcccatatttatatcagcgcttttacccaggcagaaatcaaagcagattttgcataaaagatgaattgagttagaataaaaattcaagatattcctattgcttgcagatgctgatgaaacattagaggcaatgacagtgcaagagcattttactggaagttttagttaaatgtttctggcctattctgaggaatcactgaacaattaaaaaccacttgcttttagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgtaagtactacagaacatttacatggtcaatatctctattaaaatataaagaaagaaaggagcgttcatctcacttctaattcaaatgaaactgattaaaaagaggattatatttcactgtgcatgtttgatgctgactactctctcttacagctgtaaagtattaatgacttggtaattcactaccaccatcctccaatccttgttctgtcctccaagtgtggttccttgacaaatagtatcaacagcacctggcaacttagcaatgcaaattatccaccccatcccagacctactgaatcagaaactctgagggtggaatccagcaacctatggtttaacaagtcttccaggtgattctcatatactttaaagtttgagagccagtgacttattccatatctgaggtaactaaagccctggtttgtccaaggtcacaaagcctgttagtgagagagacaggtccagagctattatggtgtcttgttccaaattttagactatgtctttccttctcatatttatatcagtactgctaattcagtaaaacaaagatttatttagcacccatagaacgcaaacagtataaaaaatgtgataccacagaattaacttattataatttcagtgaggatttagaactgaatttcagtaagggtttagtaatgaacagaagtattcattacttccccatagtttcctttttgagacctggtctaattttataagtgcatatggttcagatatataccaggtgtaatttgtaaattatttatattagatgacttttttcatattaacaacaagatctcattttcatgtaaactgaatagatactggtccagataagaagtcaatttcaatcatcttaatgatgaatgaagactgggccaaaatcagtgttcattttcttttgttttttttttttttttgaatgtaagttctggggtacatgtgcagaatgtgcatgtttgttacgtaggtatacatgcgccatggtggtttgctgcacccatcaacccatcatctacattaggtatttctcctaatgctatccctcccttagccgtctacgccccaacaggccccggtgtgtgatgttccccgccctgtgtccatgtgttctcattgttcagctctcacttttgagtgagaacatgcagtgtttggttttctgttcttgtgttagtttgctgagaatgacggtttccagcttcaacaatgtccctgcaaaggacatgaactcatccttttttatagctgcatagtattccatggtgcatatgtgccacattttctttatccagtttatcattgatgggcatttgggttggttccaagtctttgctattatgaacagtgctgtgataaacatacgtgtgcatgagtctttatagtagaatgatttataatcctttgggtatatatctagtaatgggcttgctgggtcaaatggtatttctagttctagatccttgaggaatcaccacactgtgttccacaatggttgaactaatttacactctcatcaacagtgtaaaagcattcctatttctccacatcctctccagcatctgttgtttcctgactttttaatgatcaccattctaactggcatgtgatggtatgtgattgtggttttgatttgcatttctctaatgaccagtgatgatgagcttttttttcatatgtttcttggctgcctaaaggtcttcttttgagaagtgtaagtacatatcctttgcccactttgtaatggggctgtttgtttttttcttgcaaatttgtttaagttctttgtagattctcgatattagccctttgtcaaatggatagattgcaaaaattttctctcattctgtaggttgcctattcactctgatgatagtttcttttgctgtgcagaagctctttagtttaattagatcccatttgtcaattttggcttttgttgccactgcttttgctgttttagtcatgaagtttttggccatacctatgtcctgaatggaattgtctaggttttcttctagggtttttatgcttttaggttttacatttaagtctttaatccatcttgagttaatttttgtaaaatgtgtaaggaagggatccagtttcagctttctgcatatggctagccagttttcccaacaccatttattaaataggaaaccctttccccattgcttgtttgtgtcaggtttgtcaaagatcagatagttgtagatgtgtggcgttattactgaggcctctgttctgttccattggtctctatatctgtgttggtaccagtaccatgctgtttggtttacttaagtcaggtaatgtgatgtgtccagctttgttctttttgcttaggattgtcttggctatgctggctctttttttattccatatgaaatttaaagtagtgtttttctaattctgtgaagaaagtcagtggtagcttgatgaagcatacttcccaaagtaattgatagattcaatgctatcagtgtttcttttcaaagtttactgttcatagcccttaatctctaatcataattctagaacaacataatgtaagcatgaatgataattactgatagagaaattgtgcatgctttttcagtacatagaatgtccttatgctaaataataaagatatatagattcttagatgtgaaaaaaaaataagaaaccttagagatcactcgattgaacctccttctcaaatctagaaactttgttattggatccctgactaatggtcatcatcccttgttcatccacatccagtaatagggagctcactactttggagggaacttgttttataattggtcaaccataatagagtctgtgattttgacatctgttccatcccatgccaaaggctatgattcagaacacctagtataaagttatagcacaattaaaatgcaagtatgatgaacagtctaagggaaatgaattgttctgcctaaagaaaggtaggttacaaaatcaaaacaacctgctgctggatagaatcccattaaaagaaaagattaagttaaatttattctaaaatatctctgggagctgatgttagattcattcatttccatcttttctgtgttctaagaaacacagtcatgttaatatagaaaaatggtaagtatgtatcacatagatcgttggaaagaggagaattagcccttccttattttattacattgtataatgtaactcttgcctctcaatctaagtaaaagataagtatttttctttttttttttttttccagttaatttagaaagcttattttgccaaggttgaggacacgctcccatgacatggtctcaggagttcctgacgacatgtgcccaaggtggtcggggcacagcttggttttatacattttagggagacatgagacattaatatatgtaagatgtacattggttccatccagaaaggcggggtcaactcacagcaaggagggggcttccagggcacaggtagaggagagacaaatggttgctttttttgagtttctgataagcctttaagataagtatttttcaaaaatattttgaatatttatttggtagcaagtgacctgcaggtatattgggtctcattgtatttataaatctcaggaaaggcaaaactcctgttcacactagacaactgtctaagagcaggggttggaatttttttttctgtaaagggccagatagtaaatattttgtagttgtaccagtctctgttacactgcttagctctgcagtactagtgcaaagcagccatagatattaagtaaataaatggaaatggctgtgtgctgataaaactttattttaaaaaacagaaactcggaatttggtcagggtttggcatgagggcatgagggccatagattcactggtctaaggagtgaaaacaaggcagatagaaataaagcaaaagaatgccttaggttttgtgattcattgacaattacacttcagtgacaataatgtggtagattatgtgtacttgtggttatacatttgatttaaaaatatttttatatatcacatgtttcttttagcactgaatacttatcatgacaagcctaacatttttcccagcttagcaaaactttagacaggcttctttctgcctctatcgccctgacgtccgtttcctcccagcccttgcagattccaaatgacctaaacccacaggcctctgacctcctttcccttagagcatttactttagaaaacttacaattgtaaattctttctctgttcctttgagatgtaactaaaaaaaaaaaaaaaaaaacccttacctgatcttgtccctgttgcagtagccttaatgaaaattcccttgtctaattaactttggtgcaatttttgctttggcagtacaaaattttccattactttgccagaagaaaaaaattctgttgacaatctgatcaatcctaaggaaattactaccaacatagatacaatctctattgtaccaataaagattttatgaataccaatattatttattggtattcattagttattagaaattattgtttttatacaaaaatatacgtgtactcattttatctcaatctgttaatataattgtaatctgtaattatatccaggaaagagaatagaatggaacagcatagaggtgcacttcaattctattccacgacttacaaattgaaattttgaagagagaaatcatatctttcattactgcttcataagaagttcttgatacatgatagaaagtcagtacatatttgcaattgagggaatcagaggcagaagctgtttatcagaattacatttatttttaccttctcctagtgtgtttctagatgccagagtttttcagttgccaaaaagaaagtgaaaatgaaaagtttaattgagctgatataggggtctatgtcaccatttatgctgtaataagggtgagagcacactacattgattgatcgtttttaaaaatttgaggaagtttcagagtactgagttcttttttcagtcaagagttgaaatacagctttcagagatagtttccaccatacttttaaaatgatgcttttgcaattgaattgtaacttgagccctaagctattgctggccaagcactaactcaactgaaaaaaaaactgtttatgaataaatctatcttttaatttaaaccggttgactaatgaataggtatttttctgttgttctgaaaccttgcatcagggaacaacaacaataaaagtaaccggaaagccaaccaaccaaccaacgaaagaacaacaaaacctagaacgcaacatttgaagcctgtctcagaagtacttcctcttaattcttaaaaaaacaaaattggaaaactcagctacaaagaagaaatgctgtcttttctctataataaggatacttaaccattttcgaaaaagacaaaagtccttaattctgtggattttcctagacactatttgatcaaaaacagaaatcaaattgtaccttcttttgatatttaaatactctttagggttagccaaatccccgggtaatttcataatcttcctcttttattagagatttcttggtttcttttgagcacattcccatttctttgaagatggatttggagaataaataaataaggggaagtatgttttaagtcagaatctggtagtacactactgaatttttctcttgtgaatttcttttcagacaaaagagtctgaaactattttgctggtaaacctgagcattaggactgaacgtcccagtgctccaaggtacctccagcttactataaagcattcctctttccacagaatattttctgtgagggtaccatttattagccctacctgttacataaaaatgaccctttgttctggagcatgcgtcagtaggagagggattacaattttcctgtttggacaagtgattgatcaaggacctgaagaatttgttcccacatggcaaatgcaaccatccatctaaaataaaaacaattttctaactaatgatagtaagaatgataggctgttccccttctctaaggaacacaccattccacatattttgcatcatggggtgaggcatagaacttgtttccatcatcaatattttgggagttcttgatgcttttcatctatatatgcaatgtgtatgttcctaatagtgttttgacagactaattgttcacagctgaacacatccggggaattctatatcagtcattatggtttaaatcatcctctggagattatttctgtcaagaaaatacattttcttgagtgtttaatcagtcatttattgtaacatgaaggctaagatgtctcacaaagtctgagattctattaggctatggttttgcctctacaatagcaaaggagaggaaagcattaggtcggtgttttttaccttgatgtgcttacaaaacaacctgtaatgtaccctggcactgaccatctttatctaatttatatttaaatcagaactgtttggatacaggttactttaaagtcacagtctgttttaactgctttatccaggagtctatctgtaaaaaagagtgctgcttaatggagtcattcatttgtttaagaaatatttactcagtgcctatcatgtgccagaaacatttctatggttacagcagtgaacaagaagtcagtctagtttctcatgaaccccacattctagaagatgaaattaatttattcaatagattttctgaggatgtaagtatgaggacttatatagaatgtcttagtctgtgaggctgctataaaaaataccatcaattgagtggcttataaacaacagaaatttatttctcacagtcctggatgctagaaggtccaaaattaaggtgccatcagatctggtgtctgacgagggccatttcctggttcatttatggctgtcatttcactgtgtgcaagcttcacatggccaaagggatggaagctctctggggcctcttttataagacaactaaaatcccattcatgaggggctccccacttatgatctaatcacctctcaacagcctcaccacttaatactacaaccttgagtcataggtttcaacatatgagtttttcatgaacacaactgttcagaccacagcacaaggcaatggggaaatagcagtaaaagatagctcttgtctctagtaagctcctgatttagggggaagagaacaaagagattaaatagtaacaagcatgggggctataagggcataggtatagaggaagcaaatccaagcacagatgagaagtgtcagaggaagccgatgggcagcctgagggccccacccttacttgtccttcaacttctgtcttcctctaaaatctgtgccttttatttattttccagtcacacaccattgctcttgtactcaaaatctccataactgggctctagcaacccatagcatctttgagaagctatgatgtttttggtcaaaacagaagtgacatttaagtgtttgagtcatctttagtgacgagaatgaataaaattctaacttatcactgataagttagaatgctgagctgaatttgggggagcaagtgtgatgaatattgttttagtgtatttctaacatcagaaatgcagatagtctttcctttcattttgcatagtatctctgaaattgcttgcaacaatctaagaatcataatcttccttttggtacttctttccaatcaccttgttcttctgttcattgattatttttaaactttagatgaaagtcatttctagtctttgaaaaccacaagttccgtatgatttcggacacctgtccctgaactggcatgtgagttagaggattgttttattttttttgttcaacaatagcaagtgacattaacccagatgtgctatttgaaatacatattagaccaataatattttgactattaatggttaataactttgtagcagttgctttagccaaaaacttgccagtaactatctcattatttgctttttaaatttttttaaaaattgattgataaaattttatgtatttattatatacaacatgatgttttgaagtatatatacattgtaaaatgactaaatctagctaatgaacatatatattactttacatagttatttgtgtcatgagtacacttccacgctgttagcatttttcaagaatacaatgcattgttattaactatcatcaccatgttgtacaataggcattttgaacttatacctcatatccaagtgaaaatttttatgctttaacaaatatctcccagcacccaccctgctagccaactccagctcctggtaactaccattttactctctaattcagtaagttcctctttttttatatatttcacatatgaatgagatgatcatatggtatttttctttctgtgcctggcttatttcatttaacataatgttctccatgttcatccatgttgttgcaaatgataaaatttcctccatttttatggctgaatactattccattgtatgtatatacattttctttatccatttatctgtcaatggacagttacattgatttcatatctcggctattgtgagtaatgctgcaataaatatgggtgtgcggatatttcttgacatactgatttattttctttggctataagcccagtagtggaaataatagattatataatagttctatttttaactttttgaggaagcttcttactgtttgtcataattgctgtaataatttacattaccatcaacagtgtacgagattctgtttgctccacctccttgccaaggcttgttatcttttaccttttttggtaatagccattccaataggagtgaggtgatagcttatcgtggttttaatttgcatttctctgatgattagtgatgttacatatttttcatatactattgggcatttgtatgtcttcttcagggaaatatctattcagatcctttgcccattttttaatcatgttatttgttttcttgctgtttaattatttgagttccttttatattttggatattaacgctttattaaatgtatagttggcaaattttttctcccacattgtagggtggctcctcactttgttgattgtttcctttactgtgaagaagctttttaggttaattcaatcccattgtctatttttgcttttgttgcctgtgcttttgaggttgtaactaatacatcattgcacagaccaatgtcatgcagtttttcctctatgttttcttctagtagttttatagttttgggtcttacattcaagtcttcaatcaatttagagttgatattttatatggtgtgggataagggtgggtcaaattgtattcttctgcatgtggacatccagttttttcaacatcattattaaagagattatccttttctcattggcactcccgttgaaaatcatttgtcagtaaatgtgtggatttatttctgggccctctattctgttccattaatctatgtgtctatttttatgtcagtaccatgtttcattatttgcagtaagtatcatctttttagagtttattactctaacttttcccatggaactaaaattccatttgttgaattcttctgacactagcaccatttacttgcaaaagtaaagtcaaatgttttaatgttaatccattgtttttaatcatgtctttaggggagaatattaaacatttccagagattgcaacagtactttttgaccttttttttttgaagatgtactctctggtttttgaagaagtggtttgcagcacctctgagtcagtcatttttaattattggttgtacttgtaatcctatttccaccctgagaataatttaagtagtgttagaactgtagctgttaaaagtaaatgattttcaatgaatatggttagaagcaagaaaaagtttgccttggctgtaactacacataaagagagaacccatgcaaactcagaggcggacatcttgccaaattgaacctcctatagaagcccattagctgaaagctctgcaaagagcaatgattgcctcaggctgacttctgtgtccagtgctttcttgctatttttcctaacccctggctgcaatagaatcaaatgctcatggtggagagaagtgatgaatgcagccggacacagccaacatgttatttatattcagaaaggcatagcatgttagagcatgtaagggttagatcttctaaaaatcctttcattttgcagatggaaaaactgaatctagaagtgatgaagtcactttttaaggtcacagaagacggctaggtttagcatgaagcatctttatgccttggtactcttaactctaaattggccacccagattccttttatcccgcctcattttatatatctatatctatatctatatctatatctatatctatatatatgtacatacacacacacacatgcacacacactttgctgaccatttcttcaaggtttcaaagaaatgtagccactaatactgattcatatttttccttttgtaagatttgtctgtttttcttttttccttcaaccatccaagaaatgtttactttgatacatactactaccacctttatcacatcaattgcctaatcatttactatttagagtcatgaaaaggcaagttcaacatagactattgttttggtactaggagctaccttccttaatttagcatgcttttaagcacagtttctagaaaaggataggtatttttaccaaactggggaaaaaattattgtaatgacctgaaaattctgttgctcagtttcagtattttattttgcaaaatcagtatcaaatgagtaagcttttaatcttggctgtcaaccatttgtttaaatcccaagtcactagttatttttaagaagttaattttaatgtaagttctaacaggtggcaactactcctaagtattgtatctttaatctttaggtgtattaaaaactgtttaatttaactataactaaatgtattactcatatttaaatttttgacatatttacatttcctttcaatcaaacaacaaaagttttgctgattaattagctcacaagaaaaacactatggtaatgctaagttgttattgaaactggtaataaaatatctagtggaaagaaaagtagcattaagtgaaatgcttggtttttcttattagccttttttgattttcacatattcaccattctcatacctttattttgcgttaggaacttatgcaccaagatcatttcattaatatctttaaaattcttgatatattttactaagtaatattaaactggtatctattttacagtaattttattataccatgaggcatgtactcctaactagaaattacttgtcagtaatacattttgaaagagaaaagtcattttgtcagcgatttgtttgacttcttcaacaaaattcttgttcaatgatattttaaaacattataggttatacaattttgcatgatgtactttaaagtttatgtagttttcttcaaaaggaaaatatgtacaaataatttagtcaaacaagaataaaaaacatgttaaattatcttattagtgcttaaggttacaaagagacttttaaaatcaacaataggcaaaatttgaattagcaaaatttaagatgtatattttacatatttttttctggttagggtaataaaacacgttaatgctacatttaaaaatatacaatgtacattttttaaataacaaaaatgtataacgccaaccagagataacactatgatcatattcagcagtatttcctgctgggtgtttgtttttgtgttttcatgtagacatatacacatatctatttgtgtttggtgtgcatgtgtgtgtgtgtgtgttgaaatagtgaaatgtttttatcctgcttgttttggcaactttcagggtttctttgaatacgtgtttgctgaccacctggatgttgtcagcatccacctgtaaactttgaaagaccagcccctaaaaattttccactttctgccatttctttattcaaatgaagcactcttttagactgggggaaaatattttttagcttctattggtgagttttctaagtatatttctttttctgaacaatgtaaacaaccagtaaattttgtcttgctaaaagcagagcataaaagattctacataatccccagggtatattgttcccagggttcttccagccctttcttctaagtagcttcacatcccattgctcattccctattgtacaggcagtattagaatcttgggagttttatgctctttaatggatatagagtgagaaggtgtgggaaaggagaaacagctttactgcctggggagtccattagcatgaaatagggagggattgatagccttgcttggcagcagtctaggccccagatctctgataaagggggcagacattggaaggtttctagaaataccctcccattcctctctgtcaggttagtgttttaggagtttatatatcagcagtcactgaatagttctccatctagccagctgcctaaagttagaaaaagttccttccagaaactgggaaatctttgattggtaaccttaatttccaatacggttgtgattttgcatcctttttggttttcttggaagtttccatgggatgcttagagggattgagtcaggtgcagctagctaccatccatcatgccccagaaatcacctcagttaattttaatcaaaatgtaaaatatttctgtcagctttctaagaggaatactggcctaatgctttaaaaaagttaaaatgctgctttcagtttactgattataagtagaatattattcgccttcaaagtagccattgttattacagtgttaactgctaagtacttccgccacattttcacaacataattggatgtcttcataaactgtcatactcaagcatatgtcctgtacactctaactctacatcaatacctttagtttatatttgggttcatattactttaatttgttttaattaagtaatgtttcttggtcaattagtatgcacaagaaaacactgtgctaaatatgggctggatatatatcttaaattttgctgattcaaattttgcctattgttgactttaagagtctctttgtaacctcaagtactaagaagaaagataattcaacttgtttttttattctttgataaactaaaaacttatgtatatttctctttgtttttgtaaataaaactgcataacctttaaagtatataatgtaaaactgtataaagctataatacttattggggaataagtcaaacaaatcaataacacaatgcttttttttctttcaaaagttatcaaagcataaaccaaacacattccagaaggaacagatacgtatacaagtaatacacaatattgaagaaagagggccaaagtaaataaaatcattatgtcaaagatatatctgtagtcccatgttcattgcagcattagtcacaataactaagacatggaatcaacctaagtgttagtcaatgggtgaatgtattgagaaaatgtactatgtactcacaatggaatacttttagccttaaaaaaaagaatgaaatcttgtcatttgcaacaagatggttaaaccctgggaatattatggttaagggaaataaggcaggcacagaaagacaaatactgcataatctcacttatatgtggcatcaaaaaaaaaaaacaaaacaaaactggaattcacggaaataaagagcggaatggtgattaccagggtcttagggaaaggaggcggattgtggagctattggtcaaggaatacaaaattttagttagatgggaggaataaattccagaaattcattttacaacatggtgactatagttaataacaatgtgttgtattcttgaaaagagcaaagcgaatagattttatgttttctcaccacaaaaaaagataagtatgggaggtagtgcaaatgttaattagcttaattcagccattccatattgtatacatatttcaaaccaacatattgtacatgataaacatgtaatttttatttgtcaattaaaaataaagaattttttttataaagagagtgaggaggataaattaagagaagctataccatggtggatggttaagaaggagtctctaaagatacactgcctgaattccagtctttgagagagaaccttacctgctctgtgactttaaagaaaaaaagaattagaaaaggaaagaaatgtttaattatgacaaatacagagaggacattagacttcagaaacattggcaaaacaaaaacaattaagtatttaaagactaagttggaattactaaggttacctagtttacttggtgttttcatgctgttcatgataggaacagcagctttccatcttgattttatattttcagagatcattctaaatcttcagttataacattgtcaaagtcaggctgaaaattgttttgttaggaagtttgggtactacagaaaaattcaaggttttatatcttagagatcagaagcagacagtaattctgtgatatttggattatctccaggtacaaagtatttttttttccttctgactgtggtatgtgaagtggtcgttcttaatgaaagcatggcaggagtgtccattttcacttctacactttctaaattgtttttctgcttccactgccgactcatttgaatccatctttataccacttcagagtcatcttttcaaattaatctgataatgctagctctttctgcagaaatctcaggtaacttcatgtagttcacaagagaaaatcaaaactccttggctagatattgtaccaatcaaggtttggccttgacctactttaccttggtcatcccctggtacctcttcactttccatcttatttcctcttagtgcaaactcctgtcactctattaacattgatcttgctaaggtcatgatgatgtttatttgtcaagtcaaataacttcttttctgtcctattttataagactcttactgcacttaacagtatcaatcatccttttatcaagattatcctgattccagtttcctgggtttacttttacctatctagtatttatttagtctcaattatagaatttactttttttcttcttgtataatttcctttcatatggctatttcccaggtgacattctctaacatttcttcatttattgtacatattttccctaggtaatcttatcctttctcatggtttttgataattcatgatgatgatcccaaatctaggtgtttagtccatgtctccaaaaaccagtaacattcctacatggaagctctatgagcaccttaagctcatagttgactagatacattatccccaccttcaatttttttcaatttttagttcccagctcacttggcagaagaaccattcacgtagtcactcaaactagaaccttgaaacttaaccttttctcttccccatcctgctctccttatgaattctaagtcctgacagttattcctctctgaatatttctcaaatccatttcctcctcatcatctacacacaactactctagttcagacatccatcgtctcttctcttcatagcctcctaattggactctttactttcaccttccttaaactcatcctcctacatgctccttccatcaaattaacctatttaaaatccagatctgattatttcacttcctaagacatgttgaagaactagagttccttgctaatactttttaacttatatttactctaagattttgaactttctccaaaaatgttttttgatgcatagaatagatccaacttacctaacatgttacataagactctctgtaaacccctcagacttatctttggccataccaatcctaattgttctcctggaaatttgtgctctgttaacctaatattgctggagttcactttacacaatattttctttctttccatagtgccttgatttgtacttttccattcctctggaatacattctttatccatcaatgatatcaaactctatgccacgcttggctatctcttagtcattcattgactgttagcccagcctcatctcaagacatctcccctgaccctcctcaccaggctgtgatatacacattctaactgagtgtcttcatagcactcttctatgcctttttcataatttttgcataactgtacaaaatttattacatgaccgattcccccagcagtctataagcagattcattactgcatatccaaagctaatatagcatctgccatgtaagtgtgctcagtaaatatttgttggaccaacttgtagagaagctaagctcttcactctttcatgatcattacctcaactctcattctgtagtccttgtgtttccttctgacttctcctctcttcaccgctatgggattcaattcggcctttggaggattgccctgcacctccaagcctgctcctccatcctatggcccacccaaaccttttggctgcctctatgattgcactttctgctgtacaacaaaattaggattcgaggtatgtgcttctcttttaagagtatgcattttattagatgaagactatgttttaatcaactccacatccttaccattaagaagagtaccaggaatacagtaagtacataaccagtgaagaaagagtactctgaccagatggcttgaataggaaaaaaatggttaaatactataaaactcttagaataaattataatactaattctaatcaattttcatagatgaatgtattataattactatttgactatacattgaagttatttttaaaagagaagcttaaagtgtgaatgtaagttggacattacttttttctaacttttctgtgaataacatatgttagcactaatgataaacgtgtggtgaagattgtattaaactatataactcaagactacacttatttacatgacgtttcctgaattattcaaattttcacatataacctatgaattatttattaacctctcattttgatcatgaaacactgctctggcattcaaaaaccacagtttcttagggtatttttatcatcaagatatttgcttaaccatctcaaagtataaaataggcaaagggtggtttttgatacttctaatcttcccatattgcatttgtatttccctcagatgacttttaagtagtgagcaatgttcaataattgtgtcatttactttcaaatttatttagtttattttaaactgacagataaaattatacatatttatcatgtacaatatgatgccttgaggcacatatactctgtggtatgattaaatctagctgattaacgtatacatcatctcacatagttatcatttttgtgggagaacttttaacatccgttctcctagcgtttttcacaaatacaatatatcatcattaactatagtcaccattctgtaaaatagatctttaggacttatccccccatttaataaaatgttatatcctttgaccaggatcttcccaaccctgcaccccctaactgctccaacctctagtaactacctttcaactctctacttctctgacttcaacctttcagactgtacatatgagtgagatcatgctgtatttgtctttctgtgtctggcttatttcacataatgtcctccaggttcatccatgttgttgcaaatggcaggatttccttctttttatgactgaacagtattctctgatgtatataaccatattttctttatccattcatctactgatagatacttaggttgattctattccttggctgttgtgctgcaatacacatgggagtgcagatatctctttgacgtgctgatttcgtcttatttgtagatatatccattaatgggaatgatgaatcatatgattgtcctattttttagttttttgaagaaccaccatactatttcccttaatggctgtactaatttacattcccaccaacagtatacagggttcccttttctccacatccttgcaaaacacttcttacctcttatcttttgggtaatagccattctaataggagtgaggtaatatctgatgtggtcttaatcggcatttccctgatgattggtgatgttgaactttttttatatatacctttcagccttttctgtgtcttcttttgaaaactgcctatgtgggtcttttgcccatttttactcggattatttgttttcttgctactgagttattcaaggttcttatatggtttgggtattaacaccttatcagatgtacagttgacattttgttacagttgattacagttgacagttgatattttctctcatcctgcaggttatctcttcactctcttgagtttttcctttgctgtgcagaaactttttaatttgatgtgctcttgtttatctggttttgcttcttttgcctgtgcttttgaggtcatatcaaaaaaataattatgtcattttttacataaatcttttagtttcacttataaaaatcatcctgtgaatgccttaagtaagttattcctgtgtcgctctactatttatgcttgaagtaaccactaagctgctgttgcttccttaaccaagcaccaaaaatctcaaggtggcagctaaaaaagtaaagccaagtaatatggctgctttatgagagcaccaatcctttctaaaaccaagaacaagattactcagcctgatgacctccagtatccctctaaaaagacaatgcagggtctgggtaataacccccttgtttttgagtgtcctaacaatttattttcaaaattgactatggcatttctatatctcttcttccccctagttcttttattgtcacctacaccattttaggcattacattttccacaacttttgacctgtgattttagtctgacaaatgtaattacttgtgaattgttgaaaaaaaaaaaaaagaaatgtgatagcatagctctaagaatttttaatttctatttttaactaatattttttgttaaataaataatattgtttgtggattcttaatacatattaattataatcaattcagtgtataataaagtcataacacttatcatttccttaaagaagcagtcattaataatcgaaatccagggttaatttgcacaaatcatggaactcacatagcataaatttttattcgtgattcttaaagatgcacctttaaagatttaaccttttttgttaatcagtattatgacaaagtaggtagcaaggtgcctggttaagatataagaaaagccacagttttcaggaccatcatttattttttgtgagtgccactcagggcagctatttatgtatgtgttcaataatacaaaattcagaaatgtctagatgctttggtggcatagtaagatatgagagcaaaataggatcacattatatagtgaaattttctttcctccatgtatattttatctttcacttttatcataagctgtgctttccattttcaagtcttttgttgtagttcaaatgaaaaaggtttccttgagagaagtaacaaacttggacccttgatgcttctgatgggtataaatgataccattattcaaggtttaaaagaaatgatctttaagcataaagctggcattattcaatctgttctcactattcatctgtttgcctaattaaatcttgtctgtaacaaagtgcttagaaaagagaattgcttacagaagatatttctttctgaaaaatcatacaaactggactcaagtcagaggttaaattgacttattaattcaatgtatattgagaggagggtgtcttgctactttacaactgtgagaggcatacaaatgcaaaacaacattttggtgaaaatatgacatttcaggaaccaaaataagtagaagcagggttgaggaagtagggaaactcctgcgcagttgctttccgatggtgctaaattccactggaaattgtacttttggtgcatacatgcaacattcaaagttgagtttacacatctttgtggcaaattacgttcttttttttaaagacacatttattccgcatcatgatcaaactattacatttagcaatcaacatcaagggtgcaaaaaatatctgcattaaaaacgttcactggaatgctttacacaaaacagaaactaaaataacgtgttatacaattggtcacaaatataatccttgagattttggcccatacacatgagtattgtctaaaacacatcttctttgacagcagcaagccctgtcaccactgtgcccagctgaattcacaactgtgttgtaacccatagcttccttgtcacttctctggctctcttctcctgctaaactttgtttcctggcagtaattaagatcttctgccactgccatagctactgctgctactggaaccaccatgaccaccttggtttcctggttggcaaagtattggcctccatgaccacaggaactagagcttctgcctccaaagtttctacccttcattcatccaaaatttgaagattgaatcctatcattgccaaaattgttgtagcttccactacttccgaaactgcttccattattaccaaatccattatattcatccccactgccaccatatccactaccaccacagctgccaccaaagccacacagtcactaacgtttcctccatgaccaaagttgttattcccccgaaaccgcctccatggccaccaccaaagcttttaggaccactttgacctcttcaactgggtgaggcactagccatctcttgctctgacagggcttttcttacttcacagttgtggccattcacagtaaggtgtttctgaatgacagccttatttatggagccatggtcatcaaaggttacacaagcaagaccccttttcttgccactgcctcagctatgatttcaatcacttcaatttccctgtactgttcaaaataatctcttgggtgatgtccttcaatgtcttctttaatgccacccaccaagatctttttcaaatttaagtgggtacctggtctttgagaatcttctcttgagacagctctctttgtttccacaactcttgcatctgcctttgcggccttgcgttcatggctacatccacctcctccacagtggcatatgtgacaaacccaaagcccctggagtgctgggtatttgggtttctcattaccacatagcctgtgagtgttccccgtcacccctcagactcacattaacttttttcaaagcttaaccctctgatgcagagcttctgcagctgttcaggctctttcaaaaactgacttcgacatgacaacagtggcaagggagactttaacaatgctttctcggcagcgtccatgggcaaaaagggcaaattacactctaattaaggcactttacatttgtgaatgggaaattttcagaaggccaaaattgtttttctttcaattagagattgtgcagttttctctccttttcatagatgtagctgtggaattaattgctgatgttagaagctctgttgttgtatgaattaattaatttctgtcttaaaaacactttatgttttttgtctttcaggcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtgtaagtataattttttaaactttaaaattcctagcagcttatgggagttacatttcaagagactttgaacttaagatattcctggaatcttattgcagaaaggacattttagggaatagcgtaatgggttccagctcaaagttcatttgaaacatttttagtaaattaactttgacaatcaataagaattttcattagattgaatcttcatatcttaaaggatctttttcagtgagggaaaaacatacattttataagagaatgctgggactttatagggaattctcaacatatgcaaatttggtattcaacatttcagattcactgtcttgtagatatagttccctagtaagtgtgagcttggctgccatctctggaacatattaggctccatttgcacttcctattggttccttctggtactgatggatagtggcacatcctctaagtaaaacatggcatgtgtttaaggagcctacaaaaaacaatctgtgcctaattaaggctgtccatctgacatatgcaaaggcatcaagaatgcattgaaaagtagaaattcagggaatcaaaggagccccaagaattcgtctgttgcatccatcagtgtaactctttctctgcaagtatactgtaactgaaattggcaagactggaaataggatataaactaagagtatttctagtaaagtggtaagagtcagaattaaaaatgagtggagatggagaagagaggatagataccaaaggttttcagggcataaaatcagcagcctcaatagcatttggtatgtttggggacatggacagggagggaaggagaagatgcctggaaatattcccaggtttctggtcagggcaaatgggtaggcagtagcgctgttcagtaatcctgtgagacaggttttttgttctctttttttttttttcatggaggaaactaagatcagttgtgggaagatgatttttcatggcacaatgttgtttccactgcacttccaatttagtttactgaatatatttttgttacagagtatattgtttagaaatcaaattttgagttatgtgtcatagaaaagaaacagttgagacacagcaaataaaagagtgaaaacccaatagggaaaaagatgtgctcctgtgtttactctttttctgtccttttcctctgaaagagaaatgcatgcgaggtgtatgaagtgaattagaataatcaaaggaaagtataattgttatttaatgccaaatcaaataaaatgccagtaaaggagactactctttgggttaggagttatgcagtttcactttttgttgaaatttagcaagtcagtttagtcgtctaagcctcagttcctcaacatgctcaatgaagaagataattcttactttaacatgtttctcaaatttaaaataatgataaaatgagataaaagatggcaagccagttgataaaagctaaaagtgtcagtgtataaaatatgagaattttgtctctcctgccttacctacagtataacctacagtatcagctacttttgttagacagattgactcttgcagaagctggaaccaaagaacgttccctagccagttcaacaaaatcctgttgttaccaaataccagatcatagaacagctttgttataaaaacctcatcttagtaacagcacttgctgtcttgggattttacctataatataaagcatgctgcactatgaaattgttttgcttctaatattccgtctgtgtatattgtgaagaaaaagccaacatcatggaacattgagcctttctccctctgagaaagatgtgtttaagtgattaatatccaccataaaaactacctagaggaaaattagataacatgctcctttacttcatgttgacccaaagaagagacagcagattgatttcagtacattttagtatttcagtggcagtgtagttataacaaacttccttttgtaaatccaataacttattatagaatagggccaaaagaaagagaaatgtttcttcaaactacatcagaaaagttggtgatttggtatataaatttgactatatttttctagctatcaaaaataatgccatttgatgagtcaaatatacctaagtatatctcctgcctctacattggaacctcaggtttttattcacctaactgttaaagctgattctgtcatctgggacacattgacaattatatgctcccttcttgatccttctcaaaggtgcatagcccacacattttgagactccaaaccagtagaaaaagctttcttacctatgagaattgtaaaacaaatctttaagaaaagaaaaccattttacatttagaccttttcaagtataaatcttatttgaaatcatgatgtggatgaaatatgttcaaaaataaagtgaaaaggacagaacccttgggtgtacagaagagatgcaagcaaagtttacctaggaaaatggctagaccaattggatgacagtgatttttttttaaaatgtgattttatcgcaccattgcactccagcctgggcaacagaatgagaccctgtctctaaaaaaaaagtgataactgtaaaaggtaaggtaaactattttgggaaaagggtagtatatcatataattaactgtcatagagagttcaagtaaaatggagaaagaaattagcccattgaatttggcaagtagaatgtcattggtcagtgaagcaattgaggttgaagcctgatttcacgaagtttgttcagtgaatggcatataacaagcttgtccaacccacagcccgtgggccacatgcagcccagagtggctttgaatatagcccaatacaaattcgtaaactttcttaaaacattgtgagacttatgcatgattttttttattcctcatcagctatcattagtgttagcgtatttcatgtgtggcccaagacaattcttctttttctattgtggctcatggaagccaaaagattgaatatccctggcatagaagcacagttatataaattaaagctcaattattccataaatatgatacagtcattaaaaatcgagtttttatggaagaggttcaataattgagcagtgcccatgataataataaatgaaaaaagtatgctaaaaaactctatatgcaatttaattccaacattgaaggcacacacacacatacatacacacacttacacacacacatacaggtttagagataagactggaaggaaatgtggtcaaataccaaagacatagccacctagttgggttatagctgacattttgttggttttgttttgtatgaatctttatacaacagtctttttgttattattttactttaagttccagggtacatgtgcacaacgtgcagttttgttacataggtatacttgtgccatgttggtttgctgcacccgccaactcatcatttacattaggtgtttctcctaatgctatccctcccccagcccctcacccctcgacaggccccggtgtgtgatgttcccctccctgcatccatatgttctcattgttcacctcccactcgtgagtgagaacatgtggtgtttgcttttctgttcttgtgttactttgctgagaatgatgtctaaaattttttataaaataccttaagtctgtattaactttataacaacattctgaaagaaagcgtgaaattggatgaggaaacagactattctttcaaggaacttaaatcagaagataaaaagagagattgggcaagggtaagaaggtttttccatataaaaagagactttatttttattatctgcttgggtagggatttttaaactatttaataaggtaaatataaacatgtttatagagtgttaggaaaggagttagttgcaagagtgaggttgtgaatttctcagatgggagaataagtgactataagtactatctcagaggaaacgaaggaagtgcagtcatgagggcagaaggagaggctagcctttagaatgagaaaggacaaactctgttctgaaattcaaggaaatagtgtgagagtccttgcagagaacactaagcttttgatatagaagtgaaaagttggggtagttgtaccttattttttaatccttctttaaagttgtcaggaaagacaagtgttgctcatttacaaaacaatgggctgtgaaatggttgcagaggggaagggggttggtaaaagtttggataagctactgaggggaatacaaaaaagaatgtttcagggacatgtaaaagaaattcctagtaaactgaaagtgtcatttgctgttgggcactataaatgtgttgtcacaattcttgtgacagtgagactttcttagagtgtgtcagcatcctgatgcttatctactaggagataaagctgatggttggattgactctaggctgaaattttgcagaaaagaggccatgggaaggtaaggaaattcatataaagataatggggtgaaggtaaagtgatttgccattagctctagtttttggtaagtggaaccatgagaagcatgatggatagcaagagagaaggaggggagaagtggggaaagggacagagagagtggaagagagaaaacaggcagagacagaggattgtgggaggaacatattaatagcacctttcagttaacattttgcaagggaagtctcaggtccaaaaggtaactcagggagtagattgttgaaaattgattgtagaacagtggtatgctacaactggctggtacctgctcatgagaactgatcagtaaattttcaggaatattgcaagcttgttaaacacagccatccttgaaattggacatattaaaagtatttacaacatgaaagttagcaaatgctaaaaatcaaggctttttgctttcagagagccactttaccagcgcatcactgagtataaatgttatttggagtccagacaaagaactttactagataaagtgtctctatgtgtgttgaacgcactcatgggtagatcaggagttgaaaagtaacaaaattccatgaggtgggaggcagtcaatattttaattttgaaggtgtctttaggaaatttatttagtgaattatcttgaaatacaaatatcaaataaatcaattgtaaaattaatatttttgagctgtttatttacttgagtatatacatgctcaatatatataaccaagtataagtgatatttttattgactgaccaacctctataatattttctttctacacatttttggctgcattttctttgatcacgtcatatgacaaaaaaattgaaatattatttttataatttttttttttacttagctgagttgacatattttttaatggacgctttagaagagtttatttcactttcacaatgccacatgcgttttagtgattttcataaaatttgggaaaacaccaattatttttttcatatgtgatgtaaaagcaaaaattacagctgacaaagttaaacaggcaaggcaaactttattcaagactattgcaatagggaagagaggccagagctcaattagagctcaactccactgaaatgaaaggcagggctgaaataaggagaaagtattgaaggatgatagtggggaggttgatcaatgggatgtaaccagtgcactgagtaattttgagtctgtaattttttcttctgcgattaggccatctttgtttgctaattacaggcatggaagttagggtcctatcttcccaaagagggtgggaggtaggagtgctctctccttgatgattacatttcaaagggaaggctcccaagtctttcagaaaggcattcttggattatgaaactggcaagaggctttaaaaaatatttccatgtgaaggggcagaaaaagaatttactgttacaacttttctaaataaaatgctttaagaaaagggaggtcgagacctagagtcaggaagaagcctatctaaagtttaaccaggctgaggggaaggctaagcgtgtcttgatcagtgaacaataacatttcaatgcttttcaagttttcctgtgaagcgactctttaaatatactttgaattgatgaaatttattaattattttgtcattgaaagcatcattttagtggcctttcataatagtatgatatttctgttggtatcagaattaatctcaaatcaataagagctataaatatatgtccaatatgttcatgtttaacactaattgaattatttaaaaattaccaaaattgcctatgcattacttctgtttgaaaagtctttcttaatgaattgctgtttttggtatgatctggaaaaaaactgttacaatttgcttgtcgtgttctgaattatttttatcttattcctgaaaattttacaaaaatctaagatagcatgaatacatagctagcacctcccaggggtgctaaagaaggtgagggctgaagagcttaagcatcattagcttctggttaaattcatccctgctgttgaagccagactttgagaaagaaagaaagaaaataatgagagatgctgaggatgatgcagaggttatcataccccttccttacaagagcttttccttccagggttccccaaatcctggggggaacttcctgaaggtgcacactccgaggagcaactacctcttccccctgcccatgggccaaatgcagtccactaactcaccaactggttttgtaaggcccataagctaagaatattttttaatattttctaatgttgaaaaaaaattttaaagactgttattttgtgaaacattaaaactatctaaaattcaaatttccacatccataaatcaagtttcactggaaaataatcatgcctattagtttacatattgtctatggcagctactgtgctatagtgtcagactgaatagttgagacagggttggcaaagtgaaaaatatttactaactagccctttgtagatagtttgccaatccctggtctagttattctggtcaactaattaaaccaagttttttttttttttttttttgcttggatttaccttttatttattttaaaaatttatttaaatttctaattggatacgtaatagttgtacatatttatggggtacaagataaattttgatacatgcatacaatatgtaatgataaaatcggaataactggaatatcgatcatctcaagcatttatcatttcttcatgttgggaacattccaattccactcttttagttattttgaaatacacaaccaattattgttaactatagttgccctattgtgctaccaaacactggatcttattccttgtaactgtatttttgaacctattatagtatttattattatttttattattgatttgccccctgctagacatatgtggcccttatttaataaaaaaactgaataatgtggcagttttagatattgtgccatgtcccttggggaaacattttttaatcacccagtctttcgttattccacaaatcacaccctacaggcagtaggcttgctctgctctgcaaagggaatctcactctagttaaatagaaatgttgtaaataaaattaaagttcaagctgtcctgctgtttaaagaatctctatgaaaattcaatcagcagcatacttttaatttcacatcatctgatgttgttctggctttcagtgacaagaagcccagcagttttcttcacagttttctattttccttgaatgtaaattttccagctaggcactgaagactaggtagggaaaccaaatgtgtgaactttatcagtcagaaatcttttcaactccatgaaacagaaactcatgaaatacatttaactaaataagatttccccctttgctccccaactcatggaacctaagtccacagaggtagggaattcagagctggtatagctgctcagtattgtaatattttaaaagagtgggcagatggggtaggatggatgtaggcaatccttttttttttccattcgttctttccattttcatctaatgggcatgaaataagcactctatcttctggaggctattagagttttaggtgggaaaagggaagaaacacagagggcaaaagttgaaaagtctgaatgctatacctaacaaagaattatacagcaaacactaatgtaacaaacactatctgccaagcactctttttaaatctttcaaaacaataagtcattggtagtatggtagctgggtctatttgatttaataagctgtctacatctcattggccaaaaccatggcatgtggtcatccttggaggaaaagaggtcgagagggtgagcatttcatatgggcacatttgacatatgatattcttttagtaaggaacaatggaagaacggatattgggcagacaaccaccaccatttgccccagtgaatataagagggccgatgatttgggccacagtatggttgatcagtcacttcaactgtcttgatggtttgtgccaatcacagagataagataaggcatccagagatgttacacgaatcacactcactttgataatcgtctaaatgattaactttactgtggcctaaactaattattgtagtgattcttctccttttctatctggattgagggccaccaacccaaatgcatggaagttggagagttaagaaaggactgtatagcttgcctcatcccctgggaaggtataatggagagtggcagagaaagatctaagacgttcaactcatctgtattttctgtagctttgttgggataaagggtcttaacctgcctaagaagattgcatgcttctggaaggcagggctcatttcttaggctcctttattgcctccacagaggttaacacagagatgatactcaaactttcttatactgatgtataaatctgatgatggcagtttattcagaaaattggagtttcagcttaggaacaatttgtcacctcctgttaatattcagctcactccatcgagatcagtgacttcgaggcataagagttatataccccataaatccacctcctctgtgaaactactgagaaaagctttcatttttgtcaatatcctccaaagtgcaatttggtgtttacagaatattaatgttggcaggggcattttatgtcatttaatcttacctctcccattttattttttgatgagaaaactggaattcagaatagtggagtgtctacctataaggtttgtatgtgtgacttttatgttttgactttgtttttgtttaatccacccaactttaaccacacacttaataagagaaaagctctttattctcaccatcttcaaatacttctgttaagaggacagttcaacactgatactgcatcaagtggaagcaacagaagttttttggctgcatgtttctactaattttagcactaaatcatacacagcctttaaaagcaattgatcctttcagatatgaagtctgcatttgcttccaaaaagaaaatattttttccaattggttttgacaaaaacaacacctgctcccacttccgtaggtggtagaagtgtaaaaaactgtaatatattgtctggagaaggggcatgaagtacaggaataaaaagaagaatgggttgcattttctcttgctgacgcattatattgttgtgaattattacacatagagaaatgtactggcaatttatttgtctgatctctttctacaaaatgcaagtctctagatactttgttagaacagttacacatttctcattaatcatagagaggaagtatgacttattgaaaagaccatgaatttggtgtcaaagagacctgagtttgaatcactgctatgccacatagtaactttatgatcttggacaagtcattgatatatttgatccttcctttctataaaatagagacaaaactcagaattattatgaggtctttagagtggtcatttatttccattctcctattttgtgtttgctttgtacagagggaaaaattcataaaactactggaccagttacataactctttgaggattgatctgtcaaagtatagggtatgtacaaatttacttgcctaaaagaaaactgttgtttggtctagagaatttcttgccatattgtaaaaattacccatcatgtaatagaaaaataaaaatattgatctcaggtgctgttacccttagaaataatccagcaggtctccttttttgttcagattctttgccccacgtagactacaacaatactctgtgtgtgtgtgtgtgtgtgtgtgtgtgtgtgtttgtgtatgcacttgcagctttaattttgtaatttttaaaatagccatcagattcaatgaccctcagctaattcatgaagtagactatggcccagtcctcattttgaaagctcaccctttgttactgaaatactctgctgatatttccccaatttctgagcttcctacttaatttactgcttcattctctttcctcctggatcgtgataccaagagtaccatttgttcctgcaaagctgcccagaattcattgtcaacaattctatatatcacctcctggggaaacacatacacataccacaaatatattcatgtacatatgtgcataagtatacacacatataattttagttacaaaatatcttagttataaaaatttagttacaaattttagttataaaatgtctatagtaataactaatagatgctctcttgtatcttacattctttaataatttatcctaaacatcttttcttattttaacatatctatctcccatgcattcatttttaattagtcttttattgacagatactttaattgcatacttatggaagttataataccaaatttaatttggtattatttcatgttggttatttcatgttggatctgggaccaacataatgagaagagaacaaccattaagccattgagagagatatttgggggcaacaagggcctgaagccacctcattcaccacctcatcataggcacactaaccctgttcaagttcatgaatatctcgtaattagcgatggttttcctaatggctctttagaaaagcatgttaacatgtgaaattgaccaaagtaaaaattgtttcttagttcaaacattttatcattataacttttcattccttcaaaattataaacatctgtatttttaaatgatgcttctcatcaaacctcgctaaaagaaacctttttttaaaatccatagtatttcaggaaagactatatgatgcaaacttatttttttaacttttaaagtttttttgtgactaaaagtaaatgcagcacatgtataatttccgaagtattttttaaaaagtagttatcttgagaaaatcatgaaaattttttcctatgtatgctatacttaatccttttagtagcaagactattttagaagcaagcattaataacatcataacattgtaataatgatattgttttgcatttattgcattgttagtgtaaatagaagagtgcagctttccaagagtaaaaatataatatttccaaattgtttacgttctataatgttttatgacaaaaatattttaagaataccttgagtatttttaaaattgtatacagtttactttccattttctttcatgagaagctagttttagtttattttcccactagaagtttactgctgacaaccttatccattttgtttcctaattaaccaggaaaactttcctgcaagcaatactgaaagactgcaagacctgaaatcaactgttgacctgttaacaagtatcaccttttttaggatgaaggtatctcattttatttctgtcactgttttgttgtgacatagaatacattcatcccctggtaaagtcttgctttaccctcctcttgatcaagtactgtgttaactccatcgattaagctgtactatctttgcctgaactcgatgaatcttccaatataaggtatagtgaagaagagattatcctagacacttaaaatactctgatacatttggctctaatttagttctcagttaaatttgtcttagagaaagctctctagtaagtggatgtggcacttaaaaaatttccaaagaatgttaaatggaaatggagttcacttctaattttagttttaacttagatgttttgccgacttttttgctacaagaaagtagctgactcttttaagtttaccccaattgtggcaacttccattttcagcactgggaatgtctgtgtaggaatatatttgatcacctatctattggtataattggctaggccttacaaaccaggtatttctttttagatatatcatttctgctttaattgcgagttttcggcagtcatagttctggcttgcagtgcaacttatgtaaagcattttcagaaactacttgccgggctgtgggctaaaatatacactctttgaaagacagtattacgatgcttattcagaaaattcctaaatagcaacaatttttttctttgcatttgcccataatttttttcactagaacctctaaaaatggcattttgtaataaaagagagacacaaagggaaaccatactatatcaaagttcatttagattctttaaagttgaattaaaattcatttggtttaaaatcaggctaactaggtgattaggataaatagaatttacatcaattctaatctactgtcagtagctactggaacaatgtgcagctaatgatggcgagacccaatcaagttgacttagattgacaagtgatgtctgccattgacactgaggagtgaggaatgggagtgagggtagggtgtgccagcacagtgctacccatctaccatgcctccttgtttaaaaacactatctccttaaacttgtaactattcttccccaaccctcactaccagttgattactttgcttcctatttcaatgaaaaaaaaaataggaggaaagaaagaggagcatcctcaagctccaatcacatactcccaccacctaccccagtaggtacttccttgtatgtgtccatatattctttcttttttagtattgatgagccatctgttttcttagaaaatgtggtctcttctactggtgcaattgattttgtcttctcttgtgcactaaaatattgttccagcaatcctctccactctcctgaattgccaactttcccctatgtatgtgctattgattttacagtcttcaaaatactgcttggcatcactttcttctatagctactaccccagttcatttcccttaatagcaaaactccttgaaatagtcatctatacatttctttccaattaatttcctcctattatcttttgaacaaattttcttctcctgttattcttttttctcattgcagagagtaaaaatcactcttttgttgtacagtcctattagttttgacaaatgtgtagtcatataaccaccagagcaataagatacagaacagttccatgagcctacaaaattcccttgtgctataccattgttgtcaacccttctcccacatgctggtaaccaccgatttgttctttgcctgtaggtttgcctttcctagaacatcatgtaaatgaaatcatacacgatgtagcataacacaatagagaatcattggtgttgaatgtatcaacaattcacttctgttaattgctaaggagtaattctttgttatgtatgtgctatcgatttatccattccctcattgagagatgtttgagttatttacaattttggtttcttacaaataaaactgttttaaataagcatgggattatagttgtaaacatatgtttttatgttccttgggttaaatcctcagcagcagtgtgtgagagtcccaattgttctgcatcctctagcaaaactcttgggattttccatgttatgtatgtatgtatgtatatatttcttattctagtagaagtgacgttgcattatcttaatgtattaattttatttgtctaaaaattaataatattgagaattttggaggggttgattttctatctgaatatctttttttgtgaagaatgttgaaatttttacccatatttattagctggttttcttactgttaagggcattttaattttaattattttaaattgatagataaaattgtatgtatttattgtgtacaacatgatgctttaaaatgtgtatacattgcagaatggctaaatctagctaattaacgtatgcattacctcacaaagttatcatatttgtgaggagaatatctaaaatctactttcttgcattcttcaagaatacagtagtctcgagttttgagagtttttatatgttttgaatacaattttttgtcagatatgtgatttgctattatttttgccttgtttgtgccttgtcttttaattaatcttaaaatatctcatatagcaagtttttaattttggtctactttatcattttttttttctaattatggataatgctcttggttaaaccaacatcacaaagaggtttttttggtgtgtttcttctaaaagattggttttaccttttatatttgggcatattttttatttagaattttggggattgttttgctggttgtttttgtttgatataaggtgtaaagtgtgaatcaaggataacattttacatatttatgtttaatagttccagcagcatttattagaaagattttcctttctccattgaattgctttcatattattgtaaaaaattaaattgaccatatatgtatgggtctatttctgaactctctatactgttcaattgtttgtacatccaccactaccatcctgtcttgattactgtgaccttatagcaaatcattaaaaaagataatgtgcatcccacctcgtttcttcatttttcacaattgtataggtgattttcattccttctgggattttaattgagattgcctttcatctatagataaatccggagagaactgacattttaacaatattaaaacttcaactctgtccttagtttttgaccacactgtaatcagacttttactctctcacttcaccaaaaataatttgtcaacatctcatgttttatttctctcctataccattggctcttttgggagcagggtggggggtactctctactgctttattccttctcatttgtctgttgtcacagatttagaattatgtaagatttaaccggatttatttcttggacctcttctcttcactatccatactcaaccagcgttgtttctttatattcttctgtaagctaataatttccaaatttatatctctaaccagaacttttccacaactgtagattcatttatccaaatatcttcttgaaattcatatatatgcctaataggcttcttaaactgttcagaattgactcctgagctcccatccacagtttttcccatttaaattgaagtcacctcccttatggcagttgctcaggctaaaatattggggtcaactggagtcagctctcacaccagtcatccagtctgtcagaaaatcctgttagctctttttttctaaattttaccagaatatgatttcttctaataatttctaattctaccaccttgatcaagcatcatcttctctagactaaattgtaacgctgttctcataattggtctttctatttttttcatagcccactttaaggcagcgtaagggagccttataaaagttagttgttttgctaaaattaggccattttgctcttatgcttaaactatccagttccttcccacctcgctaaaagctaagatttttatagtggtctatatgtagtttccccttgttctcaccctacagcttcatttactcttgccgtttattgtattaattctattccattgaaacgcttcccatccttcctctgttttacttttcaacatgcatcatcatgtaatatattttacgtatttattttattatctacttgaacttaagcccatgaggaaagggatttttgtttctatcattcattgctgtatcaccattatctggcatataggaagtgatgaatatttgttgaatgatggaatggaatgaaatcaatgcatgaagtactaactggtcacgttaagtgtttttatttgagtgtttacagccattatcattttcaataagtttttatatcagaaagttaaaatgtttacacatttaaaaccacatggtaagatgacacttactgaacatagaaaaatcgactgaaagtatttattgaatatatatttgagtagtttatactagattacaatgtgtcactgttgcatttgagaaaataaatgtctgtctttgtcaggttctggagctgcaaagccccccaaaagcgagcatggtggtgaaggactgtgtaagggcttgcctggattctacatacaagtatatttttgacaactgccatgaactctactcccagctaacagacccggtaagaaaatatgtatgtcttttataatcgccacttttgtttctagtatctgtttccataagtttagcataatagtaaatagaaaagtatgttcatttaatttcacattaactgcaaatttgagaatttccataccttttcttcatatttgaatatcactttcacatacatgaactaattcgctccttaaaataactttatctagtaaaggcacatattatttaaggttttagctggagaatcagtttcagaaaaatgaagacattttctcaaggtcacaaggtaggtaattggcagatttgggactagacattaggattccaactcctgtttctatgtccttcccctaactcatactgcctcccatatcattttattttatttatttgttttttgagatggagtctcactctgttgcccaggctggagtgcagtggcgcaatctcggctcactgcaacctctgcctccggggttcaagcgattctcctgcctcaggctccccagtagctgggattacaggcatgagccagcattcccagctaattttttttatatttaatagagacggggtttctccatgttggccaggctggtcttgaactcctgacctcaggtgatccgcccgcctcggcctcccaaagtgctgggattataggcatgagccaccacgcctggcctatatgttaatttattaagaaatatttcaaaaatacaatttaaatcaaaaccacaatgagatacaatctcacagcagtagtaatggctattattattattttaaatttttatttccataggtttttggggaacaagtggcatttggttacatgagtaagttctttagtagtgatttctgagatttcggtgcacccatcacccaagcagtgtacactgaacccaatttgtagtcttttttccctcacacccctccgagcctttccccagagtcctcaaagtccattgtatcattcttacgcctttgcaccctcatagcttagctcccacttatgagtgaaaacatacaatgtttagctttctattcctgaattacttcacttagaataatagtcttcagttctatctaggttgctgtgaatgccattaattcattcctttttatggctgaatagtagtattccattatgtggagatatatatatatatatatatatatcacagtttgtttattcactcgttgattgatgggcatttaggctggttccatatttttagaattgtaaattgtgctgctataaacctgcatgtgcaagtatcttttttgtgcatggacttcttttcctctgggtagatacccagtagtgagatttctggtttaaatggtagttctactcttagttctctaagagatctccacactgttttccaaagtggttgtgctagtttacattcccattagcagtgtagaagtgttctcttttcactgcatccatgacaacgtctattattttttatgtttttactatggccattcttccagtagtaatgtggtattgcattgtggtttggatttgtatttccctgatcattagttaggttgagcattttttcatgtatttgttggccatttgtatatcttcttttgagaactgtctattcatgtccttatcccactttctgataagattttttttcttactaatttgtttgagtttcttgtagattctggatattagtcctctgacagatgtatagattgtgaagattttctcccactctgtgggttgtctatttactctactgactgttccttttgctgtgcagaagctctttagtttaattaaatcccacctatttatctttgtttttgttgcatttgcttttaggttcttggtcatgaagactttggctaagccaatgtctagaagggtttttctgatgttatctgctagaatttttatagttcgaggtcttagatttaagttccttgacctatcatgagtagatttttgtataagatgagagatgaagatccagtttcattttcctacatgtggcttgccaattatcccagcaccatttgttgaatagggtattctttccctactttatatttttgtttgctttgttaaagatcagttggctgtaagtatgcgggtttatttatgtgttctctattctcttccatgggtctatatgcctatttttataccagtaccatgctgttttggtgactatggccttacagtataatttgaagttaggtaatgtgaggtctccagatgtgttccttttgcttagtcttgctttggctgtgtgggctctgttttggttccatatgaattttaggactgttttttctagttctgtgaagaattatcatggtattttgatgggaattgcatcaaatttgcagattgcttttggcagtatggtcattttcacaatattgattctacacatccataaacattcagaatggctattattaaaacatcaaaaaacaatacatgctggtaaggctgcagaaaaaagggaatgcttatacactgttggtgggaatataaatgtgttcagtcactgtggaaggcagtatggaggtttctcaaaaaacttaaaacagaactaccatttgacctagcaatcccattactgagaatctatacaaaagaaaatcagtttttctactaaaaagataaatgcactcatatattcatcacagcactattcacaaaagcaaagacatggaatcaacctaggtgcccatccatggtggactggataaagaaaatgtggtatatgcacaccatggtatactatgtagccatcaaaaagaatgaaataatgtcctttgcagcaacatggatgtgtccggaggtcattatcctaaacaaaataacgcaggaaaggaaaactaaatactgcatattctcacttataagtgagagcttataaagatgggaacaatagaaactaggcctactggcaatgggagagggcttaaaaactcactattgggtcctatgttcagtacctgggtaaggggatcagtcgtacgcaaacctcagcatcacacagtctgttcaggtaacaaacctacatatatacctcatgaatctaaaataaatgttgaaattatttttaaaaatttcaggaatacaaaaaaatatagaaaccaaatcaaacatgtatatgcttactacctataaccatgttaacattttccaatatttctctgctcttgtttaaagacattaaatgttacacataaaatagtattttgcttgggaggccgaggcaggtagatcacgaggtcaggagatcgagaccatcctggctaacacaatgaaaccccgtctctgctaaaaatacaaaaaattaaccaggagtggtggtgggcacctgtagtcccaactactcaggaggctgaggcaggagaatggtgtgaacccgggaggcggagcttgcagtgagccgaggttgcaccactgcactccagcctgggcgacagagcgagactctgtctcaaaaaaaaaaaaaaaagtagtatttcgctttgtatttcccaatcccatcctactccttttttgtccattggagatggacactattctaatattggtgtgtttgaacgtattttcacatatgatcaatgaacgcttgagttttatgttctgtgaattgcctgtcaatcttttgtgtgtgtttctcttggttttcttgtctgttacttattaatttatagaaaaatctaaaaatattgtggatactaatccttttttggttatatggatttcatagattatttccctcttgatgacacatctttttgttatattgaagttttctaatgcatactatgacatatatagctattacttctataaaattggattttacaaatgtagtctagcttgggcaacctgggcaacatagcaagaccctatctctacaattttttttttaattagctgtgtatggtggtatgtgtctatagtcacacctacttaggaggttaaggtggttagagtgagtccaggaattggaagttagagtgatctatgattgctccactgcattccagccttggtgacacagcaagaccctatctctatttaaaaaaaaaaaatgtgtctatcacctgtcctttcaggaagagtgcacttggtccactagatattaaaaattgtgtaattatccatgaaacattctgtttacttgggagaggcaaattctagaaagcaatgttagatgaaggcaagtaagactcttccaaactggatttttagctaggtttcatatagtatatttctggggtcactgttttttgtttttgtttttgttttttttgttttgctttataagaaaacaaattaagctgagtttggcattgcataagcaaaacaatatataaccacatacttgttcataactttagcttatcaactctgttagatatgcttagttttaaaacttggtcctccaggatttctaggagctaaattggtgctcacttgtactttcccatgagtagttttctaatgacttttctttgtctaatctctactttccatcttcctcccatagggctctttcaattcttttacatttttcaacatcattatctttattttacctaaaggctaagattgaaactttttattgtaccatgtaattacccatgcataactttttttttttttttgacagagttttgctctgtcacccagactggagcgcagtggcgcaatctcggctcactgcaaactccgcctcttgggttcaagtgattctcctgcctcagcctcctgagtagctgggattacagaggcccaccaccacgcctggcttattttgtatttttagtagagacagggtttcaccacgttagccaggctgggctcgaactcctgacctcaggggatccacctgcctcagcctcccaaagtgctgcgattacaggcgtgagccaccgcgcctggccccatgcataactttataatcaatcttaccagactttaccaggttcagtttcctactcctcacactcctgaaccaaactgctctgctctcatgagccctaaattttataatttccatgaatcagccatcctttttcacatccttgcatttatgcatcctgttctatatgcctgaagaaattctccctccttccctgctttcatcaaaatccagctcaaatatgatctttgtcaaagaaaaaattattcattacacccattaaagaatggtaaggcagactattcaaagagtactattacaatagttacacaggaaggctaccccaataggattttatagtagaaaagagaaattgggctcaactatgaataccacaaggaaaagtgggaatttatagccaaggagctgagttaaggggaggggcttactggatagaaattactaagagttaacatttggggtaagggggggtcctggctaacagatctgatgggattcttgctgaaggcagaccagggtgatcaaatatcaccagaagcattgtagaggaaggaaacctgatcagataccaaagtgtgatcatatatcaaaaatgaaaaattctggctaaactgagaagattcttgctaaattggacaatgcagaaactaacatggaagttcgaaagttggggcctggttaaaaagagagctcagaagagtttgatcaaagtttggtcaaagagagaatctttatcatttcctcatctactaattaatactcagtggattaattaagctgccaaagtgaagtggcataccttacttgatgtctttctaatacataaataataacaacaacaatgataaacgaacagtttatttctgtaagagagcttcgtaggtagttcccataaagcaaacgtgcccctaacaaaaagtaaatgaattatgtcacatcaaaataatctaatatagcttaatattttatgacttggctttcagaaaagataattatataattttcttactggttttatttttaggtagatagatcttagattttatgcgaaattttgtcaatgtagggaatgcttggggctaagctttaaatcttggaaaaatactttttcatcaacattgttattatttgaaattctaaaggaagcatccattggagctgaattatttagggggttaatgctctctcgagcccttttgaagccatctaggaatacttcatatgattaaggcttatctcccctcagttggctgcaactccatgctcctaagagctcaagttaagacctttttgtcttatagcatacgtctcacctgtcttcaaattctaattatttagttcaaaattaaataccttcatttcaaaatatatccagaatcagaccacttttcaccagatccatgcttctaccctggctcaaaaccataatcattgttcacttggattactacataacttcctaagagagctcaatgtgtctaccccatcatcttatgtctgttctcaacagagcagccagaattattttttaaaaaaggaagtcagattatatcactcttctgcatagaatgttttaaggcccttcatttaagttaaattcaaagtcctacaaaactccacatgatctggcctatgttacgcttctcacccctcttactctaatgctgtccccttgcacatgtcaccatgtgactggagagccaatgaagagttgatgtgcagggaagtaatgtgagcaatgctttacccctgctttttatgacagagacagaacttaggacagtgccgagtaggtgttcacaaaagcatttgtttaatgaactgaatacataaataaactgatttttctccagtaatacagtaagaaattataggtatatttcacctattataaacaagattgaatgaagtgccctattctgtggtagactctcagtgcttgcctaaagcctcttgcacttactctgggtcatgtggcaggatcccagatgaagagatatgggaaaagtaaatgaaggccacttctagtcccaacccataaaaacatcttgtcacctgcagtgcaataacctggaaggatacatattgcagatggcatagctaccaggtggtgaagggctgcctagtcagcctcggactttgggtgtttaagaaataaccttttattgcattaactcacggatatttggatatttatttgttaccatagcacaatctggcttattttgactaatagaacttcagttacttttccaacctgccaccccactatatatttaaaatatatccatgtttacgtgactatcctatttataactctggaccagctccccatttactcagaggatgaagtccagactctcccattatccacagtgcctctaaggtctaagccttgattatcactcctgacttcaacatcatctccacattgcattccatgattcagtacattaaactccatggtgactttgcctgccttatatttacctgcctggagcgggcatcccttctccaaacttccctccaaacagctaaccgcagctcagctaactttttcttcagaaagcctttatacctcttctagctggatttggtgtttcggttctctattctcataataccctgacatgtcaccaccactgcacttatcacggtgaatttatcaggtgcatcatgtgatatcagttagacctgtcttcccggctaaaccgtgagtttcatctttgtattcccagtgcctggtggtatacctgactctgagtagggttgataaacgaagtaattatctaataaaaataacatttaaagaaaaaggcagtgccttagttacttatttgtagtatccttcagtgactctacattaaaacctatggtaaggaacataatctctgatattaaaacccctgagttcaaattacagctctacttttcagcattgtggactttgttaagctatttagcctcttcatgtctggtttcttcatcatattcatgctacttctgttttctttgaatcttctccagataatatgatgccttgcctgaaacaagaaattaagaattccagcactattagacacagtacagtctgattatttaaatgtggaatcatactttctccctccagagggattttgaagaaccatataaaaataaaatgcttagaataagaaaggaaaatcgatttgatagaaaagtagagacagctgcagttagaacaagatagaagtgtggtctccggaggctggctctgcactcggtaggtggtattttccttggctgaattgccaggctccgcatctgcacttcagtttagcttaggaactccaatgtgtcagtgtagacagaggtcactggactcacagagaggtacacaaaagatcaatctataaactggatagatatctatccagcagatacctaatcagccctattatatgccaggcactggtgtaggctcttaggacatatcagagaacaaacgatagtttctttaaaataaaaaataaaatttcaaacagattgaaagtgttttagtttatactctcccaggtgaacatctatgtgaaaataaaacctgtaatccgaaggttattttaggaacctggaacaagagcaggatgaattagctggataatattaatagtgattattgctagcatgaacacatccattttaataaaatctacataaagagaccccctaattgtggaatgaggaggatagataagactttctttttaaatgtgttttaaaagaattatgctgagctaatgtcagcattaactcagttccgtggaaaccactcagcgaaagaacttttctgttgaacaatgaaaacctttattaactgattttacagtctccctccacacctaccctgagatcaaaacttgtttacacagagatcatccacaagaagatgtcaaaaaccaataaaacctttctgcctaagattctgctattttaaatttatatattttggtaaattttaagttgtttattgaatgactacctaagaaaattgtattaagatatgccttaactaaaacacatgtacacttttagttctgaagcacacttagggactttttaaaatcttattttgaatctgattagaaggtttgtaactaaaaacaggaacaaacgaaagttcttgacattcatgtgatgatttcttttgaaaatcatttctccaaatgactgtgttttgctataaggcagcatgagtgatacagatagatgaatgcagaggaaaatgtgctacctacaagtgggagttgtatgtaaaatcagtagaaacatatttctctctttattgacttttggatacatacacacacacatgcacatatatgcttagtctctttgtttccctcccaagtcaaattctctcacttcttatctcaaaggaaatctctgttatgaatttcttattagctttgatgaacatagtttcatctttgtgtacatttattacatatatctattatttgtgatacagtctttatctctatcaacctgtgatataatacattttagaaataggtaatacagtattattgttgtatatactaattctagaaccagattgtctaaatgtaatgattcttctataatttttaaagctcaatattaatttttgagagctatctatgctgattcatgtatgtacagtttgttgatttttacaactgcctacagcatgtacagcaatttacacatcaattccgatttttcacaattacagataaggctgcaatgaatatctttgtagtaggtgtgtaaaaaattcggtatggtctcttaaaggagaagggaatatcctcctttcctctactttttcccttccgctagacagaatgtggacctgattttgagccatcttgtaccatgtggacagaagcaccctttacttttcacatgcattaaaataccttttgtctgatacccatggtaacattgagtttagtgaaaacagaaactctatttatcttaatattgaatttgtagcatataacactgtgcagagatcaattaatgcttactaaatgaaaattctatcaaaaaacatctctttgtattagacggaatgtgatatgtataccacaattttggccacgttatcctctgaaaattctttgagagagaaaatatcaccgtagaatagtctaaaggggcaacttacctgaatttaaatgtggaaaatttcagaacgtccatgcttgttttgtggatgtatctttctcagttattttaacccaaaaagttgatttagcaatttgtctttttccctttcttttggttttgctctagccaatttctaaataattcagcaatgaaagaaaagttaaaatgtgccctgaaatgtacatgtagaaaaatatccaattctgtaactcttaatttgaaacatgatttaaatagtaatcattacaaaactggctataatatgtccctgacttttcttagatatttttccagcaatgtactttcttatgtaatcattggcattagttagggaatgatgtttattctgaaagataggtgttttttaccaccttatgtgctccttgtcttagttctaaatctgagtaaatataagcataacttagagttaatatgtttataatttgatatatacaaatatatcaaattataatttataaaatatttatattttataaatatataaaatatcatttgatattatataaaatgtatagaataaatgttatgaaaagaaaatttctttttaaatgccagcttcatgactagtatataaaattttacttgtaacaagaaattgttcaaaatgagtagtatattgccatgtcttatgtattttaaagaagaaaaatatatgaaaattcagagcctgaaaaatgactagccagttatgcttctatcactatatgctttaattttcataacaaggtaaataaagtaaaaaatgaaaccataataaattctgaaaatatcaataacatacatagtatgttgtattagtaaaactagtgaaattttgattctaaaactgaattatgacaatacatgaaaaaaattataacctcacgttgttaataaacattgatgagaaaagtctaagtaaaatattaaatattaaagaacatgacttggtcaagtaatttcatctcatgaatgcaaaaatggttcaacaataccaaaaaaagatcaattataaatttaatggtgatatgggacattggaaccttcatgcactttcagttggcaagtaagccgggagccagtaatctaactctgggtacatattttcacaaagttcaccaagggcatgtttactaggatattcaatatagcattgtttgtgagactgaggagatggaggcaacccaggtatctttcacagaaaaatagatccataaaatgtagtgggtacatatcatggaatattgtggggcacttaggaaaatgggttagatgtctacatagtaacatggataaaaagtaaaaacagtgataagtggaaaacaagggaagaaacataatgttgtatattagcacaataatattttccttttttttttttgagacggagtctcactgtgtcgcccaggctggagtgagtgcagtggcacgaactgggctcactgcaagctccgcctcctggcttcacgccagtctcctgtctcagcctcccaagtaactgggactacaggcgcccgacaccactcccggctaatttttgtatttttagtactgacggggtttcaccgtgttagccaggatggtcttgatctcctgacctcgtgatccgcctgcctcggcctcccaaagtgctgggattacaggcgtgagaccccacgcctggcctatttttctaaaatttagataaatacacaaaacaataataaacattttacaagactgaaaaaaataggcaaacaccaaactcagtatgtggtcttatgtaagtcaaaaggacatgaaattgtagaatggtaattagaaagaaatagaaagataaggatgacggatggaatgaatcggcaggcagacaggaaacttgcatgatctaaattcttaaacaaggttctaacctctcctccaactcaaagaaaaaaagagtaagtctaaaggtctgcagtaaaatatgctatatttgtggtatctctggagtcaattacctaaactttgtataacttttcaattgatatgaatttagcatctaacaagtataaaactcagatttaatgttgactctttctgccccacgtggccatacacgaaattgaaatggcgacctctgaaattgtgtcgtgttatagccataaaactgctgtagtggagtcaagaggtataatcaatattgtgtcatgtgatttttattttaatgtgttccttcttcagaaactttcattctttaaagatggttttccttcacaaatggtgataggaaaaaatgaattcatctacaatgtgcttctttatattataatactatcaagtaagttgtttggaacatataatatttcactgaagactatagtttgagttatttcacttaaaatttttctatttttcacattgtgactttgtataatagttacccaggaaattgatgagtcttgaatctgttagttttaaaatatagttgttgattgggatgggacattttagtaagtcaaattactccaagctcctgaaaagtccagtaaacataataaattggaaacataatttttttttacaattgtttgactctagtatttcccaaatttcctgctgctaaagggttcttggctacttcagaaaatacaggatatccagtgaagtgcgcaggaatctgtattttttaacaagttagtagaatgatacgtgacattaagcaactattccattaaatagaactttgtcactatggattctgatattctatttactttttagtttttctttttagtaagtatctagagaaaaacttgcactgaaaattaaactgtgaaaagaactacagtatgtaaaaaatctgtttaagaactgtttttgcctaatagtctgtattatttcccaaggcttgcgctcctcttccccagcttcccagaagttacacagttctttatataattccttttaaagagaagaaaatggtagatgttacttgtattactgaatccttggtaaaacaatacagcaattaagatcaacacggaggcagtatggtggagtatattataaaaccctccagtgtaggaattttatctctcttgctcaccaatgcattttttatatccaacctaacgcttcacatatactaggcattccataaatagtggatataatagttgccatttttatttataatacatgtgaatcaaaaccataagattttaattttaattttagttttacaactcaactaattataacaaattaacaaatcactcagtagccactgttttctcatctctaaaataatgcaatatcttttgtctctacttcagaggtagtagaactctgattctaaaatcaggaggtgtttacacttagggaagcatctagtgaattagaaagtagtgtagaaacataagtaattaaaagagagaaatatacagagatagaattaaagttaaaatatcatttactcagtgatttcattgaaatcttggggtgaaagttaaatatgaaattttaaagcaagaggtcaggaactctaatccatctaaaattctctctatatggttaagtttaatgcatttttaattgctattttcagccttccaggaaatactgatgtagttattctcatagttttgattttgtttatatattgtgattatacaaatatataacacatatatacatttatataattatatttatataattaatatatattttatataaatataattatataaatgtatatatatatatagagagagagagagtgagtcaggttatcctctctgaagaatattattggtcataattgtttaattcatcaccagcaacaaaatcatgtgaataaaatggtgttgcattaatgaaatggtatctaatgtgctgattagacatagtctcttttattaaaagtctcatattttgtagcatgtttcttctaaagttcctgattcgtcagaacagtgtcaaacagaaggcataaaacaaaaatacagcaattaattatgctaaattctagaatatatatgtatttttgctatcactcataagtggtgtctatatataatctctgatagatggctagcaaagacagactagattgtaataatccagtaatccaatttccccttgctctctccagaacaagttaatggataatggaatctcaccaggaaatgaattggtccctttctttatttccatgatgcgttttattttccttaaatatgctatatggctctctatagaggtgttcaattttgttaccattccttaaaatatcttattgaaaatgcagtttatgtatcctgttttattgatttttacaattttatctattgaaaaattctatctttgagacgttcttctttggcaatggtgaaaatggccaagaggaagcattcaaaattatgcaggaagattagttttgagctttctgtctcatacaggaaaaaggatttaaatgtaattcatttattcacatatatacaataaataaaatttgttgacttcttgttgtgtaccaaacactaagaataagagaaatttcagtgaacaagacaaacacagtcagtatcctcatgggactctagccagagaggtagacattaaaaaaattattagaccaataactgaaatagtgtcagatgccaggcaggcagggaaaatataatgcagtattaaaagaaaaacccatcctaatctgggatgtagggaagagtagaatttaaaataatatggtttctgttagaaatacatccagacagactctgctggaggtggtaattctggagatgtgtccctacaaagaccagggaaatgtcacaatcaatcaatcaatcaataaaacaaaacaaaacattatcttactttcatttaaaatcccagtgtagtagtacctagaattctatagacagttgtatttttcatcgcagcgaagaggtacggtagaatcactttcgttgggcttctgctaaaactatcttagctctttcatctgtactgtgcctaaaccaatggtcaatcatctggcctcatttacttaacctatcagaaacatttgttattggccactccatccttcctaaaatactttattttctaaatgtctaattgctattcttaccagctttcctctgacctcactgactgctcccttttgaattatttgccaaatgccatcctctaccaggcctgtaaatgttagaactcctggggttctgtccttggcttttactctagctacaccgcttcacacacaaaacagtcccataaaaacttggaggacgccaaccaattgaaaaacagagttgtctccaggccaggatgaaggaggcagacccttttgctttgattctggaaacagctcttacaattcctagggaagaattggttgtcctgcctgcttcatgtcagcaaataaccttgttttgttttggcaaggagtggatgtcttaggaagagatgcagctttgaaatcaaacccacctggattcaaatagaggctcccatcaattaggaagctattgagtcttggacaagttacttcgttcttctaagcctcaatgttttcatttagaaaaaaaaaaggataacaataattgctcatagaattgctgtgaggattaaatgaaagaatgtttgtgaatcatcttactcataggtattcaggagatggtccttttctttattccatcaatacttgccttgtttttgtgctaaattcactgaccagacaggagtttgtgctataacaccatgcactgaaacacaaacagtttttgattcggtgctgcttctactgattctgttagccttataaaaatggaggagattataacacacaaaatacatagtttgctggacctaccaggattactctgaaatgcatatactgtcactctccatctgcttgcaaagcatcttccaggtatttggaagcattggaatgtgctctctaattaaacttggcactgacagcctataaaaattactggaaatgtacttcattgtgcttttcttctttttggccacacagcttctggaataggtttccttcagtgatagtaagaggaacaaggttgtacaaaccaaagtagtacttccaactcaaggaatatctcaactttactgttactcaaagaaaacaacttaaagatcagtgcccccaaattctgcataaaatgtaacttggaattaaataatatgggaatagttacttgctatggtttgaatgtttgtcccctctaaaattcatgttgagatataatccccgatgtggcagtattgacagatgaggcccttaagaggtgattgggccacaagggctctgcccacatgaataaattatttcatttatgaattattgtgttagtgggcgatcataggagtagagttgatggctttattggaacaggaagaaaggcctgaactatcatgttcagcctccttgccacgtgatgccctgtgccccctccagactctacagagagtccccaccaagaaggccttcaccagatgttgcccctcaaccttggacttctcagcctctgcaattataagaaataaatgtattttctttataaatttcccagttccagttattttgttacgatcagcagaaacaaacttaaaactttacttatgtaattatcaagtatcaaagacaagcaagaattagaattatttctatgatcatgcagtctacacatgtcatgtttcatttcattatctctgaattaatcttgatttttaatctcactttgctttttttttgatacagagtctcactttatcacccagggtggagtgccatggcgcgatctcggctcactgcaacctctgcctcccgggtgcaagctattctcctgcctcagcctctctagaagctggggctacaggcacgcaccaccaaacctggctaattttttgtatttttagtagagacggggtttcaccatgttggccaggctggtctcgagctcctgacctcaagtgatgctcccacttcggcctcccaaagtgctgggattacaggtgtgagccacagcacccagccctcactttgcttttaattccagttttatttattaaattttttgttaatatatttctcaggcacataatttaaaagatttttttttaaagtataaagtaaaaattatccttctcatactttccccaagtactcagcctcccctcctggaaataaacaatattatcacctttctgcatatcctttcagagatactgcattcatacctatgtatatatatgctttccaaatatgaacgtgtcatagatgtatatatagatatgtttgtatatatgaagacacgtacacatacagatatatgaatcaccttttttacacaaatagtagcatattatacatactctactgctctgtgcttcatttaacaatatgtctttgaaatggtttcatctccaatgcactaaaatattctcattttttatgtctgcgtggtattccactgaatggacatttcacaatgtatttagcctgcccctattggtggaaattcaagttgtttctaaggttatgttttcacaaatgatgctagaaagacatgatatatatctttttgtaactcataaaagtatgtatcaaataaaattcaaaatgtgtatttgattgatggaacaaatgtcatatagattgggaattttagtagataccaacaaattaacctccaaaggggttttattaattttcagtccctccggcaatctctaaaagtgttttttttttccataccttgtccatatactgttctaccaaagatgtcttagtccttctgggctgctataacaaaaataccttagactgggtaattaataaacaacagagatttatcgctcacagttctcaaagctgggaagttcaagatcaagatgcccatagatatagcgtctggtgggatatgctctctgcttccaaggtagtgacttcttgctgaaacctcacctaatggaaggggcaaaagcagctttcagcctctttcattagggcccaggtctcattcataagagcagagttttattatttgataattccccaaaaattcccaactattaatcctatcacattgagtattaggaatactttagcaataaaacatatgattttttgtgggatacccaacattcagaccgtagtcattgtcttaatagtttttacaaatttgatagatataaaaaattattgctgaggaatttcaatttacatttatctaaatattgataagtttaaacatatttgtatattaaaaaggcacttcaatgtttaatcaaagttttcttcattttttattgatttatgtattctgatctataggaccttgttctattttaaggaaattgcactttgtcttgataaaggattcaaacataatttctttagattttgtttaaatttctttagttttttttgaagtttacagtgttaattgtatcagtttacagcttataggttttatgttatgttgtaaactacagtccccactttgagattatttttaaaaatctcatccgatctttccgtctagaatttttagagtatttttaggttaaatgtgtatgactcacctggaatttatttttatataaattgtgatgaaaacattgtcttaaagcagtgttttattataaatttcaaaataaaagataattatgaagtatagagcagaatcaaatcaacaaatgtttttgctttgcattctctccatcctaaaaaacaacctggaatatttttaaaatattcttattttcttccattatccaacaggactttctgtacattgttttcatgaaatattaaatttgaaaatatttgttaagctcagctttaggaaaaaataattttttattctaatattatttgaaattcttaaatttttagcattatacatttaaacatactttttgtacactgataaatattcttaaaagataaagcagaaattgaagaggtttcagcatatgcgtatattaaaaaataactttaagcctctaaagttagcataaaattagacatattaggaggtataaacgttttaggagaaagtaatctggggagataattactgagaaatccaggggaaaaatacaaacacattccttcaacctttcagtaaactgttctttggtttccatataaatttcccttgctcttggagtaggacttacaaaacacatttttcacatatatatgagaaaaaacacacacatatatgtgtgtgtgtatttatgtaaaccattattttatatgtgtttgtatgtatgtatatacattaatctttattattatcaaaagcccaaaagccagtgagacttgcctgtactaatcatagtgcacaaagatatctattaactctttttatttaaaaaatatctaggagtttctgcatttactcagtatgcaatcgagctttcctagcaccatttattaaggactatcttttccccggtgtatattctttccaacttcgtcaaaaatgagttggctgtaagtgtgtggatttctttctgggttctctgttctatacctttggccaatgtgtctgtttttatgccattaccatgctgttttggtcactacagctttgtggtatgttttggggtcaggtagtatgatgcctccagcttcattctttttgattaaaattgctttggatatttgggtcttttgttgttccatacaaattttaggattggtttttctattcctatgaagaacatcattggtattttcatagggataacattaatctttagctccctttgggtagtacagacatttaatattaattcttccaatgagtggacacaagacacaaaatgtcattccaattatttgcatcttcttcaattgatttcatcagttatcttatagttttcagtatagagatctttgacctccatgtttaaatgtatcactattttatattttataactattatacattggattacattcttgatttgagatagtctgtaattggtgtgtagaaatgcaactaatttttatatgctaattttgtatgctgcggctttactaaattcatttatttactggttccaatattatttttgtggagtctttgggattttctgtatttttaatcatgctgtcctcaaacagggataatttgactttctcctatccaatttggatgccctttatctctttctcttgcccaattcctatagctaagacttccagtattgtgttgaataaaagcagtgaaagtggacatccttattttgttccataacttagagacaaatgctcccaacttttcctaattgagtatgatgttagctgtggtttgtcatatatggcctttattgtgttgaagtatattacttttatatctaatttgttgaagatttttttatcatgaaaaaatgctaaattttatagaattttttttctgtgtctactgaaatattcatatttgattttttgttttttgtccttgattctgttagtatgatgtattacgtttattgatttgcatgtgttgaaccctccttgtattcctggcatgattccatttggtaataatgaaagatctttttaatgtgttgtttaatttgttttgctagtgttgagagtttttgcatctatgttcaacagggatattgtcctatagttttctttttttgttgtatcattgtccggttttgatatcattgtaatgctgactttataaaatgagttgaaagtattcccacctcttcaattttttatgatgaatttgagaaaagttaatatgtgttcttccttaaatatttgataattcaatattattggcaaatatttattagccgtgaagccatcaggtcctggactcttctttgatgggagagtctattattgcctcagtcttcttccttattattagtctgttcaggttctctatttcttcatgattcagtcttggtaggctgtatgtgttcaggaatttatacatttcttatagatttttccacttgttggcatataattgttcacaatattatcttttgtatttgtattgaatcatttgtatttctgtggcatctgttatgatgtctccttttatcatctctaattatgcttatttgagtcttctctcttttgtacttacactaactaaaggtttataattgttgtttattttttgaaaaccaagtcttggttttgtttttcatatttttaaaatctctattttatttatttttgttctgttctctgttatttcttttcttctaccaatattaagtttagttggtttttgtttttctagtttcctaaggtatacctacctttcttgatgtaagtgtttattgctataacttccctcttaaaactgcttgtgctgtatctcataggtttgggtatgctgtgtttctgttttcacttgtctcaatgaattatctaatttcttcattgacccattattgttcaggagcatgttgtttaatgtatatgaatttgtacagtttccaatattccttttgttattgatttttaggtttttccattgtaatcagaaatgatacttgatattattttgatttttaaaaatttagtaagacctgttctgtgacctaacatatgatttgtactggagaatgtttcaagtgctgttgagaaaaaattttattcagcagctgttggatgacattttctggaaatgtctgtgacatctattcagtcttgagtgcagtttaactttgatatttctttgttgattttctgcctgaacaatctgtccattgctgaaaatggagtactgaagtaatctactattattttattgcatcaattcctttaagtctattaatatagtatttatatttttaggtgctctgatattgggtacatatagatttaaaattcttgtgtctgcttgctgtattgacccctttatcattatataattgccttttgttcaccatgcttgacataaagtctgttttatctgatataagcaaagctactttcagattaaagaactcaccttagcatttttcttgtaagatagggctagtgttaaggaatacactcagcctttatttgcctgggaaagttctctctcctgtatgtttcctggatagcttttcttagtacagtattcttggttggcaggtttttgggttttttatttttcccatcagcactttgaatacagtattccactctcactgagaaattctctgaaaggtgtattggggctgtgttgaatgtgatatagttctctgctgttgctgttttaagtattctttatttgactttggttgataatgtgattattatttgccttgggaaattcatttttggcttaaatttggttggcaatctctgtgtttcttgtacctgaatgctgtcatctttctccagatttgggaaatattcacccattatttgcttaaatatgctttctgggtcttttcccttcatctccattaggaatttttattaatatttggtgaaacttaattcacttgatggtggctcataattctcataggacttctttactcttttctattcttttttcttttatctcctattttgtatattctctcttcaagcttgttaattatttcccttctttgatcaagtctattgttgaggctttctaatgtgtttttcaggtcagttattgtattctctattcattgtattcagtattcttcaattttaagatttttacttggtgtgtttttacttgtgtaaatactatttctttgtcaattttctcattttattattagattattttccaaatttcatcagttttctatctatattttcttgtgattcccctgaacttctttaaggagataattctgaattttctgacagacatttcatagatactcaatctgtgccccttgctgaagctttgttgttttcctttggtgatgtcatatttccctgagtttaacaatgcttgcattgatgtcttcacatttgagaagagaatcaccttgcccaacttttgcagtattctttggtggtattagacctttactacttagtaccaaaagttaatcctttgcttccgattctggggaggacttacagcgagcactagaactaaaacactgcactggaactaaactgctaccctacctctctttcctggtttgagtaagacttactctgtgagttgaagctgaaatgctgcatcagaactgaattgctgctctgctattatttcccagtctggggaagacttatagagagtacaagaacttaaatgctataccagaattatattgctgtcctgctatttttttctagtctgatgaagacttaagtggcaccaaaacctaattccaacattttagttatttctaggacagaagaaagattcacatgaacatctgggtttgtaaaaaaatatggccagggatttgggccttcctgcatattgtacctactgtagctctatggctccagccagtctccttactgtggcatccatgctgattagagggaagaatagctgccaagatctgtgtaccactcactgtgataaaagacgtactctttatccaatttaccccaggtgattgagccttcctggcactcccagtctttccagtgggatggaactggagttggcttcccatgaagattatcagaccagtggagagattgaatatccacctccaactccttcctctcacctcagaacccacaggtctagggaaattctttgcaaatggtgttatgccagcttggaggagggagcagcacagactaaaatgactatttctcctactggtcatgccttctctcgatactgtaggcccaagagatttcttcattactcccctgaattcagggtggtgttcctgtctttgaatactttctaattatatttttgtgggagtagtgatacaagggaatcttatattccaccatcatgctgacataacttttctcagtttttttccattgcagggttcacaaaaacggagttatagaaccataacatcactttcagatatatacatccttaggacccactcaagagctactgaatcagaaactcttgaggatggggtccaacattctgcatttaaacaagtcctccaggtacactctaatgatcgaaaatcactcatctactgcatgactcagacaaataaagggaaagttaaaatgtggaaaatgctctgagagaaaaaaaggtgttctacgagtacataggaggctcacataatccattggggatagacagatcatgaaaggcttctaggatgagaagaaggcatataaagaataggtaagttaagtgggaaggatgtgttagggaaaagaaggatggggcatggtgatggacaaaaggccagagagaatattgcaaataaagaaaagccccacaagtgcaagatctcagagataggagaaggttgatgcctttcagagctgaaaactgaagcaaccataaccaatcacagtgctgagctaatcacaaggtttgttttgtttgcttgtttttgagacagagtttcactcttgttgctgaggctggagtgcaatggcacgatctcggctcactgcaacctctgcctcctgggttcaagtgattctcttgcctcagcctcccaagtagctgggattatagacacatgccagcccacccagccaatttttgtatttttattagacacggggttttgccatgttggccaggctggtcttgaactcctgacctcaggtgatctgcccacctcagcctcccaaagtgctgggactacaggtgtgagccacctcacccagtcctaatcatgaggtttttatcgaggtgaatatgtcacaagtcatttgatactagtatcagtgaaagtcataaggactgaaaattatttccttttactggtgacaaatcaggttaaagaagaaaagagatgttttgtaaaccaagttaatggatttggatttgtcctggaggaaatgtggagccactaagaattttaagccgcagcatggcatgatcagatatgtgtttataaaagtgtatctgactacagaattgagaactaattggaggggtgagactgggagcaagtagaacagctatagcaacagactatttgggtaagctgtctgtgttaaatttcctgattttctcttgctaaagaattcatttacaaaaatatgccctagctttttgatgtatgttgaataaaaataatacatacagaaaaattaaagtctaatgtcttaaataaggatttccattttaaaggtcctgagcaattatagatatttgttaaaaagtaaggggaactaacaagcaattttcagtatattaaaaagcccaacaagtgtcatacatttgcgtaaatgcaaattaaaaattcatggttttctttttaatttggggcgaattacatcaattcagtacaggcactctagtgatttagtgctgattggaaactccagcttgacctttacatattgctggagaacagaaacatcagaaaatgagctttttgcttaacagatgctatatgaaagaaaaaacaatgaaattcaatggtagaaaaataaatccatgtgtcttgatagttgaagattacaaaacatgacatttaatctattttataatatagctggacccaagtgaattaggtagtcatctaagtatttattagaccaaaaaatgacccccccccaagaaaaatttaattgcatgaaaatagcttaatttttgagatagtcatattttatttataagtatttacactcagagctgctatgagagggaaaagttagccaccaacaaagctcagagacatcagaatttgagcagggtcccaaatcaatgctcgtttttcttagatgtagggagctactggggtttaatgtcattttgtacacatttaaattcaatttagtatcatcttttgagtggcaccttcttttggaaactgactgagctgatgacagtttatacttttagtgaagtagagtaagacttcactgtagtgacttttttgttggaacaaactcacacaaatctaaataagacatccaaaacctttatggaaaatagtgcccactagaagtgtaatatagtactgactgtacttatgatattcccattaaatgacttaatgaaccttattcaatgtaatttgtgtctagatggtgccggtaacacacttagctagtgattgattctcactgatgaatagctgtgtgaattagaaaactgtgaatgagtctaattatagtatgctagagctactgctagatgtacataaaaacgatcaaactcgggcataaccactgtgcagatgaatgcttttccatatgtggatgcttacactagcgctatgtctatggcaatagctctgattagattgcaaagtagcccctaagatggcacagctcaactgccattccaattttgacagcctttttttttctttttgccatttagagagagaaagaactccccgtcagatctgcaaagctgcaaacccagccacaggcttggtctgttttcttggccctctcagtattttcctgcgtcctttctgttcctgacttggctcaatgcaggctccccactgagatcattttctctgtataactcttccccttctggccagctggtcctttttggaggctaagtattttgtatccattggaagtctccctctcattttcatagcaccttggggaaaggtgtttctctgattattgcacaaggtccctgaatttaaagtagttttcctcttttttaaaaaccactttgttgaggtatgattgatatatttaaaaactgtacatattcagtctatacaacttgataaatttggggataaatatacacccatgaaaccatcaccaccatcaaggccataaacatatctatcacctcccaaagttttctttttatttgcccaaattaatttaactaatattcataagatatcttttgtattacgtaggaatttgggatggcatataagaccatgttgatttatgattttatgtgttaactatgagccttgggagactcaggatttatgatgaaagagttggagtctttctagtgggcccttatatgacaaatgtcctaggctcctcactggcactgctccccgctcaaaaagaaaaaaagaaaaaaaaaaaaacttgacccaagagacagtcccactttgtgaacatcgtatattctttagaacttttttagttatactatgtcttcctgaaggttcagtacttggactgcttatcttagttgtaaaatcatcgtgagtttttataagggaaggaaaatatatcgttttcaattctccatcttgaagacccttagaattatgttaactgttgtgacctttgcagcacattcggaaaaagtgttccaggagagtttgtgattatttaattgttccacagaagaagagctagttgggatattgcttggatatattattttatgtcctatttttattaatgactccctttaaattacagcatctctctgttagatgaaaaggccttatttttatttcaaaagcatcgtttattatggttattctgttatttagaatttattgcagacatttcatctacatataatttgggtggtgcattttctagttgctatataacagatatatttccataacgtggcaaaatgtaaagaagctggcagcttggggtatttatgttcagccctcttcagattttccttatggttttacagatatgaattgtaatcatgctttgtactttgcctgagattcattttccagtccaattttaaatccccaggaaaaaaagcatttctacctgaaaacattttactgtattttagttatgtgcatatgaacacacatacacacacatacatccatcgatatgtagtacatttaacccactgtagttttttgttattttttttgatatcttaggtttacaaggtttgtgtgctaaaatggtaaatattatctattaaatcatatttttagaaaataattaactctttgacccaggatattaacagtaattgagaaaatcagggttggctggaagaaacaaatctgacctattgctggaaataaaaaagagctctcagtgattttttttattaagcatcatcttggcaatgaatggtgttttgttaatgcagcgtttttcttcatttttctgaaaaatggctaacctatcttaaagcagatttggacaactcttgactatatgcatggaatacactcagtcctctggtggctacaaggccctaacatccctgttacagcacagcaggatactattccttaagagccagttagaccaggaattgttgagctctcacacaactgtcttctcacaggaaaactggatggctgtcattgaacctcaggggatacagtgaccttatgatgcatgtaatttaattatgcataagatcaggcagattaatgacatgacacttatttattaatttaaatctattagtattaaaattgtattcacattaatatagtttctcagaagctatcagaacagaaagtaccaataaaacagaagaaatatgccaacccctacacactttatattccaaaccaaccaaatagttcttcccatgtatggctcagattttcctctaaccttgacttttctcattaaaaaggtagtagctctccctgcaactatatttacattttccaatcctacctattcataaaggcacaatgtgaataccatcttttctgtaacaaattcttgatagatttaacagtaaataatttctccccacccttaattcctatttgggagtttattccactttatgttactgttattttttgcaagtcttagctttcccattatgccacaggctctttgaagggaggatctgagtttaattcatctgtgagaatcactttcttgcccctgtccatacacagtactttccacaaggtatctgctccatgaatactgatagaacgaatgaatcaaaaatatttaaaagtttttagacagagaatgtaaatgatccaacaaattatagcataataaaagctgcttttaacctctccttcattctggagtccattatagcatctagtctcagttaaatcttggattgtagactgaggcaagtcagttctgtcccacaaaattgtctgtgatggtagatatattttatatttgcactatccaatatggaagcctctagccacatgtagctgttgagcacttgaattgtacctagaccaactggattactgaagtttgtactttatttacgtttattttaaacttaaatagtcacatttggctagtggctactgtattggaaaacataactctggaactcagaacaaatggcgacgttcatattgtattaaaaaacttcagctggactgcaactagggttcactaggctgagactttcagggtaatgcaagtacatggttgacccttaaattttgcactcaaggacaccccatgtgcttcaccttagtctcagccatgcatttcagagattactagccagagtttcttactattgacactttaccctatgtttttgggcccatgttaaaccacagatggcactgagatgctattactgactattgaagagtcatgttatctaaagaatgaattgttcacagatctaatggaatttgttttctgctacagtgagaattatgatgttttcttttattcttttcctttcccataggagccttttaaattatcaaatcttctttccatattcaaatcgaatgttatctcctctatgaagtgactcttggtgctttgtatattcacttctcctgacaaaagtgtggtagaaatgccaagtgttagctctatagaagtgccacaacatgtgagttatggcaaagaaaaattcaacaagtgctattaggtacaaccaatgagcccccgagaaaccaatgtggtctgctatttcttaccacccttaaaaacacaaggagaattaacttcactgtgcctcagttcccccaccccacagcatggtgatgctaacacctaatttatgttaattttcttaagtgctgtttaatgagtatctgctatatgactgatatttgcactaaaggcagagatttcattcatcaagagagattttgctttttgtttcacagaatagacccaacaattaaataagcaattgcaataaatgtctatcatgactacgaaactcttgttttagtaaatggaacagagtaggcactcattaattccagtaatatcctttcaaatattaaagctgaggagtctatttcataaagtccaaagagtaaatgtgttagtaggacataaccatgttaaacaattgtagattaattttaccaaagcttgttggtaaaggaagaaccattagaataatctcctccatgaagtaatgatttgttcaagtataacttataaagtccttcagagttaaaaatgaaaggaaaaaatacattttctctagttagcacaattggtaaaattaaacatccctgtattttgatagctacaagtagattatagaaatagaccatctgggatcgatgattaacctcccccccccaaaaaaaaaagttgaatgctagaggacatcagttgaatgcattttaatttcatgttattattggtagttttgagctgcagttatttgggataaggttaattcgtagactttctcccacaacaaaagcattgcctttgccgaagcccttttgtttatttacttgctgattgcaatccagcataacagccacatttacaattaaattggtaattgaccatttagatcactgttccccatgcaacactaaacttgtaagtaatgattcaggcattaataagcaagccacacaattttaaaaatgcaccacaaattttatatctacctaatgaattgataaatccagaagaaaattccagttagatactatctgctataaaattaaagatagaatatgaacaaaacatagcctaactttagttatttacagatgagttatctagtttgaaaggttcttagattgtcttttctatattttggtcatcacagtgtcactgacattacttcaccaatgcatggataaacaatgaagaaaaaatgacactcagattagtcaacttgcatgctataaagggcttgtaatagtgttgagcctgagataagaagaaaaaccaaaagggtatgtgggcctgtctgtgcctgtcttctaataacgcatctcgcttgtttctactatttttaagaaaaatgagagttggctgtattagaatctctggttagttagggatcctcggtttcctcttgactacatactctccttgtgtttttaagggtggcgagaaataataggccacactggtttcttaggagctcattggttgtacttaacagtgtttgttgagtttttctgtgctataactcacttattgtaggactgctatcgagccaacgcttggcatttctgcaatatttactattttcttaatgtgtttattaactacttccacctctttctatgcacagatagggggaaaaagacaatatggtggcttgctacatcttttcagcaagcgtcaaattgtacagatatccagtctcttcattgaccccatttagtctggctgttaaatactgagaaatagtcattttaagaacagcaaggccctaggaactgtctattgttgctaaccctgagatacattttggaatcctgaatcaccctcaagtgatttagttcactaaatacctcataatgaaatatagacatttagacatatagatttacttacttgtcattaagcctagggaaaaccaagacttgcaatctttaagtcccctttcaattctaaaacttcctgacaatgagcaatctgacagttatatcatgatacgatcatgtctgccactgcttcagtgctaattcacattgaattgccctttcctgcctctcgactttcagattagttttgataaaacatgaatatggtattttctagctgatcattctgatttctaatctgacatgttgtcatatttttatttatagattttggtttacaagtcagcactccagagagatttctggttttttgaccttcactaagggtctctttcattcaaataatatctgaatatggtataagtatctgaatttcactcatattataaagctattttttaaaatctcaattataaaaattaaaatatccttcattaaaatataatttttttactaattataaacttaaaaagtttttaattgacatgaaatcacatgttagtgtacaacattttattttgaagtatatgtacattgtggaatgacaaaatatagctaattaacatatgcatgacctcacatagttatgatttttgttgtgagattactttatatccactctcttagcacttttcaagaatgcaacacattgtcattaactataattacatattgtacaattgatcttttgaacttatttctcctatctaactgaaattttgtatcctttaatcaaggtctccacaacccatcacccaaactcctacccctgcccgaccattccagcccctggtaaccatcattttactctcggcttctaagagatcaacttttttagattccatatatgagtgaaatcatgtgatatttgtttttaatacctgatatttcatttaacgtaactggaatgattatcaaacattatcaaaatgatggaaatgtatagaatataagctcttaggtccaattaaacacatacactactcttccgccattcttgccatcaacattgcaccccattaagtttccaagttgaataaagcggaaggctttattcaaaatgtcatctcaagacttttttgaatggcctgaggcttagcagcagttcttagttcagtagtctattgtggttaagaaactttattatagaaagttttaatgtgatataattaaaagttttgccattctgtttggcttctccaatcttatttccatgtgtaattttttgatattcaggatttgtttatggctttaccacagctttaaaataaaataccccttaataatggatatatatatatacacacacacacacacacacataccagtggaatactattgagccttaaaaaagagggaaatcctgtcatttgtggcaacacgtatgaacctggaggacattatgttaagtgaaataagccaggcacagaaagacaaacactgcatgatctcacatatttgtggaatgaaaaataattctactcataagaacaatgagtaaagtgatggtagccagaggctgagggaggggagattggggagatcatgtccttgttgatcaaagcacacaagttttagttagaaggataaagttcaaaagatctattgtacaacatgtgactattattaataacaatatattgtatatttaaaaatagctaagagagtagattttaagtgttctcagcacaaaaaagcattatagtatgtgaggtaatgcatatattaaaaagcttgatttagtcattctgcagtggatgcatatatcaaaacatcatattgtgtaccataaatgcatacaatttttacttgtcaattaaaaagtataaaattaaaaaatatagtaatatgtcatatcagtgagctttatcttatacttgttttctattagtaatagaaaacatatcagttaccttttccttaagagcctagattattgaaaaaatattttattgtgaaaaatgtcctacataaaaatagtgaatatttatgatttataaaaagataataagataagcaccttaatactcgtgacccaagtttagaaagagaatacactgataacatcagtctccaaaaataaccacactcttgaagcttctgtcaatgattccttttcttttcattatagttctactacatgtaaatatttatatactttattatctaatcttgtttttaaattggtatatatggaatcatactaaatatgtttttccatgttatgttccttggcctccacattatgtgtttggtattcattcaggcttctgtttgtaactgtttgttttactttggattccctgaaaatagattctgaggtgaagaattgcatgcagaaatttcacctaagaatgctctaaagcagtgctggccaatagaactttgtgcagtggtagaagcattctatacctgcattgcctaatagagtagctgtagccactagccataggtgacaatcgagttagtcaatttaaaaatttaaaaataaatttcaacatccacatatagcttatgaactatggtactggatagcagagctctagagagacatacctgtaagaaagtaggaagcagaattggacagaggtagaagctgactcagccagtcctctgggcacgtctagaactgggataggctgtcaaaggtgtccccagttgaagcaaagcaactgaactttagtatgacagcatgagacagtcattggtgctgcctcctagaagaaggagcaaccttgggtgagtcagctcttcactggaaattaagggcaatttccagtgaagagcatatctgtgagcctttagcagccaatattaccagaagcaagtattacaggatactgggagtgttgcttcattagccagaaaactttgtggccagtggcacctttgcctgagttttgctcgagcccactggacttgtttcacccactcacactggcaggccatgcttggcttgtgctactggcctggatcccattccttcaagggtgaaccaggcatgaagcagtgaggggtgtatgagtgagcaagcatggagtccggctgctctgcacagccaggcacactggctgtggtggggtaggcagctccagatgctggcatgggtgccagctccctgcaaggctgcagctggtccaggcttgccacaagcagcttccactgctggcaccagggaacatggtggtgcctggaagtctggaacaccaggaaccatagagtcccaaagaaggtgtcacagccctggcttgggagcttctagtctgggttccccgaagggctgcagctcttctcttttcctctcttctctccttcttattgcccgcaacatggtgagcaaggggcatgtttctgccctgtttgtgttacagctcttttagtcctgctattcagtgggtcccaagttcttgtctcacatccaggaagaatgaggtacaccgacaactaaagggtgagtaaggtgaagaggtgctttattgagcaacagtacagctctctggagactcgaagtgggtagctcctatccataggcaggccatcctgtcaagggtgcagttttcagcagacaagaaacccagagtgggtagctcctatcatcaggcaggtcatcccaacatctgcttagctctcagctgaaagaagaccctcagtgggcagctcctctctgcagacaggtcctctgaatgtctccccaagtctgtctgagtctggggtttttatgggcttcaaaaggaggaagtgtgttctaattagttcatgggtggctatgagagggcccagaaaaagcaccataagttctcattccagtctgtggaactggcagcccagcccccagcttcaggccttcccaggccctttccacccaggagcctatctgcctcccactgtcatcagcctgtcagcccaggtgcccaggctgtttgtactgagggacacctgcaggcctacaccaaggcagcctcagtaacccccaccccggcctccctctcatgcccctcagcacccaaagtctggaggggccaaggcagcagggagctggcatttctgcaccacctccagcaagcaaacacacctctgggttgtgacagtgcccaggcttagtctcaactttgcttcaaaattggagcaggcaccaggagcaggaagaggccaggcagcaggagcaggcatttctgagcctgctgaagaagggaggcatttctgagcctgcagaggaagggaggccttctagggcccctgagctcaggaatgctcaggtctgcagctgcacccagaggggcaggatttccattcctccaacttggaaggggtgggggcttctgcctgttcctggctcctgctagctctgtggagcatgcagtcctggctgcgcctcgccggctggctgcagctgtcatcttcacaacagcctctccagatgggctgccactgccatcattaggggattggcgctaagctctggagagattctgagcagatcactgcagtatccatgatagagctgatcatttatttgtactgctctataagaatttaattctataaataaaccacagtttactaatatattctatagatgataagagatttaggttatttccagtttgaggaggtatggctatggtaaaccatgtttctctaaacagtcctgtatatgtcttctggtgaataaatgcaagaatttctgtaagatatatacctgtaagtagaattacagaaagttaggatatgtgtgtaattgactgcactaggtaaagcttggatgttttccacatagttacagagtttacatattgcagcctctcattcagtgcctcaactgtatcaaatgaaaggtttattcaaaatttctaatctaccttgcagaaaataaacttggattttttaatatcatttttctctgaatgcagtgttgaaataaatttaaccctgtagtggttggcactaaattctaaaataaccaccagtgagtaatgctattgtttaatgcttttcccttgaatcttgactgaatctgtgacttgcttctagccaacggagtacggcaaaaaccataaacaaaaacaacaaatataaattcacatttagattattttgtatgttaaaggtaaaggatttttacagatgtaattaaggtccttagtaagtttgaattgaatcaatgaaaagaaggactacattgtgtgagtctgatttaatcaggtgagctcttttaaagggggcttcagccttttctgaggtcagatacattgtttttctggtcttaaagaatcaagccttcctgaattctagagatgcatggaaattaattctgccaacaatgatgtgagtttgcgtgaggaccctgaactcagatgaaacaccaccgccagccaatggctagattgcagccccctgaaacatagagcagaagacccagcggagctgtgcctggactcttgacccattaaaactgtgtgacaataaatgtatatttttttaaagctgccaaaattgtagcaatttgttacacagcaaaagaaaacaaacacccatttgcagcaaaatttcccctttttttaatcacaatattttattttctccatctgactattaccttttcttgagtattttttattagagtcagagactgtattctttctgtctttaagacaatccttaattcctggagaagagacattgaatatcattcaaattgctttcatgtagtatctagtagtaactgtgtcctttcaaataaatttttaactttcccaaggataaatgtacttgtaggaattcaaggattgaatagaagttatttatgtttatttcaaagataaaatatataaaaataaatttcctggaacatctaagaatacctaagtttaagaaaagaaaggtatgggttatagtattttaagattcctctaaagacaaaaaggggttttaagaagataacaatgacagaaacataaggaaaatttggatgacacctgaaacatagccagaaaaagcatatacgagtttaaattttataaagaacaatggaattatgttattacagataaaactagctgctaaattaaatacatttaaactcaaatatgagtaacaagttttattgttacatgaaagtctaaaaatcagtctgactgatactcaagtagtcttcctgtcatagtttgggttgtccaagagcagggcctaagagaaagactcgaaggtagtttatttgagatgtgatcccaggaaagagaagctgaatatgtagagaaaatgacataaagaacaaagaaaagcagtaacatgtgctatagtgagctggtaaatctatgctctgcttctctgagaacccattgaaaaccacatgaaacatatttgagaattgtcccagtggaagatggtgagttcaataggtttcatgatgtcccccagaaagacttgctgttcacccagaacctcagagtgttacctgatttggaacaagtgcctttgcaaatgtaactaaggtaatcatcttgagatgagatcctcctagattagaataggccctagatccaatgacagacattcttaagggagccagaaaaggagcagacacacagagaggagaagcccttgtgaaggcagaggcagagatcagtgttatgcagctacaaattgaagaatatcacagcctagcagccgtcaggtgctaggagagaatcatgaaatggattttccttcagagcctccagaaagaaccaaccaccgccccacagggctgcttgggcttcctcacagcataatggctgtattttaagagcacatgttcaagcatcaagagcagagacaagcattgagaattgcatttcttaagactacagcctggaaatagatcaattctgccatattctattggtcaaagtcacccatgttcaaggggagaaaaacagacatactttttgaaggaagaattgacaaataatttgaaactatccttaaccctccacacttgttaggtgtgtacccaagaaaaaggaggaacagattaggtgaacagctattcagcctctgtcatgattggagctttttaagctgtttatccttttaagcagtaactgtatattttgatcaacatcctatgaagtacttaaaacttgtcttaatccattcagactgttataagaaaagtccttatactgggtaatttataagcaacagaaatttatttctcacagttctgaggccaggaagttcaagatgaaggtgctagcagatttggtgtctgctaagggtccattccttatagatagcacagtctttctgtgtcctcacatggcaaaaggagtgaaccagctccctcaggcctcttttgtaagggcattaatcctcttatggagggttccacccccatgatgacctaacaacttcccaaaggcctcacctcttaatagtattgcattggtgattaggtatcaatgtatgaatttggccgtggggattagaccatatcacttatggattacattttcatatctgtgaacttagttacaagtatataatcataggaatgcatattaacaaatgcacagggcatgtagtcaatttttagatacagtatgggattttttttttggtacagcattccctgaaaaaagtgatgtttttatatgtagatacccatgtgtacgtggaagtttataacatttggagacatcagatactagaacatttttattatgttacactaaaatcttctctgttgaacattttactcacaagtaaaagtattagtattattttcttgaccacaagaaacaaatccaagttatcttctagtcttctgtacaacaacccatcatgtatttgaaatcagctatcatgttactccagagtttgttatctttgttctaagcactaccagtgcttttaaagaggtgatatatgaagcagaaaataaatgctagccagatatgatctattgcatttttcttttttaatacaagtgtaatttacctaaagagaaaggagcagctattagtttattaaaatggtagtgttttatattcaagaaactttcatatgcatgtctcttggatcctcaggacctcgtcaattactacagcatataccataaacttaattaaatgtaagtattcccccattttggtaataaatatataatattaaatatattctacacatacacttgctataactatcagaaatatagaaatatatatgtatatattatcatttcaatattaggaatctaaagttttgaagagattaattctttgcccaaatttatacaataaattaaggtaagctgagaccacagtaaaagtttctgatcctatgttcagttactatttttctattataacgtgctgttaaataatttatatatttaaaattccacattcagaattgtaatattttataattatgtatagtttaattaactatgtacagtctattcaaattcaaggaacaattttgagatgttaaaaaccacttagagtgctcaaacactttgaaatgcagttttggcaatttaaatgtcaggatacctctgactcatttaaactgaaaggaccctgtaaagactattgaatattttatggtaatgaaactgaaatactctaatatatggaaattcctagttttgtttctaaccaaattaatgtatttttagcttttgataattactcttaagaccactagttgctcagtttttttgttttcagttattaatagcaacagtcttattatgttatttgagaaaactagtaatcccttagtaactattaattttaaaagtaatgttttatatagggtctagtatgaaagtctatcaacagctagaaaggatactacataaatacctagtaaactattccacttcctcttaaaattagggaattgtgtgtagttggaaattcatcaggtctgaaggtgaaagatacatctttcattatcatgacagaatacaaaaatctagcaaactcatgactgatactggcacccaaaagtaagtgtattactcttgtttctaaaaagcaagtcctgtttttaatctgactttattataagttatcttttatagcctttattataccttttttaatacctttattataagttaccttttacagtgaacttttcctacgaacatgagacttcataagagcagtgctatgtatgtaaggccaaatttgcaggccatattttcagttatcctgatttagtaggtctacaatagaggctctaaaatcaactgtatttctatcaagcaacctacatggttctgatggagaagatccgtggaccagacttagaaaagcaatggtcaataggagctgtgaatattggccccaattccattccacatacgtttcttttacattctctgtataagttgcaattcacactttgctcaggtatttttggtatgggttttaaaattattattttttagttgaaagataaattgaatgtatttatcatgcacaacatgatgttttgaaggatatatacattgtgaaatgactcaatctagctaattgatatatacattgcctcacatagttattatttctatggtgagaacaatttatatctattctcttagcatttttctagaatacaatatactgttaactatggtaaacatggtgtacaatagatctcttgaatttattccttctaactaaaattttgtgtcctttgaccaacagctctctaagcccccacccccaaccctaccctaaccacccctgcccctgttaacaccattctactatctacttctatgagatcaacttttttaggttccatacatgagcgtgatttttgtctttctgtgcctggcttaatccccttaacataatgttctccaagttcatccatgaagcaacatttccgttctttaacactacataggattccactgtgtttatacatatgtatggtttttatccactcattcattgatagctacttaagttgattccatatcttggctattgtgaataatgctacaatgaatatgggagtgtcactatctctttgacatactgatttaatatcttttggatatatatacagtggtcagctgaatcacatggtagttctatttttagttttatgagaaagagactgttttccataatagctgtactgatttacattcccatcaaaagtgtgcgagagttctctttatgtcctaaccaacacgtgttatcttttgtttttttgataatagccattctgacaagtgaaaggtgatatttcattgtggttttaatttgcatttccctgataataaatgatgctgagcatttttctgtatatgtgttgactatttgtatatcttcttttgacaaatatctgtttaggttctttgcccatgtttaattgggttatttgtttccttgctattgagttgtttgaatgtcttacaaattttgggtagtaactccttatcaaatgtatagatggcaaatatttttctggttctataagctgtcccttcactattttgagttctttgttgtacaaaagaacaaagtttttgtttagtgtaaacccatttgtttatttttgcctttgtttcctgtgcttttgggatcacatccaaaaaaatcttaatccagtctagtgtcatggagcttttctcctgttttcttttagtgatttaatagcttgtggtcttacattgaagtctttaaagattttgagttggtttttgtgtctggtgtcaaataagggtataattttattcttctgcatgtggatgtctagttttcttaacatcattgattgaagagattgtcctttaactattgtgtgcccatggcatatttttgaaaatcaggtggctaggatttatttttcagctctctattctgttgcattgatctgtgtgtctgcttttatattagcaccatactgttttggttactatggctttgtagtatattttgaagtcaggtagtgtgatgcctccagcttttttttctttttttacacaaaattgctttggttatacaggatctgtggtggtttcatacaaattttaggatcgttttctcaatttctgtgaagaatgccattggcattttgatagtgattgcattgactctgtagatcactttgggtcatatagatattttaacaatactacacttccaatccataaacattggacatctttttattcatttgtgtctttttaaatttcttttattcctatttatagattttaatttagatgtctttcaccttctgggttaaattaactcttacatattttttgtagctattatatatatgcacccagattcataaagaaaatattactagatatctaaaaaatctaaaaatatcttttaaaaagatacaaacttcaacacagtaataatggaagatttcaacatcctactctcagcattaaacagatcttctggacagaaaatcaacagagacattggacttaaactgaacttgcgaccaaatgaatctaacagatacttacagagcattttatccaacaactacatattcttctcatcagcatgtggaacattctccagaataaaatacatgttagtccacaaaacaagtttcaaaatattttaaaaatcaaaattatgtaatgtatcttctcagactacagtgagtaaaactagaaatcaatagcaagaaggactttggaatctatacatatacttggaaaacaaacaacacactcctgaatgaccattggatcaataggaaaattaagatttatattaaaacatgtcttgagagagagaaaaatggaaatataaaatattaatttctgcaggacatagcaaaagcaatgctaagaggaaagtttatagcaccaaacaactacataaacaaaaagtgaggctgggctcagtggctcactcctatagtccccacactttgggagacttgggaggcagaggcaggcagattgcttaagcccaggagtttgagacaagcctgggcaacatggcaaaactccatctccgcaaaacgtacaaaaattatcctagtgtagtggcatatgcctgtagtcccagctactcaggaggctgaggtgggacccagaaagttaaggttgcagtgagccaacattgagccgttgccctccagcttgggtgacagagtgagaccctatcccaaaaacaaacaaaaaacaacaatgaaaaaaaaaactcagaaagatttcaaatagtctcattgtacacttcaagcaactagaaaagcaagaataaatctaacccaaaattagcagaaggaaggaaatgataaaggtgagagcagaactaaacaaaatagagactaaagaaaccaatgcaaaagttggttgttcaaagagatttaaacatttgataaactgataactagactacccaagaaaaaaagcaagaagctcaaaacagacgacctcagaaatgaaaaaggagacattatgactgatattttgaaatacaaaagatcaccagagattattattaacaactatacactaaccaactgaaaaacctagaagaaatgaatagattcttggaagcatacaacttaccaagattcaatgaggaagaaacaggaaatctaaacaggccaataatgaggagcaacattgaatcagtaatggaaattctatgaacaaataaaagctcaggacaggatggattcaatgcagaattctaccaaacatataaagaagaatgaataccactttttcttaaactattccaaaaattgaatagagaattctccctactcattctatgaggctagcattttcctaatactcaaaccagacaaagatacacacaaaaaagctatagaccaatatctctgataaatatagatgcaaaaatccttatgaaatactaacaaactgaatgcaacaacacattaaacagataatgcatcatgatcaagtgagatttatcccaaggatggtagcatagttcaacatattcaggtcaataaatgtgatctattatgtcagcagaaggaaagacaaaacccataggattatcacaatagatgcaggaaaatatcgttcttttataacaacggtgagcaaactaggcatagaaatatcatacctcaaaataataaataccatatatgataaacccacgctaacatcatactgaagggggagatttgaaagcattttctctaagaaatgaaacaaatggtgaaaaatgcccgctctcaccactcctatgcaacatggtgctggaagtctttgccagagaaatcaggcaagaaaaataagtaaaagtcaccaaaattagaagagagtcaaactgtccctttttgtaaatgacatgatcttaggtccagataatccaaaagactaccagaaaattcttagaacttataaacaaagtcagtaaagttgaaggatacaaaatcaacatacaaaaatcagtagcatttctatccaccaataatggcatagccaaaaaagaaattaagaaggcagtctcattttcaatagctgcaaaaaaatacctaggaataaatttaatcaaggaagagaaagacctctacaaggaaaactgcaaaacactgatgaaaggaattgaagaagacacaaacaaatggaaagacattacttgttcatgaatcagaagaattaatattattgaaatgaccatactacccaaagcaatctatggattcaatgtaattcctatcaaaataccaatgccattttttacagaaatataatacacaattctaaaattcatatggaacaagtaaagagctgaaatagccaaagcaaccctgagcataaagaacaaacccggaggcatcatgctatctgacttcaaaatatattacaaagctattgtaaccatgacagcatggtatttgtatgaaagtaaacacatagaccaatgaaactgaatagaggacccagagataaatccacatatttacagccaactcatcttcaacatagattccaggaacatacactggggaaagcacactctcttcattaaatgatgctggggaaaatgtataactatatccaaaagaatgaaactggacccctgtctctaccgtatacaaaaggcaactcaatatgaacatgttaaacctgaaattataaaactactagaagaaaacagagggaaaattcttcaggatattggtcttccgaaaatctttctagggaaagattttatggctaagagctcaaaagcataggcaacaaaaacaaaaatagactattgagaccatagtaaagttaaaagcttctgcacaacagagaaacactcaacagagtgaagaggcatcctcttgaactaaagaaaatatttgcaaattattcatcctacagggcactaatatctggaatatacagggaactcaaacatctcaatagtaaaaaataataattctattaaaaagtgggcaaaggatatgaatagatatttcccaaaagaagatatacagatgtccaacaggtacataaaaaatgctcagtatcactaatcatcagggaaatgcaaatcaaaaccacaatgaaacatcactttactccagttagaatggctataatttttaaaagacaaaaaatatcagatgctggcaaggacgtgaggaaaagggaactattacacactgttggtgagagtataaattagtacaactactatggaaaacagaactaccatagaatatagcaatcccgctactgggaaacatgtactcatgtatttattgcagcattattcacaaagaatagtggaaagatatggaatcaacctaagtgcccatggtgaacgatgcccactttcaccgcttctattcaacatagtactggaagtccttcggtactatggaaagatatgaaatcaacctaagtgttcatcaagggaacaacagataaagaaagtatggtatatattcataatagaatactacttgaccataaaaataatgaaatcatgtcattttcagtcacatgggtggaactggaggtcattacattaagtacaataagccaggcacagaaagacaaataccacatattctcatttatatgtgggagctaataaacttgatgtggaaatagagaatagaatgatagataccagacactgggaaaggtgggttgtggcgagggttggaggggggcaggatgaagcagggttgattatggatataaaaatatagttagatacaagaaataagttttaatgtttgatagcagactagggttactatacttagcaataatattatgcacatttcaaagtaattggaggacaggacttgaaatgatatcaacaaataaaaatgataatcattcaaggtaataaataccccaaatatgctggcttaatcattatatgctctatgcgtgcaaggaacactcacatgtaccccataaatttgtaaattattatatatcaataaaaggagaaaaaagaatgctctaaaactgggtgaaaatcaaatggaaattaacttacagctagaccttgattgtgcctataattctcaaactgcaaatgagtgctcaggagttgtgacatttgagaactcaggaagtgcaaaggcatttaacaaaggtatcaatcattttgttccctgaaagcttttcttctcattcaagatatataacacaaaataaaagttagctccatattattaatgtgaggtgatggttgccgtctgtatatataaactcaaccaggtcttggcattgaggctaaagagaaaaaaccgaggctactaacttgtgttatttgcagttaagaggatgtggaaattaagataaccctcagtttacttatctctaaaatgatgataatggtatttgactttagtatttggaaataaatgaagaacatccaagtgagaatacacagtttatttattcagacattgctatagcaataaagtcagctaccatcactagcacttggcagagattgaaagtcaggcagggaagtggaaaagccttataataaaaaacatggaaggcctcaggtgtgatgtgtttggagcatgttagcatgggaaagctaggagtcagctaaatggaagtgacacatcctgtgtgatttgtttagggagtatatttggctttctcttgttggttttcagttaaaaattagggcaaaatataaggaagctggcagccattgaccaaatccttaccattccaggtcagttgctgcaaaggttgtgatttggcctcctgcacttgttgatgcagagattgtgggccagagttctatcagatatggtctagacattattcatttgtatgttcagtcttcatggctaacagttttttaaatgagaattgaattgtaatgagttgaaaatatgcctctgttgctgcttttggaagtagtggaggtagcattaggtggtaagttgaaggcagcagtatctggaagagagaagaggggcatgtggctccactgatgtcaggaatgtcccaataggttatcttgagctaggggaagaggacttagagaaattctctttctcaatcctgtctaaatgtagagtagaataattgccctctattttcctagctgataaactgtccacattgctcttcacaaggatccttgatctcctgggtatctgaaactttaggttctacttctaaactgatggtgaaccccaatattggggcccagacaaggagtgttcttggcatcatgcaggaaagaattcaaaaatgagccaacggagtaaagtgaaagcaaagcaagtttattagagcaacagagtacaggaaaatgcctgctccgtgacaaagcagggctaccccataggcagagtagcacttgtggatctagcaccagttagctagatttatagctactccttaattatatggtaaataattttctagaaaagggatgtggatttcctggaactgagggtttctttcctttaaaccatgtaagataacttccaggcattgccatggcatttgtaaactgtcatggtgctactgggagtgtccttcagcatgttaatacattataattagtgtataattagcagtgagggcaactagaggttgctttcttccccattttgattttagctggtttctttactacatcctgttttgatcagtgggatcataaccccactgatgtggagaacaagtcctgctgatctcctacctcaaaactaatgagagagggcccatttttctaacctatgaacttctatagctaagatttccttatctcagaattatgaataggtaaacaatcaatttgtattcagaagaagttgcaaacacatcatatgagagctatctagtgaatgatttaatattattttatcttgccacatatttctcacattttaaagcttacctcttttaaaatattcaggcttacatctatcttgctttcctttttgtttctttatatctaccctgtcctgattattcaaattcttggcatcagcaaaccttgttgctaagatctttaatcattgcttagctgccatgactacagctaccttgctttgcacattgcaaagcacttatacacacacacaagcacacaaattctttaagttctgttcagaaataccacagtccctttggcctctcctagacctcctcatttctagagcccttcacctaatctccattcttgattcccattcccatgagctgaatgacgaaacacaaatatcctactgacctcaatttcctgtcctgcctttttcactccttgtttcctctagatctgtttcttcaccttcccttcctttttttccttccttcctccagaccaaaatatatatttgttctagcacttcagtaattctcttcaaatatttaaatctcattctcctttcctgtttttattgtatgctccggaagcacatccaacattctggcttttaggcttcaacattcaacactggagaaaactcataatagtccagcgtagtgtcactacaagttcagagatccaccccacactgcttggcaatgccactatgggtccaactcgaggctgtctctcattcctcacaggtgcaatttcaaacttttactaccccaccagtacactgtgcaccacctcttctctgaagaaggaaattcctagctaatttttctcaccaccaacaaggcttatctgcaagatatttttattatcttactcagagcaagtcacattcttatttatgcttgaagctaattattccacatagactccggatctcattctcttccgtttcagcaggggcctctctcctttacctatgtctcttataaaattttattcttattgttttttagactttttctccaaggttttgtctgtggtcacatatttatctctctctttttgagtaatctaatttattccataatttcggctgccacatatatactggaattttttttgatctacatcaacatgttcagaatgcttttgaaacttcagataggtctacctaattaccttctagattcctccttttctctttctcacccattagtcaataagttccaacaattttacttattaactctttaagttaataagtaaactgccaagtcatttagaacacaaatgtaaccaagtaatcctatgtttaaaatcttttaaatggtccttatcatgtttggtttcaatgcaaactccctgacatgacacacaaaacttttcatgatttgacccctgcatttatctctctagtcttttatttcccaaagtatgttcagaagaacacttatcctgtgaaaagtctggcacgatgagatgggggaacaggaagggaatggagggctttagcaagttcaaatccatttaagaaactaatgctttagtattacctcttagagaagtggttctcaaattggtttctggagcagaagcaccagcattatttgaaaggtcactctcaatacacattttcaagctttaccctagacctactgaatcaggaaccatgggtcccaggacctagcaacctgtctgtgtttgtgagctttcccagtggggctgatatacactaaagttggagaaccacaatcttagagaatcaccatgcacattagcatattaaaggcttcaggaaatctgaaaataacgtatttaactttgtttaagcaaaaattttgaagttagttgagcccttgtgtgtgtaagtacatgatactaacatagagtagaacaaacgttggagaagcacacttcatcaaaagctgttatagcccattttactcataattattcaaatatagtaggcatctgtcatgtggttttgtgtgtacacagcctgtctttgcatttttcttttttttttttctgtgatggaatctcgatctgttgtccaggctggagtgcagtggcacaatcttggctcactgcaaccgccacctctcaggttcgagcaattctcctgcctcagcctcccaagtagccgggactacaggcatgtgccaccatgcccagctagtttctgcatttttagtagagatggagtttcactatgttggctaggctgctctccaactcctgacttcaggtaatccacctacctcagcctcccaaagtgctgggattacaggcatgagccactgcgcccggcccgtctttgcatttttctaccagaggtctcctcccaacccaagtcttgtcagctccttagaagcagcgtttcacaattacatgtttattgaatgaatacattgaatgccacagaaatattttataacagttttaaaagtattgtataagttccactaagttgaagatatcatttgttatttcaatactgtcttttgcatgtaatggctctttctatatactgatctcttcttgatggaatatacttatattttcttatgtgatatcatgaaagtgtaatatacatcccatcagcttgtctgtaaaaacttttctctatatgcttttctgtaatgaaatgactttgtaaacatgaccattggaactttcttcagataatcctataacctggcaactttccactttcaaaaaattacctccccattatacccttacagattttctgtaaagtctgtttcttcaataatctattaacaaaataattttagtcactattataataattactataattatgattgatttactgggtcatattttaataaatgtatttttatttgctattaaatgatttataattaccatattttcttgatataacaaatgttatttcataacattattcatagtaatgtttcagtcaatatgaatatacttattataagcttttcttaatttctactacaataaccttaatttttccaatcataaggttaaatgccctattagatttctagggtatattaaaaagtttcacatagagaaacttaattcttaagaaattgagtaaatattataatacaccagatgagacctcatcctttcagcatgcagtctattacaatacgctattaaagtagggaaagcctggtttatgatagtattgtgtgctatataaaaacttaatgattcaacatccagtttgatttattctaatgcaacaaacgttatatgatgtgaaaaatagcatcatcagtaatcttctggtgtcataaaaaagagtgatggaagtacaatttgcgacaggtaagggacttgggaatgaatgcatatttcaactacttctgtctctcctcctttccatgtcactctttgcaaaaatgataagtggctgtgatgttacacatatcatgtgtaataattttctttcatttaatcacattacttaaaatatgtaagacatatattttggctatgtacatatgacgataattaatgatagtgttctaatacaaatatctccccactgtggctattagaagtagttttatttatcaccttcacaactcaccaggttatctggatttctaaatcctttagaaatctattgagcttaatataatgcacaaataattacattatagtagtgataacaaaattctgtttacaaaataaaaataaattttaataaaatttctaacttaaaaggcagcaaagcttgacatttgtaagcctgcattactgtccattacttcctaaagattcactaatataacccaggaattgaaagaagaagcttgccaagaactttcaagttgttctcggggatcatatatacatacttcttaaaatcctttggagattgcttatcatttattctggatatttgaagtattttgtgtcagccactaatttttttttaccattttaatctagttctgcaagttttaacatctgttgcatttcaaacataaatgtaaatcaaaggctcttggatgtatcctagggaaatatatgctcttaaaagtacattatagtctaagaatagaggtgtctagtactaagtgagttcactataggactgtctttcaagttacacgagaataattaaatgacaactcaacaaaatatggttacatatcatgatttgcactggaacatatgcatatacaaccattcagccgagagggtggctgatctggtcacagcagaagacatggcaattggatatggcaatagtttgggccaaatacaatctaatacccattttacattagagtctttgagtttctggagccataagttgatgttttcaaatatcctgcacctataagcttgtaaagggtttagcaaaacttttcatatacttaagcgaaaatgtatctctgcctatatttttagccaattttaacaagtaaatgtaaaagaagtgctctaagaggaacacccaccaaaataaatgaccagaatagcttatctctatgttgtaaagaattgcatatgttgagtatgaaatttatatgtgaaacattcaagattgatattgtactctgttaacctcaaagtaaatctagatcatcctatgtcacattctgctttctagactgagagttgaagactttgagcagtgtggtaaattgagaaagtttcaaagacattttaaaaaaaggaaaaaaagagaaaaagacaaacttacaaaattttagttacctagataaatttgtgcgtaagaagggagaatttaagtcaattaatgttgcatatatagtgtgggatttaacagtactgagtttgagtaacagtactgacaggcagctgtcagttctgcatacttactgctgatgtaactttgagcaaaatatttaggcaagataaattttatgcatacacacacgcacacacaaacacacacctttgtacacacaaaattcaatcttcatccttggaagaagccacattaaaggcataatttctaataataataattcttaaggtcatgaacttgtaatcatcagaggcaggaaaaacctctaatccagaacaacaacaacagcaacaaagcaatggaagttaaaccaatatttaaaaagtgattagaaatacaagccaggccactgtgagtttattctatgggatgtcattcaatgaagaaaagaaacctgagtttaacagctttgactcccataatctaagtttcatttccacaatcatttttctttgatcttctatttgacagtgacatctaactaaagtcatcccatttaaccttttcttttgcatgttgcgtgaacttgtgagcagagtaagaaacaggatattcctcgtgaagatcagggaccaaccaccaagaatttggatttttggccccaacttattacactgatggttactattattgatgaggataaaactgcctacacacctgtcctgaatcagtaagtacaatgttttggaaatgaatggattttattccactaaagttcaaataatacatattttaagcgcaacatatactgacgacaataataaacttttccataattaagctatagaaaatagtatttttcaacttttatcagtaaatatcaattaaatgatattatgaatttttagtttgagctccatggagtatgattctttggatatggagaaaaatattttccaagatttgatgtttatgtaatgtaaaacttttcctccacatcctttcatagctataccattgtctcaaaagaaaaaaatgtacactcccccaaaactaaaaataattttgaagagctagtgttaaacatattgcattgtggctttttaataataaagatttggcaaaaaacctgctttcaaaatagatgtgcatattgatttaacaaatttaataacatatttaataaaacaagttgattttcacaaagtataatctaaagttcatgcctctaagacatggcagatgaattaaaattcatgactattctagaagagaccgtaaaaatcctcattttatcaaaatacaactagctgtgtgaccttaggcaaattatctaatttccctgggtctcaatttcctcccaactaaaataaaggtgttattattagatgatttccaagatccaatccaactttaatattgcatatttagattttattttacacccacatattaaagaccataaaagcaaaaataacatcagacttccagctaggcacttgcagtctggttaatgaagaggattgtcttgacaatattagttagacctgaaatgttatgggtagcaaagatagcagaaatagacaaacaatgaagtagaacagtgaagtagactcagacttactatggataaatgactgtattcttatcctctatactggtcaagaccgttagggtcattgtttatgttcagtccaattaaaattccagttaaagaagaaatacatttaagtatttcagtcttcatccttttctacttactattaaccacccattttcaacagtcccccaattcctcctaattgtggagagagtggtcctatttttggtatacaatcatgataatatcaagtttgccctttcactttcttctcccttttcccccacacctaattcttatatctgccttttcttcctgatggcctttgtgtttcctaatctctgtacagactttgctcttctattctcttctgttaggactagaagatcttctcttaatctataacatgtcgtcatcgcatcatgggtcctgggaagtacatctcaggtctctgacagctttgtagaatagagttgtgttttcttatttactctttggacctttcttgaggacagagtagttttctgaaagattgggagaccgacaacttgtttcaagactgtgtccttggactgggataggccattttacaaatggatactggatgaaaacaaacatctactgagaaacacaaattcagttctatgaagaaactttggctttaataatcaaagaaatttcttatgtttaccaagtatcttaaatcaggatttgatcagtaaaaatacattataaaatcatggaagaaattaaagtatccatgatttatttgtaatcatgtgccacaaaatatatacaaagattttagttgactttatgtaactgtagtaaagaaactggaataaatacgtttatttatggcaaaaatagatttaaaattatgaactaaattaagcctaccaagtataaaaattagcaatgacatgtgcaaaagagaaaattgtttttgtttttttcaattttgtttttaatgtcagagtttaagtccacttttttcctttggaaacctgtccctgaaaaaaccaaatgccttcctctatttggaatccattttttattattgtgtttggtcagattttaaggatgctgtaaaactttttttcacatactgaagatcgttcaatttagtttctcatttaatttaataaatgccttaagtgaactcatctggagaccaagatggcatcctggtggccaatgttgcatttgtataatgtggtgagatttcatttatatctgttactttgtttgaatactgcatcgtcacatttatgcttaattaatcatctccttggttacctaaactaatgcagaatttcacaaagtaaaaaatccagaccactagggtaaggatcacatgggctactagctggatttgcagatctgagccccatcccaaatctgtggagtcagaaaacctgcaattgacacagaagtctgcaatattaataaacgatccctgttattgtgtcttatggtcactaacaatgaaggcacagatcaatatgtgaaggacatgctaaaagtagcttgggttttgttttagaggcaaaggcaagtgaatttaatgattttaaaacataggacattttaaaatctctttcaatgtaatccctgattattgattcagatcatttagtgaagttcttattgttatcatgagtttgagaaatcattgtaggcttttgcttactcaaatttgataacaagtttacagtgacggtagactataagcatgagggaaaagacttgtattttgttgactaatgtatattcaggcatacatatttgttgaatgaattaataaattaaagtaaatttatacatgtagtcagtgtttgttctgtctattcccatgttgatttattaatgaactacagtgtttatttgagtaatattttctcaatttttaaaattatttataatgaattttagatgttttagaaatttcaatatttcattaaaactaaatagtattaagcagagtactttcagatttaggtccaggtttctgtctctttttctttctctgtctttctaacaggtttattgaggtataattgaatataataaaatttcacatatttaaatagtctaatttgaatagttctggcatatgtatttagccacaaaattattgctattttcaaaataatgaagatatccattaccccaataattcatccacttttgtaattcatccactcctccaccatccccaggcaatgcccctcatctgctttctaatactatgaattagtttggaaatgttatcattatgtgtaaatgtaatcataaattctctccattcttttgtctggctgcttttattcattacaactattttgagtttcacccatgttatttattcattacaactattttgagtttcacccatgttattgtatgtttctttttatttttgagtagtattccattgtacgtatataccacaatatgtttattcattcatctgttaaaatttgtactttttcaagattaggttgctatgaatatttgtttacaagtctttgtatagacatactcttttatttctattgagttacgtggtaagtatgtacttaatattaaaactgccaaactgctttccaaagtggctgtaccatgccaacacttggtttgataaatcttttagttttacctatcctaacaggcatatattatctaactatgattttaatttgcactttcctgaatcctaatgatactgaccatatttttatctgaatatttgaaattcatatatcttctttggtgaaatttctgttcaaatcattttcccatttccaaattaggatgtttatcttattattgttaagttgtaaaggtctatactagataaaagtctgtcatcagaaataaatgttgcagtatatgcttctagcttgtaactttcttttccattatcttactagtgccttctgaagagcatagttattgcgcatttttaaaaaaattttgatggaatagtccaatttattgatcagtttcttttatagtttaagcttttaaaaaaattctattttagaaatctttgcaatctgcacagtcagcttgcaacacaattttcttctagacatcttacatttaagtctataattcatttcaagccaatttttgcttgttaactggtgtgataatcaagtttaactttctttggatcgttttcatatggttatctatttttttatctctacttgttgaaaattattctttcctcattgaattgctttggcatcttggagaaaactcaattgactgtatatgtaagaggttaattctgaagttctttgtaatctgttccactgatctatatagccgtaattacaccagtactgcatgtcttggtcactatcattttctaacatattttgaaatattatagtaaaatttactcaactttgtttatatttttgaaaatagtttggctcttctagctcctttgcaattccatttaaatttgtatcagtttgtcaatttctacaagaaaaaggtctgctggacttttgattgatattgcattaaatatataaatctattggggaggaaagaaaacagcaatattgaattttataatccattaacatggcatgtacatgcattaaggtcttatttaatttcttattttggtgaaaaggtgttacatattctttgttaattggtttctaagtatttttattactatcttaaatggtacttttaattctaatttctcattctttgttaatagtacatagatatacaaatatatatcttcagcctttctaaatttacttttttgtaggttcctcatgattatttaaataaattatattcttgtctaaaataaatatggttttacttatttctttccaatttagatgtattttattatttttcttgccttattgctctggttaaaatcttcagtacaatgttgactaaaattagtgaagagcagacattcttgccttattcctaatctcatagggaaagcatagagatttttaccattgaatatcatgttaactaactgtttttcatggataatgctttatcaagttgaggaagttctgttctgttcttattattccgaaagtttttatcatgaaagggtgttggattttgtcaaatatcttttctgctcataatagggtaatcacataattttgcttttcaacaatcagtatggtgaattgaactaaggaatttttaactttaaaccaaccttgcattcctggaacaatctccacatggtcttgatgtataatctttcctacataatattatattttattgataaaattttgttaagtatttttgcctttgtgtttatgaggatattgctctatggttttattttcttatagtgcctttttctgtcttttatatcaatgtaatgatggttttatagaaagagttagacagtatttcctccagtataatttgccaaaagagtttttataaaatttgacattttcttttctgaatttttgatagaatttactggaaaaatcatccgggcttagagttttattgtaggaggtttttaaactaaaaatgttatttcttcattagatatagggctatttagtttacctatttgttcaaataggtaacctaaatttaggtttttgtagtttgtatcttcaagaaaattttccatttaatctaagtggtgaaattttccatcatgtagttgtttatgccagtctgttattatttttttatgtctattaaatctgaactgatttttcctctctcatccttaatattgatattttgtgtcttctctcttttgttctgtccaactgtctgaacgtttataaattttactggtcttaagaaacagcttttgattttattcaatgttttgttttttgttttaaattaatttttttctcattcctttactattgtctttcttctgttagtgaagataaatcttaaatggttatagcagtaatccagtgagaagatatgaaagccttgtataagatgatggagagttaaggttagatttgtgaaataaatcaaaagatctttatgactaaatgcactgagtggagtgttaaggaagaaagtagagaccatggaaatgtcatatttataggggcatcattattggagataagaaatacaggaggaagtatccatttaaagaagttcacagtgacttatattttgatatacagatatttggttacctgtgggtcttccaagcattatatgcaacagacaattgtatacatagataagaaagtcctttaggttgatatcgattaaatacataatgtagagaagttttgctatatgtgcctaaaagtaagaaatcttaattatttctaaatattcataaaattttactcattttacttaaactgtcatgacttcatattactttgtttttgttatgcagaccaaaacataagcagaaatatctttcatccattctgttatctcatttgttcgcatgcattgtactataacatgtaatttcttttagttttctccaaaaatatacatacagtgaagtctcaactcattttctctctgcattaagtgtagatagcagaaagtatctcaatgtattgagtagaaaatggaccagttttaaaagttgtcttttccatttgcaaggataaaatctgcctatttttcccctctcggggttatgtgatgagccagaacattagtttcaaattgcatgtttttaaagataggatgttttatttgctgaagtgaggaagtttaggtttaagcgactttgatcagggatttgtcctttgttctttctgttttggaaataatgttcagagtattaaagttcttgatttgtttgcttacactatggcttccctaaattacttttatatttaagaaattgttatgaaagtgtttatcctactataaagtacagagactatgcagtagagtcctgtatatccattattcaaattcaacaattatcaaaattttgtgatgttttcttcatctatattcttgagttttcaccttctttttcttttggctgagttatcttaaacaaacttgagacattctatcatttcatcccttcttagtttagtatttatctctaaaaattatggctttcttttgtacatcacaactaataacattaacggtaaggccctggtattgtgtaatccctattccataatcaaatgctcctgattttctttaaagaagattttttttacattggtttgtttcagtcaggatccaaataaggtgttagcattgcatatggttattatgtgttacaggtctctttcatactagttaagtcccccctcccttttattttatttataccgttgacttctgcaagaagctatgttcattatcctttagaatatgccactttctgggttattccatttgcttccttgtggtgctatttaacttgttccttcatagtcattactctccatagctgaacatttcagattcatttttttaagaacacttcataagtgactgtgtgtatttcatactatgtcacatcaggtaggacattatctggttattcccttgtagtgatgttaaccttgattagtgctgacagtcttatttcttcattgaaaatttcttcatcaacctttcctataatggtttcatttatttatgatcacttcagaattcgctattttattagggatgacaaaacggtgggtttttatatttttttattatactttaagttctagggtacatgtgcacaacgtgcaggttttttacatatgtatacatgtgccatgttggtgtgctgcacccattaactcatcatttacattcggtatgtctcctaatgttaagaaaatgtggcacatatacagcatggaatactatgcagccataaaaagtgatgagttcatgtcctttgtagggacatggatgaagctggaaaccatcattctcagcaaaatggtggttttataaggttaccatttcttcaacatttattcattagaattttttgtaaagaagaactttctttcattaattaggtttacttacttggttacccatatgtgtaataaatataggaaagataaggtaaatatttaattatttcttttaacctaaagtattttatctcattcttttcttttctgctctattgaacttttatcatctttcattaacagtttcatttcaatttaataaatatgtattgaacccttaataaatatatgccagtcaccgtgcaaggctagagtcacaaatatttaatttgtaaaagagatatatacgaaattaatcaggagtctgaaagtggttaactactgtgcctgccacagtcacaagtcattctgtgattaaactcctcctacacacccttgttgacgcagccttatgagaaaaattttgcacaataagagaaactaggttcactctctggaactgtaccaagaaatactaagagtgaatcggctgacagggagaatagacactgaaagtttatgaatttgaagatacctgtagcaggtgatcaacaattaagtcagaatgaagtataaacaggaacgaagatcgcgtcgagagagaagaaggtagttgacagtgagtggagggaaaggatacttggaaggaaaagcagatacaagaatagcagagtcacgtactggaggactttgtgcctgatgatccccatctgtggtcgttcaacgcactcttcagcgctgccttaaatccggaaggagcatcttgtctgtcttgtctgagggtccctgaagcctgactccaggggctgtttgactccagtagacagagttcagcttttcttgggttccagtacaatgtggtaatggagtttagtcttgtttctccattacccaaagtatccttacaaaaattactttttaattatttgtagttacttgagcctctgatttttggaaccaaagtagcataactaacccaatataatattatatgaaatgacacatgtatttcaatatagttgcagtttgtttgctgttgaaatgtaaaaaaaaaaaaaaaaatgctttaatttgaattcttaggatctaggtgaacggttcatttcctacaagcaatcagttttgcagacctgcagttcatagtgggcagaataggtagcgaaaaaacccacagatctgttgtaaaaatctacctaacactaaagatataaagtaaaatttcaaaagtaatttaaaaactgttactcatatatatcatagccattttgaattttaaaacagatcaagtgtgttactctgcagttttctaaaatattacattatatggaaagaattcaaatacttttctaagtgcataagggtactgccaaagaatgcttaccaataattatactaatttaaacacctctgaagatttcaattttctacctccctgaccacatatcacagaggtgaaaaagagttgatcttgaatttttcaaggtttgtcatgcttgctgaaagattttaacacaactagatatttatatgttataaatatcataatcattatatagggaaccatggggaattagctggagacaggcactattctaagcatttttacagtttaatgtttaatcctaaatttattctaatgatatcagtaccattatcatccccaaactgcagatgatgaaacttaagcatagagaggactaacttacgcaaaatgacttatctagtaataggcagaatcaaaatgtaagcagccctttgaaataacaaaagggttaatgttaacaaaaggatcccataaataagatggtgagcattaatccttccaaatatttctgatattttaatgattaatctggatctgattgcaacatcttttaggctttctatgttttagaaattaggaggcaaaacttaattcatgagaccatatcaggatttgtagagataatgcacagaaagcacctggcctaatgcctgcattgagtaggtgctccacaatggtaatctccatctctgctctactgccttaagctccctgccctgcaatatgaacatgaggacttgcttgtaccaggtcttgcagttcgagaaacagttatctaaactcagtaaattctgttgactatttaccccatgcacatcacacacgttatttaggctgtccctggccatctccaactcctttgtcatactgccaggaggtattttcattgtcttatgcaatgctgatttcaagagttaacttagagctgggctcatgctggtatgcctagctacttgggaggatgaggcgggtgggtctcttgatcctaggagttcaaggctgaagtgagctatgatcagaccactgcacttcagcctgggtgacagagcaagatcctgtctctgacataaataaataaaaacttttaaaaagtggaagccaggagcagtggttcacgcatgtaatcccagcactttgggaacccgaggcaggaggatttcttgaggccaggagtttgagatcagtacatagtgagaccccgtctctacaaaaaaatacaaaaattagccaggcattttgccacatgccagtagtcccagctattagggaggctgaggcggaaggatctgcttgaacccaggaggcagaggctgcagtgagccaaggcaacactctgagcaatagactgagcaacagagtgagaacctgtctcaaaaaaaaaaaaaaaaaaaaaaaaggcttacatagatccattcacagttttgtttttcatgttaaaattaagtatatacttaaatatctgagttcattaaaataatgccttgaaacagaaagcaaaaagataaaaagggtgattggcttcaaatggcacttatgatcaacttgctttatggtacaagagaacctaagtacaaaaggaaaaatttctaccacagcattaattcgtaaggatggcttgtaatttactagtagagtcctgattaataaaatttatgcttagttgttcactacattcatgataatagcagttaattgcactaaatacatgtcaagcatcttaagtgcagagcatactaacaaaggcttaataagttttataatgtaaaaagggcacaacaaactgtctcttaagttctagctatgacaaagaaatttcagatgcatacacgacaggcagttacagagaaccattgcttacttatttgtaataattaacctacttttcttcaaagacaaactttgcatatcaaaataatacttctcatttaatggattctaattttatccattgtgactgatgaatcagtattatcaaatttggcagtggcagattatgttttcctcatttcactaagaaatttgcaagataataaattggattattaaattgttgtgtctcataagattcaagatttaaaacatttgtgctttgttaattaattgctgcaaattaaaaacaggagacagtcacataatggtggaatggatcagttatttcattaaacctcctctttatgatggtagattaagttaagctatgactgcattgaaaatgaagaagaggtagagctctaccttagagaatttaatttgtgcacaagaaaacctcatgaattcagattagtgtgagaagggttaatttaaatatatatggtacataggaatatttaatgtaccatatttatgtgtacttcttttaacttctaagtatgtatgacaatttctacaaagttacaaaatggttgtggaaaggtaaacctctttcagttttgcttctatcacagttaggaatttatttgtagttaatgtatgaattgttagtgtatagctcagtacttctgaagttcataaaaccattcagtgctgtgagtacataaacattttcctttgcaatcaagtttattgctattaactttattaacaaattttctcctacagactaaatacctagtaagtacaaatataaattttcattcactttatgtgattatttttatgttagaaatcaatggaatctaaataatattttcctgtctgtctcatttatacttagaatttcatcattatcagcaggaaacatttattgagtactcactatgtgccagtgactatgcaaaatatttacatgtaaaatctcatttaatcctcacagcagccctagaaacagtcccaagttacacaattaatatcatccccatttgacaagtgagaaaatggagttttgaagagattactcactgctccactgggtaaatttgctaagcagcagaggagaaatgaaattgctgtcttttggaatgcattgctatttaacttctatattatactgctatgtattatgcagaagaaatggacaaaaatgtgttaaattttggaaaataagcctctagcaaatatgcagatggtatagactccttaggtagcccccaccaaaaggcagaagtattcaattgtggaatgtcagaaaaacaaactctgccttttaaataatgatttgatactgggactacagcatagaaaaagcgaataaaaaatttagtgtcaaagtgagattacatatttacaagtctacaaaggcaagttagacatggtgaaaaaacactattatggaaatattattttgtggccccttaaaaattagaaacgtaaaatgtagccattagttacccagaaattgataaaatctatgttgtctgaaaaatggagtgtttctcctttcatttccagtaccggctttcctctttcacttactgtattttactcataattgttcattttttctcccctatttccacaaggcagaaaataataaagaattgtttgggaaactgttagctttgcaaatgttactaagttatattctggctgctaaaatggtttgaatagtatggagagaaaaaattatatacatatgtaggtattgagaagactgtgtaaatgtaattaatactgttagtttacagtaaagagatgctatgttgagagaagtgtggggggggaaagaatatcttatccttctatcctctgagtcctcagctgtagtcactataacaagatccattaacaagagaagagcatacaaatttatttaacataagctttatatgacacgggagacttcaaaggaaataaagacctgaataaatgattaaatttgagtatattttgtgctaggttcgacgaaaagtggagaattgcggggacgtgtatagaagcccccagaaaagtataaatacagtaaacttggaaaagcagcaaggcctgctcattcacattccttttgacatccctgtcttcaacgataaggatgcttctttctttccttttgatataggagcagcacctctcacataaggatcttatttcctgcttcagagaaagatcagaaaatcctttctaggttttacgtcttgctgcaggggaaaatcataaagtcctaactgcatgtgccatttctcagattccttccacttgaaatatgcaatttgccaaggtgccatattttggggtagcatgtcctaaatcctgtcaggagaaatgttttataatgctagacaaaattgtttaaagagaaaaaatgttattccccttattttcatcagtttggaactacaaagcaaacatcaataacattgtgccagttcagttaaaccttgtgtcacgagtacaattatggaatttccacagtataaaagcaccaatcctgtcactaattcttaatattaagtgagctcagacccatttatagtcactatgcacttctctttgcccttatcattcacaactatttaatcattgctaattctgccttgaatacaacagaacacttaaagggaggtgatacttgagctgtgctttccagggagagagagaggttattatctcatagaaattaagaagaagagagaacaggaaggtggaaaatgatcagaagatatatagaatgtcaggcgtgtcaagaaataataaataataggggtagctagattattcatagtaagggttggggaatgaaggtgaaagaaatgaaagttggggccagatggtcagagcaggatagtcatattaatgaattgaaactattatatgctaataaatgtgtgacaagcaatttatggttttaaagcagtagttagaaatatgatggcctgtgtttttaaaaggtaaatttggtgataatatagaagatgtatcagaagagggaaaatagaggcaaaggcataaactaattgattagtgcaattattaaggcaaatgaaggtaacgacttgaattaggaacagggaagagagaggcaaattccataggtagaccaaagaaaaaattcccaggagggtggaaaggaggggacactgtggatcgtggcagaggtggatgactctggtagctatctaaattcattagctaaatagtattgccattaatttaactatgaaatacgtaagaaagagtaagaaaagttcttccaaaggtacaaaaagtaccatagagtggaggtaaagtaaaataaaatacaggcttcggaagaacttgtgtaactgttaaagaaagaaactttgcattctttttattttctatcatgggatatctattatctctataggtaatagcacaaccaaaattgaaaccagtgtatcataatgttttataatggaaaaaaacttctaaaactgatcagaatgagacctcagaccccaaatattgttttcggtatagaagcagatcttagcaagaagtagatcttgagatttaaatttaaagagggactactacataaaatatgaagccaataatttaaactgtaaatattttgaggaaaaacccaatagcctaataccaacaaaaaagaaagaaaaagttaactgtgaaaacattttcaatgcatgggaatttttttgttgtaaaagaaaagaatgggcggggtgcggtggctcacacctgtaatcccagcattttgggaggccaaggtgggcagatcatgaggtcaggagatcgagaccatcctggtgaacacggtgaaactccgtctctactaaaaatacaaaaaattagccgggcatggtggcgggcgcctgtagtcccagctactcgggaggctgaggcaggagagtggcatgaacccgagaggcggagttgcagtaagccgagatggcgccactgcactccagcctgggtgacagagtgagactctgcctcaaaaaaaaaaaaaaaaaaaaaaaaaaaaaacatgggcaagaaccataggctctgtttctgattctgtctttgattcatttcatgttctagtacactttcctaatctctaacgttactaagtctaaaatgaacgttattaaatttccctttacatctcctctaaatatcaaacaaactcattgaatattgttttttctttattggaaagatctcagtgcttaactcctgaccaccaatttttgaattagaaataataacaactgaataggggttttgtgagaaacaaattaatattatccatcttttaaaagaactcacgtatatagtaaaactccgattgattctacttcaaaattgaatttcaaaaatgatatgattacaaaaataatcttattcagcttcacaggctgtatgaagtagaaaataagagttctaatgtttatttatcatttctgtgaagtaaatcagtaaaaattaaaagcgtgactccccaacctaagctttacaaattttcagtagtttggtgtgttttcttccagctaatctttcacacatataaacatagaaattcatttaataatgtttgcttctatagtgttttttatgaaatatgcgatcatattttatatgctaatctataatttgctttattcacctaatactgcctgagagacatctattcatgtcaattgaaagagatctgccttggtcatttcaatagctgcatatttttccgtggtatcatttaacatcaggatgatgcagccaatgaggggactcctggggcacagacaagagaaggggatagggacaacacagatattggtatagaaaagaactgaagtcctgtagagagtcattagataactatgagaaaatcaacttcaacaaaagcctgaattttcatcaatttttaattgtttccagtctgataagtaaaaaatttttactcttattaaggtgaacagctcctttcttgtgtttattaggctttgattttttttaaatttccctttcatctcagccacttttcctttcatttcttctatagatttttaacatgttaataatatgttccttttatattaataatattctttttgtcttttatataagctgtatatatttttccagtttgttgttttattttaaatgggggtttttgttttgctttttctttccaacttttatgtgaggttcagtgggtacataggcaggtttgttacatgggtaaattgtaagtcatgggggtttgatatacaaattattccatcacccagatgataagcatagtagccaataggtagtttttagatccgtactctcctcccaccctccaccctcaaggaggtcccaatgtcttttgttcctttctttgtgtccatatgcactcgatatttagctcccacttataagtgagaacatctgatatttaatttgtgttcctgagttaattcacttacactgatgacctccaactccatccacgttgctgcaaaggacatgattttattcttttttatacctgtgtggtatcctatggtacaaatgtcccaccttttctttatccagtccactgtgtatgggcttctaggttgaattctatgtctttgttattatgtatagtgctgtgatgaccatacaagtgcatgtgtctttttggtagagagatttgttttggttatattcccaataaagagattgctgagttaaatggtagttgtattttacgttctttgagaaatctccaaactgttttccacagtggctgaattaatttacattcccactagcagcgtataattgttcccttttctctgcaacctcaccggcatctgttatgtttttacttttcaatgattgccattctgaccaatgtgagataatatctcatggtggttttgatctgcatttccgtaatgattagtaacatcaagaattttttcacacgctttttggccatgtgtatgtcatcttttgagaagtctctgttcatgttctttgttcatttttaatgaggttgcctgttgtttttgcacgttgacttaagtttcttacagattctggatattacctttgccagatgtatagtttgcaagtattttctcccattctgaagtttgtccctttactctgttgatagtttcttttgctgtgcagaagctctttagtttaattaaatcccacttgtcaatttttcttttcattgcaattgcttttggggtcatcataaaatctttgccaaggcctatgtccagaatggcattttctaggtgttcttctgggttcttatagtttccagttttacattgtctttaattcatcttgagttgatttttgtatatggtgaaaaagatccagtttcaatcttctgcacgtgactagccagttatcccagcatcatttattaaatggggagtcgtttccccattgcttttgtcagctttgtgaaagaccagatggttgtaggtgtgtggccttatttctgggctctctgttctgttccattgttctatgtgtctttcttggtgccagtatcatgctgttatggttactgcagccttgtagtataatttgaagttaggtagtgtgatatctttggcttggttcttttttcttaagattattttgtatgtttgggttctttcttggttccatatgaatttagaatttttcttctaattctataaaaatgtcatttgccaaactgctttccaaaacaactataacattttgcattctcaaaagcaatgtgtcagagttccagctcctctgcatgcttgcatgtttgctagcccttagtattggtgggcttctgccttttgttttttttaagctattctaatagacatgtagtatcacatcataattttattggcaaatatctaatgactaataatgttgagcctatttgcatgtgtttatttcccatctaatttttttctctgctgaagtgtcattcaaatcatttgcccatttttattgagtaatgttttttctctattattgagattttagtgtaatgtatatatcctgatataagtcctttatcagtcacatgttttgcaaatttttttctccctgtttgtggcttatgtttttgttttctcaacagtgtcttttgaagatcagattttaattcatgaagttcaatttatcaatattttattttatgggtttacacctttgtgttacatctagacaatttttgcctaatataaggtcataaggattttctactatgttttctttcagaagttttatagttttaggtttggcattttggtctgtggtcctttttgagttaaatgtttaatttgttgcaaggtatgagtcaagatttttttcttttttgcatgtggttattcaagtattttagcatctcttgttgaaaagactgtcctttcttcactgacatactgttacacattgttgaaaattagccactcttgtaagagtagccactcttgtcttgtagttgaagacattctgtataaattattatattttcatagaaagctgcaaatacaagtaatgtttgttctttacttttaaaaaaacattttttcctcttctagtgcttttactttgctatgtcaattttagaatcagtttgttaatttccacaagaaattctgctagaattttgattgagattgcattgaatctatgaatcaatttgagaaaagataaaattctaacattactgagtgtatcagtctgtaaatacaatatattgatttaggccttatttaatttcttttttcaatacttcatagttttcttcatataaatcttgtacatattatcttagatttataagtatttaataacttttgatgctgcattagtccattttgacactgctataaggtgcacacctgtagtcccagctactcgggaggctgaggcaagagaatcgcttgaacccaggaggtggaggttgcagtgagccaagatcgcacaaccgcactccagcctgggtgacagagtgagacttcatctgaaaaaaaaaacaaaaaaagtgcccgagactgagtaatttataaaggaaagaggtttaattgactcacagttccacatggtgagggaggcctcaggaaacataatcatggttgaaggctgaggggaagcaagcagcttcttcacaaggcaggaggagagaggcaagagcacaggagggaactgccaaacgcttttaaaaccatcagatctcatgagtactcactcactataagagaacagtatggaggaaactgcccccatggggattacagatccctccctcaacatgtagggattacagtttgagatgggatttgggtgggaacacggagcaaaaccatatcagatgctattataaatgatactattattttaatttgaatttccaatagttcattggtagtataccaaaatacatgattttatattctgtgaccttatattttgtagcttcttaaattagttttttagacattttctatgcagacaatttttagtatgccattttttatgtagaaaaccatgttgtctgtgaaaagtcttatttcttcctttgctatctatatgccttttatgtatttctcttgcattttaacagaatttaggaactccagcacaatgttatgtagaaatactgagagtcaacatcatcatcttcatccttaagtatcaagtgtgagacttaactataattttagcagtagggttttgtagattctctttatgaggttaaaaaagttcactttactgtctttcagagggattttaaatcatgaatgaatgttgaagtttgtcaaataccttttcagcatctattgagatgatcataaaatttttcttccatagtctaacaatatggtaaattatgttgattcatttttgaaggttgaattaacattgtatttttgggataaacctctcgatcataatgtattgttcattttatatattgtgagattaaatttggtattttttgttgaagatttttacatctatgtttataagagatattctttagttttttgtgtgttttagtttttagttttagttctttagttctttgtttcttgtatattgtactataaagttaacataatcttattcttgattcaaataaattaaaatagctaagcaattttgcctttttataagcataaagtactcttattatatcacttataattttgatgccgcatattaattacataaaatctaatgtactacaaaatgtgttatgctagtatttatgctcaaatgaaaccttttgaaataaattgtttgcctagggttatttttatatcagtaaagtaaaatttaatattgaaaactaatttatatgtattcagattgtattaaattttttagaaaagttctgaacttaaatacttgataaatgtaaagcttctgatttaagttttaaaatcgaatgccttattagacaaattgataaaattggcagtcagtaagggaaactgatgcaacacactctaattttgatgaaaatatggactagagtagttctgtatgtgtcaatagtcttttcttatttgaggttgttttgaggtcatatttccttaggtaacactttccatacaggattatactctttttttattcgaacccccaaatgtggatgaatgtgagagctagctctgttctttgatataaatatttttattcatgtgtgcaagtctgtatatatatagagagaaaatacttctagtcttacattctggcatggagtgagtgtttacactgtaataaaaagactcggtcatcatattcattgggcttatattattaagagccttatcatgagactgaaaacacatgcaaacaaaataaatttttagaagcagtcagaatcttgtttttaacctaagcttgtttagtctaaaacacagacctgcctggaagttctggagtacagattagtgggtgtgtccaccaggagccattttgccagagggagtgaggaatctttgttcatataattcacatgaagataatagataatagaaaaaatagaagtacttaattgtgcttcaaagaaaatggctgagggacatatatgaggtgtgattttttagtgtcatatggtgtttgctattcagcttcatctgatctatcctcaaaagtgagacataaaaagacggagtcggccaggtatggtggctcatgcctataatctcagcactctgggaggccaaggtggttgaatcacctgaggtcaggagctccagactagcctgaaccaacatagtgaaaccctgtctctactaaatacaaaaaattagccgggcatggtggcacacgcctgtaatcccagctacttgggaggctgaggcaggagaattgcttgaacccgggaggcagagattgcagtgagccaaaatggcaccattgcactccagcctgggtgaagagtgagactctgtctcaaaaaaaaaagaagaagatggagtcttcgataaaagtgaaggagctcttgagacacaaacactcatcacaagacatccacagggagacccaggcaccattactttggcactgatataatgaagtctcttttcttaccatccaataactttttaacattaaactctagtgtgtaacatttttttttttacttacgaaagttcataaagagaaatgtcataaataaaagtatttatgaactatgtaataactactgtggtatatatgtaaaatgctgtattttggtttttaggcatgcttttcttcttcatacactaatacaatgtgtttggttttaggtttcctcaagagctgaacatgggaaaaataagtgccgaaattatgtggactctttttgctctggatatgaaatatgcattagaaggtaattataaatatttatacttattcgaatacatgttagagttaaatggtgatattgtgttcttggctttaaatgttgagaattgaaacattaaaacactgattactgtgatcagtttagttctaaaacttatttccgtatggtgaaaagataaggtctcaaagtactcaaaaagccctaaagaagtatatacatttttaattatatggtctaagttcttggatcataaaaatatttcactgataggattatgctcatatgcaagaatactttatggtagttcatttaccaaagcaggccatattgagggggtggatgagttgtttagtccagatatttgtctacgtggacttggaaatagtatccaccaggaggcgggtcaaaatcctaccaagtttgctcaagaacaatggcagaggtcttcacccgaaactccactctgaataagtacaaatcattcagtgtagaaaagagaaatacagctctaagttaaacaattctataaatattctttgtgcaccctcattgtgtttacagttagagatagaaccatagacctggttactatcctctagaaactaacaacctagtagaaaaatttctttgtacttattcagtgaatatatattgagcccatagatactaaatgaccattggtgcactggatgtaggggatgcaacagtgaacaagatagccctggtccccaccctcatcaagattgcagaggaggactacaagaatgcaaacagttgcaatgtggagtggtgaggacttatgatgacggagtgtctggagaagcacctacagcagacatggggctaggggacaaggcaggcttactatgggaacttcctctaagaaaatgtaactttgataaagacctaaaggataggtaggagtaagaagagcttttggtaggacagagcactagcaattagagaaagcacaaggtgcatttgagaagagagaactcagtgggcccaatgatcaagaaagaggtagcaagaagtaagacaggagaaattagcagggaccagcagacagggccttgtgggccatcgtgaggagtttgactctgtgctgagagaaacaaagtcccataaaggattttcagcaggtgcatgtcttacttagatttgcaacttagaaaaatcattttgattacaatatggaaaataggttgcgagagtgagacaggttttatagcgttcgtgtttatcatgctaatgtttaatagctttcctgtaccaggttgcagagggaacattcagtttttcttatttggaaaaaaaaggtactagatagatcataatatctagttttgtgataaagtcaggctctcccactcacaaatagagaggtttatctaatctttaaaatcacaccagaactgctcagaggtacaattccttactttgcaatgaggtgtttcttctacagtttattaatgacccagcccttcctacctcttccatctttgtctcctactaaccacatccttttacatctctctgctttcactgtctctttgggaccccaagattctcttacatcagacaggaactaccagtccactcagcaaataactttttttcagagagcgttcactaccctaggcctatactctgcatccccccaccctacttgaaagtctatcaggcatctgaagatttttagggtctgtatagattcttaatctcctttgtcagaacagactcttctctgctgttccctatagcagttattggtgccaccatttatgcagctacttaagcacttacgggttatcattgattcctttattgtcttcgctacagtaaaagtttattcctgcatgagggattttttggccagctgctctgatgcctggatttttcttcccaccaatcttcataagcagccatggagggctcagctactgacacctcctcagagaagatttccctcaccgcattatctgtagtagctcccaggaataaacttattttaatctgctgcgtaacaactgattttatttgtttatttgtttgttgatttgattatgtatgtgtcttttttaccaaaatgtaatttttttgtctatgacttttaccaacatatctacattgcctataatgatgtttagaaaatagaagctactcaataactacttgttgaacaaataaattgccaactttaccaggtaatcccaactcaatggattagtggcaagggcagtagaggagacatcattttgtgaccgtcttttgctgtgtgaccttgggaacattccaagagctcaacacctttgtgtttcactgttctccccttttgtttgagtagaacaaaactcagtgcattttcaaacatttattgcctttttgtatcataatgtataagctaaatgttatagaaagttgacaattaaccttaccatttaagttttagagtaaatttaaaacttactctaaatctatgtcttagagtaaatttaactggggacttgggtacaattctgcataactgtattttccatatttaactatgattcagcatacttcatatatattttgaagattaaagtgttttaatgctttttagtagaatagatggtcttactagtgacattttcaattatatgagattagagctttttgaaaaaaagaactatgttaaccatgtgtcagtccttaacacaagcctggcatatagtagttgctcaataaataatggttgcatgaaaatctaaggagcactaaagcagtgtgtaaatgaatatatatgagtagattagtgacataattcagaattattttcatttatattagagccaggcagttgtacattgttaaaatttcctatatgttttatgtatgtttgtttgtttgtttgtttgagacggagtctagctctgtcaccaggctggagtgcagtggtgtgatgttggctcactgcaacctccgactccctgattcaagccattctgctgcctcaacgtcccaagtagctgttttctagtcccttctatattgaagtacattgttcatcagtttaattgtccatattgatatttgcacaacagaatagtaaagctttagctcatcagaatgccttttagcctcaatccttacccaaaggctttctaatatataacaatctattttacattagcaaacacagcccacagaacacatggcaaaatgctgcttttatgagataaaaccacattttagccatcaaacagatttcacagactggttaataaaaatcagctgtcagactgtctaatacaaagtcgaaaaatattccattaaatcccctatgtcgttttagtggggaaatggagatcagggagaatagacgttgagaagcagggcaagaccaaggtggacagatgtgttctaggctcaccttccactgcttgttctgcatgtttcttcccgcaccctgtctgccctgccccttctttatctatatcttatgagcacctggtgcatttagggctttcgaagagattagacacactaaagcatttggggcatcctggttatcccttccaaaagatctgaaatcacaataaggaaataaacacattataattaaaaactgggagggttgggggcttggtaaatatatcctgcatacactgatgagctggaagtggctatgtgggaataaacataaaagacaataaaacgggagcaagaaatgaagctaattagcatccgcttttcacctctaaacacgtatctcagaaatttaggagattcttgcctcctttcatctttacattgaaggaaagcatcagtgttaataccattgacctaaacttggaagcacagttcctctttcacacttatagtaagcacattccacagtttcctccactggcagttcccttccaacccgcacactccctcctcccttgcaattgagttgaaactacttgttttgtatatctggagtagatagagaaggcaagctctgtataattaatctagaatcatgctgactaaaatatttggtttctaaataacagaagaaaaatagacatctaagactgtttgtaatgctattatttaggtacacctttgaccatctactaaatcactttgttatctatttcagtaaaagataattaaaatatgtttacctgagtaatataccatgctcttttgatagagatgaatacatcagagtaggtatgtaattaactggtcagccactttctctggtccaacttaaaaagtaatcaaatggaaagaacaggactaaactaacttctcaggctatgaatgtggtcccacttgtagtataggcaaatctatttgttgaacacacagctgggtgctctgatactattagaagttcaatggctaataacttcaataacttttaaatctgtctttctattatactatggtgaactttagcagaatctcacgtaaatggaaatgagtttccaaaagcccactgagctggtattagaatcaggatatggagacttacctgtttagatatttttaattagtagatggtcactatataaatagaacataaggccttaatgagtattttatccctgcctgaactcaaactctaagattctagttttatctcatataattctgcctctttggttttgaaataaggaacaacagtggacactgacattcaaggatttagttaagttacctggtcatctgtgctcctggaaaacactgagctttctcacatttttttgtttcagatggtattagaatttaaatttcttgttaactcaattcagagtctgtgttgtcgtgaatacagctggtctctcactgttgagcttggtactcactcaagtatgacaactttttttctttctctcttatatgaggcctcaggagactaaaaggctgagactgggtgatctttctctctccctcttacaacataccccctttctagttaattgttttagtagctaattatttttggtgtgcttaaggagtcagaaaagaataagatgaacagatcccctgcagtagcaccaaaatagtaaaagagaaactctcagcttggatacctaaaaaatataaggtttagggttagtgtatcagttacctattatgatataatgaattatcccaaaatttagtggctggcaacatacgtaagtagctcctgttgttgaagaactgatgggctgggggattgctttcctaggtgacatacttacatggctgttgagtagttgcgggctgtcagcaggagacctcagttgttctcagcatggacctctccacaaactccttgaccatctccaagatacagctgctagcttttcccaaagtgggcaatgcaagagaaaaggcagaagctgccatctttattatctatactgtgaagccacactcagtcacttctacaatatctcgttggtcgcacagttcagcttgttcagtgtgggagagagtatgcgaggtgatgaactctaagagtcaaggatacaggtgtcatcttgaaggctggctagcacaattagtatttgcctttctgatcatttctgtataatattagcatattcttattttaggtcaggtttttgtttgtgatgattttaaacaaaaataatagtcagtgtggataaaaccattttttttcccttcggcttcatttctctcagcccttcccataacaacaggaaaatgaggtgagcaagaaatgactcttgaaattttataaaaataaattattgtctaagatgctaaagctcttgttaaccctctctagttttcctcaccaagctcctctgggaagggaattctggttcactgaaaagaaattaaccagacactttcaggaaaggcattcattgatctactgtgctctcttcatttcagaacagtggttttcaacactgattatacattagaatcaccaggggtagagccttggccttttgaaacatgcccagatttttaatcttatttagcaattgcctatttagcacttgctaggtactggtttaaatgatttatgaatattaacttatttgatccccacaacaagcctatgaaataaatactatcattatcccccttttagagaggttattttgcctgaaattatattgcaattgaatggaagagccaagattcctggtgattctagtatgtattcatactagattgatgtattcatgattgagtaccattattcataacattaattacattttggtggccttcttggagaatctaataaaatatgtagactgtattactagaagaatgctaaatagcctatacatcaaaactctgcatatattctcccaaagatatgtatacaaatgccctatagcccaatcattgacttcttccaaggatccatggaccccaggttcaaaacttttgcttgctagagcagtgattatccctggaccagcagcatcagctaggcagttggtggaaatgcaaattcttgggccccatcccacatctacctaatcagacatcctgggaatagggcccagcaattcctgttttgacaaaacttccagttgcacctgatgtgcaccaaagttgagaaccactgctctagaaaaccgctgtgtggaagcaggtgatttaagtagcaaatgaacccatttcatgattctttatagacatctcattgttcttggctcatccttatgcaagtagaaactatcttctgttaaaacttggtttatttgataaaaatgatcaccaaaggaaaattactcacaaatattcatttaatttttcattaatacacacacttatgtattatgtattcaaggaattcccagaatgcttgctctatgccaggcattatgctagcaaggctcaatgcaacacaacaggcatgatccctgccttgagaaacttttactttacaataagcaaataattacacaaataaacatataagatttaaatcagtgatatggatgaaaagcatgtccattagacatctctaacttaaatgtttaaagtaaacctagaagtacaaccttctcacccaaaccctattcctctcttggtcttttttattacagcaaaatatgttaccatttgtggattatcagacattatctttgattccttatttctcttgctctaccaccatctccagacacttgacatagacaaatccataaatacttacctattctagctccaaagcatatttggctctcacacttctctccatctctactacctccaactagttctagccacaggcccccttcactttgatacctatcatagccctctaagtagtttgcacatttccactcttgctttcttatgatccattagctcataacattcagattgactttcacacacttagattacatcaagacattccctggtatataaaagtttccaaaggcttcctctttcaattgaccaaaatccattatttttactatggcgtataatgtagcatgtagtctgggctctacccatctttccaactttacctcattcacgttcctctcactcaaatgtagccacactgtcctcatgacttccttaactgagccaaatgtcttcccacaccagggcattcatatttgcttgcttttctgcctatgaagctgtttcccttctcttcatagagggctcctttccattcttcaagtctcatttcatggtcaccttcgttcacaaccctaccctgaccatcccatccctcagaacactcccacgcatctccaactcttttttctccccaaaacacttattatatctgaatcatattatttagcctggttatttgttcacttctttactactttttttctgtttttgatgccttttccttttttctgtttgtacatgttttggtcacaatccaaagcaaaaagaaaatacacttctacagcaatatagtacacacacacacacacacacacacaacgaaaaaaaaacttcatgaaatataaacatcatgataaagataacaaattctgaaattgtatttcttcatagctgtgtgtgtacattatatatatctgtatatacatgaagatattacatgtttataatatatagcatacatatatgacatattgcatataatttatgtatatatatttaaattctggtcataaccctctaaattgatgttatgacccactgatgggttgaagctagcagtttaacaacactgttcttaaaaataagcttcatagagtatgaaactttgtaatttcatttaaaattaaatactcctattcaaaaaataataattgaatattttgaaaatatattatgccaccttaaatctcacaaaatacatattttagatatattcagatatatttctatgttgataagtttgccagtataatacagcatatagataatttccccagcaatatttggaatttgacacaatttggggcctgtttttgtgtacctagctctttatttctaaatatacataaaaaatgttatatttatgcataaaaatgttttctcttcaaacaaattaagatattcatggtgaatgatcacatctcttgggcaaggtatttgaatggagcatttgaaaataaaaatctatagaaagccattattgccagaaggaaaaatatagtaagagttcaatcaagaaaataaagttggtattggctgaaaacaagggaacagagctaactgcattttgcatatgtcattatcataacatggtaggttttcacttatgtgaaaattatatatttaactttgtattttttctatcattttcctgctattagtttttcagccatgtaccatctgggaagagataggaggaaaaagaaaagagaaagtgatgaaaacttgcttagatttttcttccttattagtggtttttagaatttttttagagaaataataaattgaaagaattgttaaaattagtttagaaaatttcattttaaaaaggaaacagaaatatttacatgtcatggccttaggtgctcattgctgccttgctacctataataaagaggataaaattattcaggaacaaatgaatattatctaaactacttgaacttgaattgtggaacttgtaaatttggctgtctcctcattaaatcaaatgaatcacaagcccaacaatgcatgtagatatgtagatataaccaatgaaaaaaaaaatagctgtgactatttttgtaatatttcggtaaaaaaatctgtgactttgtttggagactgctgatactcagccagtgaaaatgttttggcaacaaaagaaacttgggaaggaggtagcagttggcatgaaatcagctttctagaaactttctcctgatgagaagcttaggaaaccatggttttttttgtttgtttgtttttatttggaaaccttccagggaaagctctgaagaaatgacctcctgttggttctgttgggttgactgtcaattacacatgtttgttttaagtgcgacctggctgcaaattgaggagaaggggaaaggacttgggtaaagcccatttatgctttagatcaaaccttttcaagcattatagataacattcacatgtgtgttatgctatcaagagaatacctgtaaatggtttgtggtgagtaacttcacagacatattaatcctatatcaatgggatattcaatttggcaaaaacaatagaattaggggcaagaaaatggcatttttagaatcatagtagaagaggaagatataggctagacctattgacagtctgctggctggaaaggacaggagcagcttggatcatggagcacatcttggagagaaaacaaaaatgtttcgtgggtaaattagtgtattgtgctgtgctctgctctggtcatccctctgcgtctccccaagaaacttcattgcactctgcattacttgtcattggaagggttctttaagaatgctccaaaatgctgatcttagcttcaaaatgtgtcctgataagccaaggctgacatgctatgtatacaatgccatgtgctacaagaaactccaggcctttctggcctaccagggaccacttcagcatgtgaaagagtatgagtgacattaggatatagtttattcttttacatgaataaacaaattatttgtaaaccttagtaccatcactagaatgagtagaaacacattacagtgagtaaaaactcacaattcactatgtagatggcagagttcaatgacaccgtgaccccaaatcactgctctggcttattggaaaaatacgaaagcagtaagtaaaaggataaaaactggacctggggctacaagagaagatttctacaatgaagggaggcaacaagtagtaagtggtttgcaaatgggagaattcacagtacaggtgaatcacaacccaagttatgaggctaaagaattttcatgctatgctccacataagaaaaacttacatggacaaccaggcatgagagatcttactaacagacccaaaggcaaatgacacctagaattaagtgattcctttctcaattattgtagtccctcttagtgctactattcaaagaaatttattcacctcctgagaagttagtctagatcagtggccttcacactgcgttctatggaacactaagttaaaatttcagggactgctttggtggtagctaaggttcagagaagaatgactactagccagctattttttcctctgtttgacatagtgtgtttattagtcatctatgcaacaaattatcaccaaagttagtgcataaaacaatgcaaatgcaaatatatcatcttagagaattttgtaggtcaggaagtctgatgtgggtttcattgggttaaatcaaggtgttggtagacagcctttctttctggagactctaggagagaatccattttcctttctctcacaagcttccagaggcttcccacatttcatggctgtggccatcttccaaattctttgtcagcaatatccaggtatttttctcatgactctaacaatgactctcctgcctccctcttccacatttacatgtcctgttgagtacattgagcagaactagaaatccagcataatcttttgtcttaaggtcagctgattagcaaacttaattccagctgaagccttaattcttctttgtcatttaacagaacatattcatattcagtaatctgggcatgatttcactgggtcctctgtcctagagtctcttacaggctgaaatgaaagtgtcatacaggacttggcctcatctgaaagttcaactggtgaaggttctgcttccatattatctcgtatggttgttgacagagttcagtttctcaaaagttatcacatggatggcctcacttcttccttggcatttggcctgtggccaccttcagtatctttacaagtagtgccctccaacatggtgccttgctttatcaaagtatgcaagccaagaaaccaagagtctgaaaacaaaaaaaaataaaagttgtaatctcttataacccaatcacagaagtgagaactcataacttttgttgtattttagtcattagaagcaagtcattaggtcaagtctatgtttaagggaaggggactaccccagagggggtaaatagtaagaagtagagattatttgggattattttaaaggctgcctaccatggagtgttgtttagtctcaaagacattggctttagtcagacaggatgagtacgaaaatctgtctccattacttacccgccatgcaacactgagcaattgttttgtcaactctgtacatcaatttattcttctgaaaaatcatattgttgtgaggattaaattaggtgctacgtgtaaaatggttagagaatttcctggtacatagtagtaagtgctcaaatattagctttggtgatgatgatcatcagtcttcacttgaatgaagaattcagtgctaaaacctgagttaaccattcagctagatatattctaaagctatatctgaataaagaatctatatgtttcattaatgacctacaaattcaatttttctactcttagaatatataaagcataacattttacaaataccagaggataatatgaccaaataatttcttcctttactattgaaaatgtatatgatatggtttggctgtgtccccactgaaacctcaactcgaattgtgtctcccagaattcccatgtgttgtgggaaggacccagggggagataattgaatcatgggggctggtctttcccatgctgttctcctggtagtgaataagtctcacaagatctgatgggtttatcagaggtttccacttttgtttcttcctcattttctcttgcttccaccatgtaagaagtgcctttctcttcccaccatgattctgaggctttcctcagctatgtgaaactataagtccaattaagcctctttttcttcccagtctcaggtatgtctttatcagcagcatgaaaacaggctaaaacagtatattatttttctgatttaaaaacttacaaaaaaattgaaaaatacaaagcacaaagaacttcagaattacccagtgtatttatccaaaaattatgtatacacttacatatttgcttttcacacatttaatacaattttatataaaacatttataactttaattttacataataattaaccaaaatactttttgtgaaagaaattgtagcttattatattttactattgacaacttttctttttatagtcataaatgttctcgacttagttatttggtcagcctatacctacaggtcaattttttgaggggaaatgttcatggattataatgttgtaagtccctgcatgtctgaaactacctctgttgtgcttgaaagacagtgtggctaagtatataattcttaagtgatacctattttctctcagaaccctgtggctacttctccattgtcttttggtatatagggttatagcaaagaattagaagaccagaataattttcttctttgaacacagcctgttctgttttgtttcagcctagatgtgaataataccttttatttatttcaaggttgaaaataaactgaagggtttctttcattgttagttgtgcctagtactccatgagtgcttaaactttgtagactcagatatctctttaattctaaaacatctttctactgtttctttgttttgatctgacaaaaatcaaatcatgtctctcttctgttcatgacccttgtcacacacagaatgaaatccagtctttaccctgaactggaaggccccgcattgttgctggaggccctgtctctgaactcatctcctttgactcccagctcatccctttgggacaatcgctctgaactctttgtccttccccaatcacatcatacaaacctgtccctcaggttgtctgcatatctgttccctctgcttggactactcttttcctgaatattcacttcaggtttctgataaggaaatcctttactactttataaaataggaaagtagagccaccctcaatctatcagccactgatatacttgtttattgcctgtttcccaccttagactgtaagctctgtgaaagggacttttctgtgttgtctactgttataaccctagcatctagagaagaatctgtcatgtggaaggtaggtacctaacacgtgttgcatgagtaaattcctcagtttaggttcctggtatggtctctgtgctagatctgaagtggatatgagtaagtacagctgcagaatccccaggcagtgtgccctttgatcccttgtttgcttccccaaatattgatagattgcaaatgtgcttgtactgtcccatggtgcttcctgactcctgccccaccctttctcggattggtggttgatcaatcactgaaggatttctgcctctttcttcacatgcttctctctcttccccccagcccccaatcgggtcccgtatttcccatatattgtataattccttaaagtttcttgcatgtgaatgctattcttctctagagtctaggcttttaaaggattttgtagcaatgaaatgaaacagtgctcaaaatgctttattatatttacggagttgtgcaatcaccattataatttaaatttattcatcattgcaaaaagaatctttgtaccattagcagccactctctgtctttccctctcattgaactgtagactttaaatgggtaaactttatgatatataaatcatatttcaataaaaagtaatttataagtgaaagtattatacgaatgtttttaattattgtgattgaaagagcaatacagaaattcctgaggacaagttaaagcattattcttttatgaacttcccatatttttccacgtctttatctttttaaaagtgtaatgatttctaatgttatcacattatccataattttctcaaatcacaacagttatttcccacaaatgataaaaagcagtatagaaacatatagttatatttagccttaacatattaactataactagtatttctcccatcatttctttaatcaaattcatttatgtatagcataatagaggtggataatttccattataaataggtattgatatttgtgaatatttattcacttgtaattttaatcagattttttcctaattgaattctacacaaggtacattcagattttatcatttactaatttttattatttatctccatgggaatttgatattgacatattgaaggcagtgtaatgacagcattgccattttgctattcctttaatttatttctatttgcctaaggagaactatgtcaatcactctgggagtaagtaacagaaagtaaaaagtaatatagttgtggataaaatgtaagtgatttgatttggagaataaaactgaattttaatggtattttatcttttatacttaaaaatgcatatggtacatcaaaatgcacacttgtaactaaaacactttatttccaaaataatatgccaatttgagggtgggaacatgggagcaaatgtttgtataactatcgcttattttttacagtattctatacattcagcatttttttaatttaaccctaagataacctctaatctaatagtatgttgacatgtttgataagtgaaaatttcagattctatattcagatttttgtgaataagaaaaaagctattcattctattttttaagttgtgctttatcaatttttgtaccacttacggtgataaagcatttttacatttagttttttactcttcaaattatgaaagtgtctggagcatattggttactgcttgatgaccaagtccaactgatatcagctattaaaacttttggaaaatttgtggtcagttgtaaaagaaatccaaaattattttactactactcttttcatgcttctttcgtattgaattttgcctctcatttatatgtttggatttttttttgctttcttatcatgctgaaggtttagacattttttaatgtgttaattgctcaaactcattagcctgttaagcctctcaacatcatataaggtaaatcagcattaaatattaatagaaattaaggtacacagaggttaaacaacttgtcaaattacattttctataccattgctgttaaaggagttatcttaagtcttgttttatcttgtttaaatttgcactaactgaataaaattttgcatgagaatttaaaacacattttgttttcactgcactaaatactatctcaggaatttcaagaactagaatgagctttctgggaaatggaggtctttcattcagttattccactgggaggttctggcatttgacaacaatatttaaatagctaatgtaactgagggaacagttggtgagtgggtttgaacaaatcttgcctccttagtgatccaagtcttcccacgggaaatttcagatgtcatgaaccatgttgcaacttctctttagagaaaacctgggcagaagatggtacacccaaagcagttacattaacactttttacttcctactgcccttgcaaacaaagtaatttgttaagtcactactcaatcaagaatattcagaataattattgctgacggagtactggacttggagatttattttttgaatgtttgcatttgttaaattatatatccaagaaatttaatgtataaagcagaaattcaggtttataacatgtgcaaatttcctggaataattaacaattttaaatattagatattcttaaatattgtgtcgccatattgggggatcatctctgccaactttacttctctgaatcacaagctttttttttctgccttgagagccaatactttttctgtgccttcacagtagttctgagaacttatctcctttttccattaatggctaaatatttggaatgtctaatagggtatctaatatgcaatatcacatattgtcagtacatattagtatattagagtgtacaactatctggttttatcttaaactctgaaatttgatgtcaaatatttttattgtttcactattcttgcaaaatccaatttttataaaacagatctacttaaagttaatatgcgctgcagtctatgtaatatgaattaattgccactgaggaagtatttttcaagactgttggttatacattcttcacattactttctttggtaaaaaacttctgtataaattggaaaatcatatgtgcaataagcacaagctcagagaattagaccatatggtctctgtagctataatacttggaggtatcagatagtcattctttaagatcattttaaaaatctactgcacagattctttctagagatcacattaatcaatttttacatttcaaaatagctagaagaaaataattcatatattcctagagtaacaaaaagataaatattaaggtgatagatattctaattaccctaatttgattatatgaatatatcaagttagcacatgtaccctgaaaacatgtacatctattatgtatcaataaaataaacaatttttaaagatatgatttctatatatttatatttaaatacatttctaacaaccacaaaaatgttactcatttgaccatttaataagctaatatttaaatagctactctgtgtcaggcactgtgctaagtacttgggacaataaagacatagaatctctgccctaatagagtccatagagtcagggagataggtatttaacaattattcttgcttatttaagtaagagcgactgtgatacctgttagaaaaaatgagtgtgtggtgttagaaaaataattgagaggggcattttgtcaggtgattcagaaaagcgttccataaggaagtgatttttgtgccaagatttcacaaacaagcaggatttaaccagttgaaaagggtttgtgcaatcaaattagaactcaggattaagaaactcactcaaaaccgcacaactacctggaaactgaacaacctgctcctgaatgactactgggtaaataacaaaattaaagcagaaataaattatttctttgaaaccaatgagaacaaagacacaacgtaccagaatctctgggacacagctaaaacagtgttaagagggaaatttatagcactaaatgcccacatcagaaagtgggaaagatcaaaatcgacaccctaacatcacaattaaaagaactagacaagcaagagcaaacaaattcaaaagctagcagaagacaagaaataactaagatcagagcagaactgaaggagatggagacatgaaaaacacttcaaaaaaatcaatgaatccaagagctggttttttgaaaagattaacaaaatagctgctagccagatgaatgaagaagaaaagagagaagaatcaaatagacaaaataaaaaatgagaaaggggatatcaccactgatcccacagaaacacaaactaccatcagagaatgctataaacacctctacacaaataaactagaaaatctagaagaaatggataaattcattaacacatatatcttccaagactaaaccaagaagaagttgaatccctgaatagactaataacaagttatgaaattgaggcatatcctaccaaccaaaaacagcccaggaccagatggagtcacagcagtattctaccagagatacaaagaggagatggtaccattccttctaaaactattccaaacaatagaaaaagagattcctccctaactcttttatgaggccagcatcatcctgataccaaaacctgccagagacacagcgagaaaagaaaatttcaggccaatatccctgatgaacatctttgcaaaaatcctcaataaagtactggcaaaccaaatccagcagcacatcaacaagcttatccaccacgttcaagtcagtttcatccctgggatgcaagtctggttcaacatatgcaaatcaatgaacataatccatcacataaacagaaccaatgacaaaaaccacacaattatctcattagatgcagaaaaggacttcaataaaattcaataccccttcatgctaaaaactctcaataaactaggtattgatggaacatatctcaaaataataagagctatttatgacaaacttataggcaatatcatactgaatgggcaaaagctgaaaacattccctttgaaaactggcacaaggcaagaaggccctctctcaccgcttttattcaacgtagtattggaagttctggccagggcaatcagatacgagaaagaaatgaagggtattcaaataggaagagagaaagtcaagttgtctctgcttgcagatgacatgattgtatatttagaaaaccgattgtctcagcccaaaattcctcaagctgataagcaacttcagtgaagtctcaagatacaaaatcgatgtgcaaaaatcacaagcattcctatataccaataatagacaagtagagagccaagtcatgagtgaactcctattcacaattgctacaaagagaataaaatacctaggaatacaacatacaagggacatgaaggacctcttcaaggagaactacaaaccactgctcaatgaaataagagaagacacaaacaaatggaaataaatttcatgctcatggatacaaagaatcaatatcgtgaaaatggccatactgcccaaagtaatttatagattcaatgctatccccatcagctaccattgactttcttcacagaattcgaaaaagactaccttaaatttcatatggaacaacaacaaaaaaaagcccatatagccaagacaatcctaagcaaaaaaacaaagctagaggcatcacactacctgacatcaaactatactacaaggctatagtaaccaaacagcatggtactggtaccaaaccagatgtatagaccaatggaacagaacagagacctcagaaataacaccacatatctaaatcatctgatcttcaacaaaatgacaaaaaggagcaatggggaaagtgttccctatttaataaatggtgttgggaaaactggctagccatatgcagaaaacagaaactggacccctttcttacaccttatacaaaaattaactcaagatggattaaagacttaaccataaaaccggaaaccataaaaaccctagaagaaaacgtaggcaataccattcaagacataggcatgagcaaagacttcatgactaaaacactgaaaacaatgacaacaaaagccaaaattgacaaatgggatctaattaaactaaagagcttctgcacagcaaaataaactatgatcagagagaacagacaacctacaaaatgggagaaattttttgcaatctatccatctgacaaagggctaatatccagaaaccgcaaagaacttaaacaaatttacaagaaaaaacaaccccatcaaaaagtgggcaatggatatgaacagatatttctcaaaataaggcatttatgcagccaacaaacacatgaaaaaaagctcatcatcactgttcattagagacatggaaatcaaaaccaaaatgagataccatctcacgccagttagaatggcaatcattaaaaaatcaggaaacaacagacgctggcgtagatgtggaaaaataggaatgcttttacactgttggtgagagtttaaattagttcagcaatagtggaagacaatgtggcaattcctcaaagatctagaaccagaaataccatttgacccagcaatcccattactgggtatatacacaaaggattatgaatcattctattacaaagacacatgcacacatatgtttattgcagcactgttcacaatatcaaagacttggaaccaacccaaatccccatcagataaactggataaagaaaatgtggcacatatacaccatggaatacatacagccataaaaaaggatgagtttatgtcctttgcaaggacatagatgacactggaaactatcattctcagcaaactaacacaagaacagaaaactaaacaccatatgttctcactcataagtgggagttgaacaatgagaacacatgaacacagggaggagaacatcacacaccaggtcctctcggtgggtgggggtgggggactaggggaggggtaacattagtagaaatacctaatgtagatgatgggttgatgggtgcagcaaaccaccatggcacatgtatacctatgtaacaaaactgcacgttaggcacatgtatcccagaacttaaagtataatagatttaaaaaataataaataaaaataaaaaaagaaactatcatcagagtgaacaggcaacctacagaatgggagaaaacttttgcaatctatccatctgacaaagggctaatatccagaatctacaaggaacttaaataaatgtacaagaaaaaaaacaaaacaaaacaaaaatcaaaaagtgggcaaacgatatgaacagacacttctcaaaaaaagacagttatgtggccaagaaacatatgagaaaaagctcatcatcactggtcattaaagaaatgcaaataaaaaccacaatgagattccatctaacaccagtcagaatggggatcattaaaaagttaggaaacagcagatgctggagaggatgtggagaaataggaatgtttttacactgttggtgggaatgtaaattagttcaactattatggaagacagtgtggctactcctcaaggatctagaactagaaactggtaattgtttcatgactaaaatattatgagcataatcaaatagctaaagatggacaagtatttcctctagaaataccatttgacccagcaatctcattactggttatatacacaaaggattataaatcattctgctataaagacacatgcacatgtatgtttattgcagcactatttacaatagcaaagacttggaaccaacccaaatgcccatcagggacagactggataaagaaaatgtggcacacatactacaccatagaatactatgcagccataaaaaaggatgagttcatgtctcttacaggggcatggatgaagctggaaaccatcattctcagcaaactaacacaggaacagaaaaccaaacactgcatattctcactcataaatgggagttgaacaatgagatcacatggacacagggtggggaacatcacacaccagggcctgtcgagggttgggggtcaaggggaagaagagccttaggacaaagacctaatgcatatgaggctcaaaacctagatgatgggttgatgagtgcagcaaaccaccatggcacgtgtatacctatgtaacaaacctgcacgttctgcacatgtatctcagaacttaaagtaaaattaagaaaataaaaagaaaaatttagaacaataaaaggaatagaaaaaatgcatttttgctatgcagttatcgtattaattttttaatgaaaaaattataagcaaaaagtacgtaacaaaatgtttttatttaagctgctggttttcaatattaacactgaccctgttagcccatagcctgcaaaatttgaaatttacatttctctgatggctgcctacagtgagattatttagtttatgtgcatatgcattcaccgatttggcatgtctggtaacaaacttgtcttttccccattgtaaaatcagtatccccttggataattgctttcactggtcaccgttttgcctcaaatattttttgtgtgtgttggcaaatccccagaaagttccaaaagaggaaatacatgtccatctttagctatttgattatgctcataatattttagtcacgaaacaattaccagctggcaagctttacatacatattcaatagcatctaaatattgttgttacatctattatataagcttcaaaggaactcactcaacagatgctctaaaatttataaaacttgtaactctcaaaacattggggcttcttggtaatataatctgagtctaatctatgactgatttgattgttcacattacagcttttccttccttagatctatctagtttgtttatttttgaggttcccacatgttccatttcttcaggattgagccattttcctgtaagtcacgccacaaagtttaatgatacaatagcttttgaggggagagtcttgctaggttagttagcacttaaggcatatcagagagtagtcagttagtccagttctgatcgattgcaaacaggaacactgttgacaaggaacaataatgatcactcaaggtcacacaggtggttagaacacagacgacatgtttgaacccatatatgcagagtatatccagtatggtttctcctatacattttataggatcatgattaagaccaagttttgaaatccatgaaattaaaaggattttaagtaaggtacttacaagcagctcaaggttttgctaccttttaggtatacgataaaagccatgtgtcattcctatgtcctttaatctcttaccttgtattctttgactatctaaaactcttacatttttctagttagcaggagtaagtgcattcataagagggaactagggtaaaatacacttcaagtcatcatcagtttagtctctttacaacatatttggtgaggttactcttaaggaaagcctatagactcatctatagaaaaaaaaggacacatgtctggaacagctcacattaacttttcaatgtaaaatcacctatccagcaggtgtagtcccatagaacttctaaactgcataaagtcagtgactgcatccttccaaactcaatggattctctgaagcgtgtcttctaatggctctgattcctctactaaaatatggatggaatataaagacgcccaactgtttgctcttcttctagtaaagactacaagatatgtccatgtctacaagagagctgcattttaaacattgaattcttttgtctaagtctttgtgttcaccaattgtaagcaagcacatttttaaaatgtagatttaaacggggttgaccactctgctctagtcaacataaggagtcctctttcttagttcctggttacatataactagaatcttcttccagtctctaaaatggcaagcagagcataccttaatgtttatgttcttgccatcaaggcataatttctctaatttgttatctaggtaaaatttctcaatctcttaaactgcttataatttatacaactgtgagttgcaattagtacctctagagagctggtggtgaggaaatatttctagaatcccaccagcacatcaagaatttatcctctcctcaaacctgttctttctcctgtatatcctatttttaattgtacttgacagcttcactctgacctcaataacccttcaagatcgctaagtaacattaagttcttccctcacctttacactttactcagagtccaagctcttaactcaataccttgtgttgtttgtaaatagcttactgaaatatattttttaatttaatgggttttagaagtttaacttataaagttctcacccttaagtatctggttctcttaccccttcttctcatacttacctgttactgcactagatcaggacaacattatcttcccatagaatccttcctagaagccaggctgctcaaattacctatgttctgctgctgtataaaatccatctaaactcaacgcatctctctcacaatctctgttacatggaatagtttgaaatacaaaacacttcactgggataccaggaataacagtagtaagtccaaaatcttttaaacaaattaattacctaatccttcatgaaagtgccatttatgtgtaggtgtgttactactcccaaaagatcagtaagaacccagtgcctttggtaggtttctttcgactatgtaatctagagtttacagtaaaatatataaaataggataaaattctcttcttcaaggaaaatgaaagttgataatgataattttgataattttgaagttatttgacttgtatatattgctcaattataatagaaataaattttaaattttaaattaccaagatcctacaatcctattctctagtcctacataagcatacaaaattttatataattgtaataatagcatagatgcatttatgtattttcacatatttttagatttttgcatattgatacaaagtctcaagtttttttatcaatatgtgatatttgtacatatttatggggtacatgtgatattttgttccatgcatataatatgcaaggatcaagataggatatttagggtatccatcacctcaaatatttatcattcctatgaattgggaatatttcaaatccttgcctctagctattaatattttgacatacacaatatattattgttgaccattctcacactactctgctgttgaacattagaacttatttcttctatctatggttgtaaccattaaccaacttctcttcatttcacccccactcctacccatacactcttctcagtttctggtatctctctctcatggtttggctgtgtcctcacccaaatctcatcttaaattgcaatccccataatgtatcaaggcagggatggagtgggacgttattgggtcatggggggtgggttcccccatgctgttttcttgatagtgagcgagttctcacaaggtctgatagctttataagtgtctagaatttctcctgcctccacttctctctcctcctgtcatgtgagaaggtccaaggtgctcccccttcaccctccatcatgattgtaagtttcctgaggccttcccactttacagaactgtgagtcaattaaacttatttcctttataaattacccagccttgggtatttctttatggcagtgtgaaaacaaacaaatactctctaatgctatgagaatcacctttttagctcccatatatgaatgagaacaggcagtactgtctttctgtgcctggcttatttcacctaacataatgacctccagtttcattcatgtggctccaaatgacatgatttcattattttttatggctgagtagtattccattgtgtataaataccacaccatctttatccatccatccattgataggtacttgggttggttccatatcttttctattgtgattagtactggaaaaaagatggggctgtagatatctctttgatgtagataatttcctttactctgaatagatacccaatagtgggattggtggatcctacagtagttctatttttagattttggggaaatctctatactgttttccatagttgctatactaatttacgtttccaccaacaacgtataagtgttcccttttctctgtaaccctgccagcatctatcattttttaatctttttaataatagctattctaactgggataaaatgatatctcattgtggttttgatttgcatttccctgatgattagtgatgtcgagcatttttaatatacatgttgaccacttgtatgtcttcttttgataaatgtctattcatgtcatttgactactttttgatgagattatttattttcttactgttgagttatttgagttccttctatatactgaatatttgttccttgtaaaatgaatactttgcaaatattttctctcattctgcagattgtctctttactctgttggttatttcatttgctctgcagaagtattttagattaatatagtcccagtcccatttgtctttttttctttctattgcttgtgcttttgaggtattagccctgaaatcctagcctagaccaatatcctgaagtgttttcttcaagttctcttctagcagttttattatagtttcaggtcttatgtttaggtgtttaatctatgtttggttgatttttgtatatgatgagtgataggggtccagtttcgttcttctacatatagatgtctaacttttctagcaccatttatttaagaagttattcttttcctgatatatgttcttggcacctttggagggaatcagtaggcacccttatcaaaaatcacttagctataaatatgtgaatatattttagggttctctattgtgttccattgttctatgtgtctgttttcataccaataccatgctattttgttgactatagccttgtaatatgttttgaagtcagatactctgatatctccagctttgttttttgatctgaatttcttgggctatttggtgtcttttgtggctacataggaattttaggattttttttttcatttatttgaaaaactacgttggtattttaatagtgggtacacttaaactattggttgatttacgtgtatgattgttttaacaatatttcttcttctaatccatgagcataagatatctttctatttgtgtcattttcatttgctttcatcagtgttttgtagttttcattgtggagtcttttatcatctttgtttaatttattcttaggtatttttttgtagctattttaaatgggattttcttctttctttttaaactagttcattattattgtatagaaacactactgcttttgtgtattgactttgtatcttgtaattttattaatttgtgtatacattttaagaattttctgatagagtcttttattcttttccaaatataatgtcttccacaaagagagataatttgacttattctttttccaattttgatgcctttttttctttttcttgcctgattgctctagcaaggacttccagtactaaattgaattgaatgaaattaggcatctttcaccacttgttccagttcttttttttttttttttttgagacaggatctcactctgttgcccaggctggagtgcactggctcccagattcaagcgattcttctgcctcagcctcctgaatagctgggattacaggcatctgccatcatgctcagctaatttttgtatttttgtagagaccagggtttcacaatgttggctaggctcgtcttgaactcctaacctcaggtgatccacctgcctcagcctcccaaagtgctgggattacaggtgtgagtcaccacgctcagccccagttcttagaggaaaggctttcagacttcctcacccagtatgatgttagctgtgggtttgtcatgtatagtccttattatgttgagttatgttccactatgcctagtttattgagaagatttatcatgaaaggatgctttttctacatccattgagatgatcttttttgtctttcattctttgatgtgatgtatcacatttattgatttacatatattgagctatcatggcattcctgggataacttgttcatattgtgctgtctttgtgatgtgctgttggatttgttagctggtattttgtcgaggacttttgtatctatgttcatcagggatattggcctgtagtttatttttgttgttgtgtccttttctggttttagtatcggggtaattctggccccatagaattcactggaaataattttttcctcttaattttttggtaataatttgaggttaattggtattaattcttctttatatatttgctaaaatttgagagtgaagtcatctggttatgggcttttctttctccacagactttgttactgattcaatctcattgctcactgttgatctggtcaggttttctattcttcctgattccatcctggaaggttatatgtgcccaggaatttatccatttcctctaggttttccagtttgttagcatatagttgttcataatagtctctgatgatcttttacatttctgtagtatcagttataatgtctcttttttcaattttgactttgtttatttggatctttttcttttattcttggttcatcaagctaatggtttatcaattttatcttttcaaaaatccaatttgtttcattgatcctttgtattttttagtctctcttttgtttagatttagtctgttgtttattatttctttctttcaactaatttcggatttggtttcttcttgcttttcttgtttcttgaggagcagcattagattgtttatttaaaaatctttttacttttttgatgtcagcatttattgctaaaaatttccctcttagcactgctttgactttatcacatatattttgctatgctgtgtttctatttttatttgtttcaataaactttctgattttcatctggattgcttcattgacccaatgatcattcaggagcatgatttataaattttcatgtatttgtgtagtttccaataggtcctctttgtattgatttctaattttattttattgttgtatgagaagacacgatgtcattttgatttttaaaatttgttgagacttgcgttgcagcttaacatatactctatcttggataaaatttcatatactgatgagaagaatgtatattccgtagctgttgaataaagtgttctgtaaaggtatattaagttcatttgctctaaaatttagtttaatttcaaagtgtatttgttaattttctgtctagatgatctgtctaatactgacagtaagttccctaccattattttattggagcccatctttccctttagatctaataatatccactttatatatctggatactccagtatggttacatatatatttagaactgttatgtcctctttctggatgatcccttatcattatataataatcttctttgtttctttttatagtttttattttacttaaagtatgttttatcttgtgtaaatatgacttctcctgctcaatttcggttgttgttgacgtggaatatcatttttcattcccttacttttgataaatgtatatatatacacaaatatatgtcatatatatacatatatataatatgtcatatatagtcatgtatatacatatatatgtatatgacatttgtatatgtcttttccattcctttactttgagtctatatatgtcagataacaggaaaagtgatcttttgtaggcatgatataactgtatcatgtacttttatccattcatccagtctatatcttttacgtaggaaaatttaatttatttcaattcaaggttatcattgatatatgagattttgttcctggtatattgttaattgttcactggatcatttgtatatcctttgtttcactttttctctcctattatttattattgtggtttgggattttctatagtcataacatttacgtcctttctcttcctaatttttttgtgtgtgctctaccagtgggttttatccttttgtgcatttttatgatggtggatgtcatccattcacttccaggtgtagaactggcttaagagtttattttttatatatatattacttttatatatatgtattttttattgtactttaagttctagggtacatatgtacaacgtgcaggtttgttacatatgtatacatgtgccgtgttggtgtgctgcactcattaactcatcctttacattaggtatatctcctaatgctatccctcccccctccccccaccccacaacagcccctggtgtgtgatgttccccttcctgtgtccaagtgttcacattgttcaatgcccacctatgagtgagaatatgcagtgtttatttttttgtccttgcgatagtttgctgagaatgatggtttccagcttcatccatgtccctataaaggacatgaacccatcattttttatggctgcatagtattccacggtgtatatgtgccacattttcttaatccattctgccattttcagacatttgggttggatccaagtctttgctattgtgaatagtgccgcaataaacatacatgtgcatgtgtctctgtagcagcatgatttataatcctttgggtatatacccagtaatgggatggctgagtcaaatggtatttctagggaatgggcacactgtcttctacaatggttgaactagtttacagtcccaccaatggtgtaaaagtgttcctatttctccacatcctctccagcacctgttgtttcctgactttttaatgatctccgttctcactggtgtgagatggtatctcattgtggtttgcatttctctgatggccagtgatgatgagcaatttttcatgtgtctgttggctgcataaatgtcttcttttgagaagtgtctgttcatatcctctgcccagttgttgatggggttgtttttttcttgtaaatttgtttgagttctttgtagattctggatattagccctttgtcagatgagtagattgcaaaaattttctcccattctgtaggttgcctgttcactctgatcgtagtttcttttgctatgcagaagctctttagtttaattggatcccatttgtcaagtttggcttttgttgccattgcttttggtgttttagacatgaagtccttgcccatgcctatgtccggaatggtattgcctaggttttcttctagggattttatggttttaggtctaacatttaagtctttaatccatcttgaattaatttttgtataaggtgtaaggaagggatccagtttcagctttctacctatggctagccagttttcccagcaccgtttgttgaatagggaatcctttcccaatttcttgtttttgtcaggtttgtcagagatcagatagttgtagatgtgtggtattatttctgagggctctgttctgttccattgatctatatctctattttggtaacagtaccattctcttttggttactatagccttgtagtatagtttaaagtcaggtagcgtgatgcctccagctttattctttttacttagaattgacttggcaatgcagtctcttttttggttccatacgaactttaaagtaatttttttccaattctgtgaagaaagtcattggtaccttgttggggatggcattgaatctataaattaccttaggcagtatggccattttcacgatattgattcttcctatccatgagcatggaatgttcttccatttgtttgtgtcctcttttatttcgttgaacattggtttctagttctccttgaagaggtccttcacatcccttgtaagttggattcctaggtattttattctctttgaagcagttgtgaatgggagttcactcatgatttggctctctgcctgttattggtgtataagaatgcttgtgatttttgcactttgattttgtatcctgagactttgctgaagttgcttatcagcttaaggagattttgggctgagataatggggttttctagatatacaatcatgtcatctgaaaacagggacaagttgacttcctcttttcccagttgaacgccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtagtaaatagcacttattattttgagatacatcccatcaatacctaatttattgagagtttttagcatgaagggctgttgaattttgtcaaaggccttttctgcctctattgaggtaatcatgtggtttttgtcttttgttctgtttatgtgctggattacgtttattgatttgcatgtgttgaaccagccttgcatcccaggtatgaagcccacttgatcatggtggataagcttgttgatatgctgctggattcagtttgtcagtattttattgaggatatttgcatcgatgttcatcagggatattggtctaaaattctctctgccaggctttggtatcaggatgatacctcataaaatgagttagggaggattccctctttttctattgattggaatagtttcagaaggaatggtaccacctcctccttgtacctctggtagaatttggctgtgaatctgtctggtcctggaatttttttggttggtaggctattaattattgcctcaatttcagagcctgttattggtctattcagagattcaacttcttcctggtttagtcttgggaggatgtatgtgttgaggaatttatccatttcttctagattttctagtttatttgcatagaggtgtttatattattctctgatggtagtttgtatttctgtgggatcgatggtgatatcccctttatcattttttattgcatctatttgattcttctctcttttcttctttattactcttgctagtggtctatcaattttgttgatcttttcaaaaaaaccagctcctggattccctgattttttgaagggttttctgtgttgctatctccttcagttctgctctgatcttagttatttcttgccttctgctagcttttgaatgtgtttgctcttgcttttctagttcttttaattgtgatgttagggtgtcaattttagatctttcctgctttctcttgtgagcatttagtggtataaatttccctctacacactgctttatatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgattacactatggtctgagagacagtttgttataatttctgttcttttatgtttgctgagaaatgctttacttccaactatgtggtcagttttggaataagtgcggtgtggtgctgagaagaatgtatattctgttgatttggggtggagagttctgtagatgtctagtaggtccgcttggtgcagagctgagttcaattcctggatatcctcattaactttctgtcttgttgatctgtctaatgttgactgtggggtgttaaagtttcccattattattgtttgggagtctaagtctctttgtaggtccctaaggacttcctttatgaatctgggtgctcctgtattgggtgcatatatatttaggatagttagctcttcttgttgaattgatccctttaccattatgtaatggccttctttgtcgcttttgatctttgttggtttaaagtctgttttatcagagactaggattgcaacccctgcctttttttgttctccatttgcttggtagatcttcctccatccttttattttcagcctatgtgtgtctctgcacgtgtgatgggtttcctgaatacagcacactgatgggtcttgattctctatccaatttgccagtctgtgtcttttaattggagcatttagcccatttacatttaaggttaatattgttatgtgtgaatttgatcctgtcattatgatgttagctggttattttgcttgttagttgatgcagtttcttcctagcctcgatggtctttacaatttgacatgtttttgcagtggctggtaccggttgttcctttccatgtttagtgcttccttcaggagctcttgcagggcaggcctggtgatgacaaaatccctcagcatttgcttgtctgtaaaggattttatttctccttcatttatgaagcttagtttggctggatatgaaattctgggttgaaaattcttttctttaagaatgttgaatattggcccccactctcttctggcttgtggagtttctgccgagagatccactgttagtcttatgggcttccctttgtgggtaacccgacttttctctctggctgcccttaaaattttttccttcatttcaactttggtgaatctgacaattatgtgtcttggagttgctcttctcaaggagtatctttgtagccttctctgtacttcctgaatttgaatgttggcctgccttgctaggttggggaagttctcccggataatatcctgcacagtgttttccaacttggttccattctctctgtcactttcaggtacaccaatcagatgtagatttggtcttttcgcacagtcccatatttccttgaggctttgtttgtttcgttttcttcttttttctctaaacttctcttctcgcttcatttaattcatttgatattcaatcactgataccctttcttccagctgatcaaatcagctactgaagcttgtgcattcatcacatagttctcgagccatggttttcagctccatcaggtcctttaaggacttctctgcattggttattctagttagccattcgactaatcatttttcaaggtttttaacttctttgcaatgggttcaaacttcctcctttagcttggagaagtttgatcgtcagaagccttcttctctcagctcatcagtcattctccgtccagctttgttccactgctggtgaggagctgcattcctttggaggaggagaggcactctgatttttagaattttcagtttttctgctctgttttttccccatctttgtggttttatctacttttggtctttgatgatggtgacgtacagatggggttttggtgtggatgtcctttctctttgttagttttccttctaacagtcaagaccctcagctccaggtctgttggagtttgctggaggtccactgcagaccctgtttgcctgggtatcagcagtggaggctgcagaacagtgaatattgaacagcgaatgttgctacctgatcgttcctctggaagtttcgtctcagagggctacccagccacgatgaggtgtcagtcttcccctactgggggctgcctcccagttaggctactcgggggtcggggacccacttgaggagtcagtctgtccgttctcagatctcaaacactgtgctgggagaaccactactctcttcaaagctgtcacacagggacatttaagtctgcacaggtttctgttgccttttgttcagctatgccctgcccccagaggtggagtctacagaggccggcaggcctccttgagctgtggtgggctccacccagttccagcttcctggctgctttgtttacctactcaagcctcagcaatggcgggcgccccttctccagcctcgctgctgccttgcagatggatctcagactgctgtgctagcaatgagcgaggctccatgggcttgggaccctctgagccagacgtgggatataatctcctggcatgccgtttgttaagacgattggaaaagcacagtattagggtgggagtgacccaattttccaggtgcggtctgtcacagctttgcttggctagtaaagggaattccctgaccccttgcgcttcccggttgaggtgatgccttgccctgcttcagctcacgctcggtgcactgcgcccactgtcctgcccccactgtccgacaagccctagtgagatgaacccagtacctcagttggaaatgcagaaatcacccatcttctgcatcgctcacactgggagctgtagactggagctgttcctatttggccatcttggaaccacccaagagtttcttttagggtcagtcagtttttgcttgtcagggaaagactttattttgcctttatttatgaaggataactttactgtgtatagtatttttggtggatactttctttttcttttcagcactttgaatatatcatctctgtaagagatgtaagcttctacgtgttattttgttaaatagagttttttaaatattttttcctctccttctgggtcactgaaaattcatatatttagtcattttatgctaaagagtttattgcagggtcagtctagtgatgaggaattacctcagtttttgcttgtcagggaaaaactttattttgcttttatttatgaagggtaaatttttggggtgtagtatttttggtggatacttttttcagccttttgaatataacatctatgtaagggatgtaagctttacctaatattttgttaaataggttttttttattttttgttctccttctgggcctctgaaaatttacatatttagtccttttatgctgtcccatatgtcatgtaggctttgtttcaactctttttaaaaaaattgtctgactggattattttaaagacctgtctttaagttctgaaattctttcttctgctggatctagtcttttgttgaataaatgcattttttacttcattcaatgtattcttcagttccaggatattttggttattttatattatagctatctcttttgtatgtttctcatttatatcctgaattgtttttctgatttctttgtattagttatctgtattgtgttgttccttactgaccttatttaatatcattacttttaatttttctggtatttgataaatttctttttcattggaatatgtagctgcagaattattgtgtttttttggaagtgtcatatttccttcctttgtcatgtttcttgtgtccttatcttggtatctgtgcacctgatataacagttgcctcttccaattttttggatttgctttcatagggaaggacttcatactgaatgtgtatctgtgattttggttaggtagggaacattggctttgattctcagtgcatgcagtagtgtattatttgtatcatttatttgaccatacacagccaaatcagtggtatctgtgatttcctcagtgacttagggtgtgattcttagtggagactgtggcgaagctttgcttaggatggaggcatcacctgggtgagtcctcagaccccagtgtgagcagtgatggagcaaatgtagctgttcttgagcccaagagcaatgtacactggcctccatattggcaggtccaggagggccaattcttgggtctccacttggtttgctcagatgccagcagtggcagcagtgggtcaggttggtgggtgggtccttgtggccctggatagtgcgtggattatggcagttatagtggtggctcaatgctctggttcccaagccatctgcactggtgttgaacatggctgagacaggctgggcaagctggtcttctgtcccacaggtggtgtataggggtgggtacctacagtggtggcaacagcaggctggatgggcccatcttcagctgctgagaggaatgtttaggtgcaaatgctggtggatagggcaggacaatcccaagattcctggacagcatgctcaggtactaggggaagttggagaaagccaggttgggaaaacctgtcctcagatttccccatggtgcatagaggttggctgtggtcagacggagtgatcctcagaccccagcagcatgcttttgtggagatggctgcatctgcactgtggccctgctactgctaagggccagtttgctttcagtgtcggcagccataggtagctggctggggagtgtgcactttggccccaggtggcagctgccaatggagcagccacttttctatgtgcatgaaaacgcacagcagcccttctttctgggaaaatagagttgctgccagtggctcacatttagcccaggtggcagtagccagcagcagcagctctcagcaggggatgacaatgggattctaagggtgtggaaatgcagaggctgttggggcccaggacaggatgcattctggtggtggctaggttctcaaaatggcaccattttgtagctgcttagggcttgagtttccagtatgagggaccaaacctgagctcattctctctctctaaagcaatgccattgcacagtctccaggcagctttctctgtttatctccgtgcccacaagtgtcaagaaacattcccttggtaggattggaggggtccatggtgggaatgtagactgctagggatcactcacttacccttttcctgcactgttgagtctcactgggctcccagatgatactagctgagcaggctaccttgcttctctgtccttccttcttttacatgtctcctgtctcttatctgttgaatcctgatgttctctcttagaggatctattgaaagcatgactaccaactcactatttgttagatgcctctagtcagccatcttgaaatccctcttcagatggttacataatattccaccaaatccataaccttcagctttttaactacaccctatatttggataatcaggttgttagattttttaagtactgtaaataatgctacagtaaaaagttcttgtattttgccttttcctcattttgtttacatctttgtgcaaattatcaggaatgaatttactgagtcaaagatgattaacatgctataccttttgaaatatattgacaaatttttttctgatgttttcaacagtgttcactgccaccagctataaatagatattctcagttaagcacacttttgacaaaatggaatgtaggaattactttttttgatatagtatattatttttaatgtaggtgaaatacacataaaatttaccattttaaagtgtacaattcagtggcatttagtttattcacagtgttgtgcaacgagcaccccatctagttacaaaatattgtcagtttccccctccctcagcatctgataaccatctaccttctagctctgtggattggcatattccagacatttcatataaatgcaatcataaaatatgttgccttgtgtctggcttctctcactcagcataatgttttcaaggtttacccatattgtaacatgtattggtactttattcttttttataatttttattgtgatatatatatatataaaatacaatttaccattttaaccattaatatgtgtgcaaatcagtggcatgaggtgctacattcacaatgttgtactattatcaccatctattttcaggactttttcatcttcatccccaagagaaactctgtacccagtgaacaataactccctggcggggtgcagtggctcacgtctgtaatcccagcactttgggaggccaaagcaggcagatgacctgaggtcaggagttcgagaccagcctagccaacatggtgaaaccccgtctctactaaaaatacaaaaagttagccgggcgtgttggcgggcacctgtaatcccaaggtctcaggaggctgaggctggagaatcacttgaacccgggaggtggaggttgcagtgagctgagatcacaccattatactccagcccaggcaacaatagtgggggaaaaaaaaaaaacaacaataactccccatgcccttcctccaagcccctgatatcttctattctactttctttctctatacatttacctattctgagtacctcatgtaggtggaatcatacaatttgtgcatggccttttgtgtctggcttctttcacccaacataatgttttcaagtttcatccacagtgtagcaactcccagtactccatctcttttttaaattttatttattcattcattcattcattcattcattcattcagtagtttcaggggaacaagtggtgtttgtttacatggataagttctttagtggtgatttctgagattttagtgcacccatcacgtcagtagtatacactacaccaaaactgtagtcttttatcccttaccacccttgcccccaagtctccagagttcattatatcattattatgttacattaccatagcttacctcccacttataagtgagaacataggatctttggttttccattcctgagttacttcacttagaataatggtctccaactccatctaggttgctgtgaatgccattatttcattcctttctatggctgagtcatattcctctctctctctctctctctctctctctctctctctctctctatatatatatatatatatatatatatatatatgttttttaatccactcattggtagatgggcatttaggctggttttgtatttttgcaatcgcaaattgtgctgctataagtatgcatgtgcagtgtctttttcaaataatggcttaatttttctctgggtagatacccagtagacggattgctggatcaaatggtagttctacctttagttctttaaggaatctccatactgtgtttccacagtggttttactagtttacattccctctagcagtgtaaaagtgttccttttcagcacatccacaccaacatctgctttttttttttttttttaattatggccattcttgcaggagtaaggtggtactgcactgtggttttgatttgcatttccctgatcactagtaatttgagcattttttcatgtttgttggccattttatatcttattttgagaattgtctattcatgaacttagcctgatttttgatggggttatgattattattatgattattattttgctgatttatttgagttccttatagattctggatattagttatttgtcaaatgcatagtttgcaaagattttctcccattctgtgggatgtctgtttactctgctgattattccttttgttgtgcagaagctttttaatttaattaaatcccatctatatatctttgtttttgttgcatttacttttgggttcttggtcatgaactctttgttcgtcattgtctcaaagactttttctgatgttatcttctagaatttttatggtttcaggtcataggcctaagtctttgataaatcttgagttgattttgcataagatgagagatgaagatccagttttattcttctacttgtggcttgccaattatcccagcaccatatgttgaatagggtttcctttccccactttgccgagcatcagttggctgtgaggatttggcctcacttctgggttctctattctgttccattggcctacatgcctgtttttcataccaatatcatgctgttttgataattatagacttgtagtatagtttgaagttgggtaatgtggtgcttccagatttgttcttttttgtttagtcttgttttggctacgtaggctcctttttggttccatatgaactttaggattgttcttttctaattctgtgaagaatgatgatggtattatgggaattgcattgaatatatagattgcttttggcagtgtgatcattttcataatattggtcctacccatccatgagcatgggatatgtttcaatttgtttgtatcatctgtttctttcagcagtgttttgtagttttccttatagagatctttcacctcttttgttaggtttactcctatgtattttatttatttatttatttatttatttatttatttatttatttatagttgttgcaaaagggtttgagttcttgatttgattctcatcttggtcactactggtgtatagcaatgctcctaatttgtgtacattgattttgtatcctgaagctttactcaattcgtttatcagatctaggagctttttgaatgagtttttagggttttctaggtatatgatcatatcatcagtaaacaatgacagtttgacttcctctttactgattcggatgcccttcattactttctcttgtctgtctgctctgactaggacttccagtactatgttgaatagaactggtgaaagtgggcatccttgtctagttccagttctcagatggaatgctttcaacttttccatgttcagtataatgttggctgtggtttgtcatagatggtttttattaccttaaaatatgtcccttctatgctgattttactgaggattttaatcaggaagggatgctggattttatcaaattctatttctgtgtctgttgagatgatcatatgattattgtttttaattctgtttatgtggtgtatcacatttactgacttgcatatgttaaaccaaccctccatccttggtatgaaaccctcttaattatggcatgttatctttttgacatgcttttggattcagatagctagtattttgttaaggttttttgcatttatgttaatcacggatatgttctgtagttttctttttttattctgtccttccctggtttgggtattacagtgatactgccttcatagaatgagttagggaggacttcttctttctctatcttttggaatagtttgagtgggattggtacccattcttctttgaatgtcttatagaattcagctgtgaatccatctggccgtggacttttttttggcaatttttttaaagactattttagtcttgctacttgttcttgctctgttccgagtttctattttttcctggtttaatttaggaggcttgcatctttccaggattttatccatatcctctacgttttccagtttgtgtgcatataggtgttcaaattgccttgaatgatcttttgtatttctgtggtatcagtagaaatatctcccattttgtttctaattgagcttatttggatcttctctcttctttttcttggttaatctcactaatgatcttttgattttgtttatctttttaaacaaccaggtttctgtttcatttatcttttctatttttttgtttcaatttcatgtagttctgctctgcttttcgtttttttttttttccttttttttttctgctactggatttgggtttagttcgttcttgtttctccagttccttgaggtgtgagcttatattgtctacttgtgctgtttcagatatttagatgtaggcatttaagctattaacgttcctttaagcaccacttttgctgtatcccacagatttttattggttgtgtcataattatcattcagttcaaggaatttttaattttccatcttgatttcattgttgatccaaatatcattcggggcagattatttaatttttatgtatttgtatagtttaatagttccctttggagttaatttccaattttatttcactgtgacctgagaaagtactatatatacttttagttttcttaaatttattgagacttgttttgtggcctatcatatggtccgtcttggggaatttcccatgtgctgatgaaaagaatgtatattctgcagttgttggttagaacgttctgcaaatatctgttaaatccatttgttctagggtataatttaagtccattgtttctttgttgacttttggtcttaatgacctgcctagtgctatcagtggagttgacattgaaatctcctacttttattttgttgccatctatctcatttcttagatatagtaataattgtcttataaatttgggatctccagtgttagatgtgtatatatttagaattgtgatatttcctattagactaacccttttatcattatagaatgtccctctgtcttttttaaactattgttcctttaaggtctttttttttttttttttttttttaagggaatagctactcctgctcacttttggattccatttccatggaatatcttttccatccctttaccttaagtttatgtgtatccttctctgttaggtgagtctcttaaagacagcagatacttgattggtgggtttttatccattctgccattctgtatctttttagtggagcatttaggccatttatattcaatgttagtattgagatgtgaggtactgttctattcttcatagcagttgttgacttagtatctttttttcattgtgttattgatttataggtcctgttgatttatgctttaaagagattctattttggtgtattttgaagttttgtttcaagacttaaaattctttttaacagttcctgtagtgctggcgtggtagtggtgaattctctcagcatttgtctgaaaaagactttatctctccttcatttacgaagcttagtttctctggataaaacattcttggctgataactattttgttaaggaggctaaggataggacctcagtcccttctgacttgcagtttttctgctgagaaatataccgttaatctgaaatctactgtttcctttataggttacctgatgcttttgtcttatagcccttaagattctttccttcatcttgactttaggtaacctaataactatgtccctaggtgatgacctttttgtgatgaatttcccaggtgttctttgaccttcttgtatttggatgtgaagatctttagcaggatcaggggagtaatcattgattattccctcaaataagttttccaaactttttgatttttcttcctccgcaggaacaccaattattcttacgtttggttgtttaacataatcccaaatttcttggaagtttttttcatttttttctcttgtttctttgtctttgtcagattgagttaatttgaaagccttgtctttgagttctgaagttcattcttctacttgttcagttctattgttgaaactttccagtgtattttgcatttccctaagtgtgtcttttatttccagaagttgtgctcgtcttttctttatgatgtctatttatctggagacttttgcatccatattcttttttttttatttctttgagttacttttcacctttctctggtgccctcttgagtagctaaataataacaatcaaacttctgatttctttatctggtaattcagagatttcttcttggtttggatccactactggagagctagtgtgatattttctgagtgttatagaaccatgtttattcatattaccagaattacttttctggttccttctactttgtgtagactgtttcagtggacagatctgcggctcaaactctgctgttcagattattttttcccattgggtgatcccttgatatggtgctctccccctaggaatggggcttcctgaaagccagactcgagtgattgttattgcccttctaagtttgtccacccagtagggctactgagctctgggcttgtgctgtggaatgtttgtaaagagtcctgtgatgtgatccatcttcatgtctcccagccatggataccagcacctgctccagtggaggtggcacaggagttaagtggactctgtgggagtccttggttgtagttttgtttagtgtgctggttttcttgaatgctggttatgctagcagtgaagctgtcacttcaacagactcaggacctctgattagccaggttattgctggcagtagaattagctgttgtcttctccttcattggagcagggttgttctgttatgagtggctgtaatggctggagttggttggcctccagccaggaagtggcactttcaagagagcaccagctccagtaatagaagggggatataatcttaccctaagttggccaggataagtacttgggtttctcaggcaatgggcagggtcatagagctcccaagagtttacgtcctttgtcttcacagttttccagttgtcttgcagcatttgcagtagcaagctgcttctttcaaagggtctgtgaattttttcggtttttctggtatgttcttgcagtggtccttgaagcagaagttcacaaaatgaatctccacacactgttctgtccatccaagtgggagctgcacgttagtcctgtctcctattggccattttcctctcaagtctagaatataggaataacttcaaatctgctgttgtaatagttataaattaaaaccttattgtttgtttatattttttatttattttataacaaaagagtggaacatattttatgtttgttgactaattttatttcttgcatttttattcatgactttccccttaaatattggtcttcaatcagtatgtttgaatttcttatttttttgacttatttataaaatataatttttaatttttaaaacaattgctgcatatatttttcttaggatatttttattcaagttatattatttttgttgtaaagatttattataggttgagcatcccaaatccaaatattcaaaatctgaaatgttctcaaatttggcattttttgagtgctgacatgacactcaagggaaatgctcactggaatatttagaatttggattttcagattagggatgctcaatcagtcaatatattgcaaatattccaaaattcaaaatccaaaacactactggtccctagcattttagataagggatatttaacctgtatatcatataatctatctttgtatttatggtttcttttagcttaaatgtcatctagcaaaatattttgttagtctataatttgatttatatatgtgtgatgttctttaatctccatggtcttcattttaatattaaaaatccattaataattgtgaaaatactacatgtatttatgattatgggaataatttagtagacagagaaaaattgataatgcagaagagaaagtacacaattgtgacaattgagtcattgagtaaatcaggtaggattcactaaataaatagactggctactcttagataatagtatgagtaggtcagccacagtagcagaaggagaggcaaagtatgtgtctacagaagagagcagattggtaaatgtggtagtgatagatgtggatactaactgatcagttgagagtgaggagatttgaggggttgttcaatgtttgaagaaaaagaagaatactggtatgaaataataacttctgagagtaggaagcaaagatagtgaaatgcagagatcactgtcagtactggtcttaccttcaagtgatgaccacaaaccttttgagttttgtggccatcacttgaaggtatgactagtcagcagagttgtatgttttccagtcatgttaagtactgggatacaagcacaaaatagataaggatttgggtttacccaagttaggcctttgccaggggtgtgacaaagaaaaagagaggccaagtagttgagcatgtatataaaagagagactacaatcatgagccacaaactcataataaaaagaaaatagaattatgaagggactatttatagagaaaatgtaaatctcagtggatataagagggagtgaaattgagaggtgacaatgtgctggtggccctcattcgctctcagtgcctccttcgcctaagcgtccactgtggccatgcttgaggagcccttcagcccacagctgcactgtgggagcccctctctgggctggccaaggttggagctggctccctctgtttgcagggaggtgtggagggagaggtgcaggccggaaccggggctacgcactgcactcgcgggccagcgccagttctgggtgggcgtgggcctggtgggcccacactttgagcaactggccagtgcccccggccccggggagtgaggggcttagcacctgggccagcagctgcggagggggcgccgggtcccccagcactgccggcctgcccgcaatgcgcttgaattctcaccaggcctcagccacctccccaggggcagggcttgggacctgcagcccgccatgcctgagccccccaacccatgggctcccgcgcagcccgaggagcctccctgacgggcgccaccccctgctccacagcgtctggtcccatcaaccacccaagggctgaggagtgcaggcatgtggtgctggactggcaggcagctccacccatgggcctggcatgggatccacaagacgaagccagctgggctcctgagtcaggtgggggcttggagaactttcgtgtctagctagagaattgtaaatgcaccaatcagcactctgtgtctagcttgggggtttgtggatgcatcaatcagcactctgtgtctagctaaagtttgtaaatgcaccaatcagtgctctgtgtctagctaatctagtggggacttggagaacttttgtgtctagctaaaggattgtaaatgcaccactcagcaccctgtgtctagctcaaggtttgtaaacacaccagtcagcaccctgtcaaaatgggccaatcagctctcagtaaaatgggccaatcggctctcagtaaaatgggccaatcagtagaatgtgggcgggggggggggggggggccggtcaggtaagggaataaaagcaggctgcctgaagcagcagtagcaacccactggggtccccttccacactgtggaagctttgttctttcgctctttgcagtaaatcttactgctgctcactctttgggtctgcactgcctttatgagctgtaacactcaccgcgaagctctgcagcttcactcctgaggccagcaagaccacgaacccactgggaggaatgagcaactctggaggagaggagcaagcaattccagacgcgccgccttaagagctgtaacactcactgcaaaggtctgcagcttcactcctgaagccagccagaccacgaacccaccagaaggaagaaactccgaacacatccgaacatcagaaggaacaaactctgggcacaccatctttaagaactgtaacactcactgggagggtccgcagcttcattcttgaaatcagttagaccaagaacccaccaattccggacacaaaatgaaaaccagatcaagaagtaggatgctcgtcaaaaggcagaattcttgaaattgagagttgaagggaatgccattgttggtaatgacatgacagagggtaagaccatgggaggggatggctgaagtggaagaagggacaagcccaatggagaagagaaggtcagagacttatagccagggcactaaaaaggtcatctacatagttattaaaatcgcaacaaatgataacaggaatgatggtgacgataaagaagcagttaacgaatgtaaattataaatatcagtagtaatttctatgaaatttttatcatgtaagatttccattaacagcaattaaaagtgcctagttctccatatcttgccaacactaggtattatcaatatgctcaatatttactaatatcctaggtgaaaaacaatatcttggaatctgaattttcctttttaataattgatacagttgaatccattttcctatatgatcatttttattacattttccattcatgaactttgtcagtttttctgccagcatatccatcttttattagctatttaaaataaatcttcctggaatagagaaaactttctctgagctatcatttatcttccaagtatttttcaattatttttatgttgatattttagtgaagcattacatttttttattcttgaaaataaacattataattatttattagttgactgtacataaaacatcagaatgatgagttgtatttaatagactttttcttctaaaggatgaaaactcattgtatatgagttaaatgtatttttgaaaattctgtagtggtcatagtacaaggaaaaggactcatcttaagtttaaaaacttttaaatcaaatttttatttgaataattttagaaggaagaaccttagattcccgatagcagtcacatacatagaagaggtggtattgctccagataaattcagattatccagtagaaaatgagtgtaaattaatgtaatgttaggagaaatgcatgtttattgactattctcctggccagtaaaaggtattaaggacttacaaatggaatgcttttaaatgataaatagtattcaaaggtattcatggattgcttttttttttttaacctcttagaacttctattacaggcttcactaaaattgtcattcattgtctagccccaatgattatagaagttgatttgttataacaaatacatacaaataatacattatactctttctgtatattacacagataatacatatctgatggcagcattcagtatcatataatttcaatatatattgaagctattgttatctgcttttggaatatgcttgtgaggtaccacagcttgaaagaagtaatgaataaaactaaaaggaaacagtcaataagacagtgaccagaatagggtaaattctaagatttcaaatgaactgtgctagtgtatgattccacttatcttcagtttaccctaatacagtcaatcgatcatcaagaatacaccagaaaatacttaaatgttatagtattcatagttcatttagccaatccttttggcctctgaatgctgaatttaaattcatgtatttaaacattttatggcttctatgctttataaatactttggtagatatgataaaacaaataaggatctgagttatagactgcttatggggaagggttaataagaaaatgaaaggagccattagtataactccctactgagtaagaggtcaacatgaaatggtactagttagtaataacttattgaattatgagaatttgaagctacatttaagtaaaatgatgactatggctgaggctagataaaatgataactcattcaggatggggagaaaataaccaatgtgaatgcacagaggcaggaatagtagtatgattccagaaagatggtcaaagtgtggcattttaatatgacagatattcggctaacaggattggggatacataatgaggattagactttggaattcagaaacagaattaccagaacaaagatatcaggttaagactacataagaagcaatgtaaggagcatgatgttgcatatatttaagttattttccgctaaagcctgaattattcctagaaaagtgctttcagatgtcaatgtgcaaaaagattatgtgcgtagacaagaatcttgtccatcaacagatgaatagataatgaaaatatggtctgtatacacagtggaatattattaagccataaaaagaatggaatcctgttatatgcagcaacatggacggaactgaaggttattacatttaatgaaataaactaagcacagagagtcaaattttgcatgttctcactcatatgtgggagctaaaaagaattgatctcatggaggtggagagtagaatggtggttaccagaggttgcaaaggtggggaaagagaggttggttaatgggtacaaaaatacaattagatagaagaaataacttctagagtttgatagctcagtggggtgactatagttaacaagaatttataatgtatttcaaaataactgcaagagatttagaatttcagaacacaaaagaacagtaaatgactgaggtgatgtatatttcaattaccctgatttgatcatttcacatagtatgcatgtatgaaaatatctcatgtaccccattaatgtctacagctattagacatcaatttccaaaaaagtcagctgaactctggatactggtattctgacgtatgtgacaaaagggcatgttggagatgaacttcaggctgaatttgcctgtggaagtaaattgatcttgagacactatcgtgtcaggatgttgcatctttaagacaaaaaaattatatatgtgattattctcttttggcaaataaaaacagaccccacccacacacacatatttgtattcctaagaagcgtatcagtgttccatggacattcagtggaggtggggtgggattggaagattgattttcccatttattccaacaatcaggtattattttagtaatttgaaaaatatcaaataaaattcaaaaagagaaaaatgtaataaaagattaataatggctatgcaaataagcagtaaataaaggtgacaacaagaagcatcttaaaatattatgataaattgggaaactaatatttgatcctaaagaaattaggagacctgtgaatttccagagctactgtattgaccagcattattctagagaagtagttccaaacctgactgtgcattaaaataaactgtgacagttgttaaaatattcagacttctgggacctacactggagtttctaaatgagaatttctgggcacaaaaccatattatctatattttaaacaaggactggaaatacagctgtgaacaagatagacatggttccttcgttcatggggcttacattttaacagggaaacataaatttaaataactcaagaagaatttttcagtaaatgatggagttttccaaaattgtagttatttgatgaaactaattatgataatgatggctatttaaatccaaatatttgccaacaatttctaaatgaaaagcaaaaaagtacacaaacttgagtgtaactagaggacagagatgactacaaatttctttttttttacaagattttaagttttcatcaattttattattgttttcattacctcaaatatttatcatttctttctgatgggaacatttaaattcctctcccttagctattttgaaatacacaataaattattatttactgtagtcaccatgctatgcaataaaacaccagaacttattcctcttgtttaacctaaactgtctatggtttcactaatatatccccttctccatctaccctgctctcccatcagcctctgataaccacaattctattctctaattctttgagtttgactttttcagatcccacgtctaggtgagatcatatggcatttgtctcactaagcataatgtcctataggttcactcatgttgtcaaaaatgtcagactgccctgctcttttaaggctcaatagtatctcattgtgtgtatatttcccatgtttttaaatccattcattaaatgatgatcacttcagttgtttcccacattgaataatatttcaatggacatgggagtgtagatgtagatatctatctcttcaacatactgatttcaattcctttggctatacacccagaagtgggattgctggatcatataatagctccattttcagttttctgagacacttccatactgttttccaaagtgcctgtactaatttacagtaccaccaacagcatgtatgggtccacttttatccacattttcaccggtactttttatattatatctttttgattatagccaatctaatagttgtgaggtgatatctcattgtggttttaatttgcatttatctgacattgagcatttttcatgtatctgttggccatttctatatattcttgtgagaaatgtctacttaggtctcttgcctgtttttaaatagggttgttttattgttattgagttgtttgagttcattgtattaatgtattttggatattagtcttgtatccaatgtatttatttgaaaatattgtctcccaatccatgggttgtctcttcacttttttgtttcctttgctgtgcagaagctttttattttgattcattccatccatttttgttttggatgtctatgcttttggaatcttagccaagaaatcgctgccctgatcaatgtcgtgaagattttcccctgtgtttccttctagaagttttacagtttcatgtcttacttttaagtctttaatctattttgagatgattcttgtataaggggtgagttaagggtccattttcattcttttgcatgtggctatccaggtttcccagtaccatctgttgaaaatactgtcctttccccattgtgtgcactggcgcctttgtcaaaaataaattgactataaatatgtggatttatttctgggctctctatcctgttccattgcttagtatatctgtttttatgtcaatactatgcacttggtttattatagctttgtaagtattttgaaatccagtagtgtgatgcttctcctttggctcaagattactttggctatttcaagacttttgtgattccttacaaattttaggattgttttctctatttccgtgaagaatagcattgaaatatttatagacattttgctgaatctatagattgattttagcactatggacattttaacaatattaattattccaatccatgagtaagggatgtctattttctcatgttacctccaatttcttttatcaatgttttagagatttcagtatacagatctttcacctccttaactaaatttccttctgtgttattttttatgttattgtaaatgggattgtgttctcaatttctaattcaaacagtttattattactgtgtagaaatgatactaattttcataagttggttttgtatcctgcaacttcactgagttcctttatgagttctaggaatgtttcttatgtagagtcttcaggattttctttatataaaatcatgccatcagcaagcagatttttctttcctttcccatttggatgcctttcatttccttctgttgtctaattgctctggttaggactttcagtacagttacccatcagtattcacatgtctctggttccaggaccccctgtagataccaaaatctgtgcatgttcaatccccttatctaaaatggctcaatatttgcatataattaatgcatatcctttcatatacataaaatcctgtctagtttacttataatgcctaatacaatgccaacacatcacttcatttatgtgggttcagggtagtacttggtacacagcaaattcaagttttgctttttggaattttgtggaattttttgtgagtattttcaatcaatggttggttgaatccatgatataaaaccaacagttatgaagggctgactgtactatgctgaacagaagtggtgagagtagccatccttatattgttcctgagatcagaggagaagtcttcgactttttgccattcagtatgatgttaactgtgagcatgtcatatatggtctttactctattgaggaatattccttctaaaactaatttgttgagtggtatgttttatcataaagtgatgtttaattttatcaaatgctttatctgactcttttaagatgctcatatggtctttgttcattctttaatataacatgaatcacatgtattgatttacatatattgtaccatccttgcatcccagagataaatcccacttgatcatggtgttcattctttttaatgtactgctgaatatagtttgctaataatttagttgaggatttttgcccatctatgttcatcaggatataatgaaaataaatgtatctgtctggctttggtatcagtttaatgctagactatgaaatgtgattggaagtattcctacctcttcaatatttggaagggtttgagtagaatatgtattagttcttcttgaaatgtttggtaaaattcagttgtgatgcttctggtcctggacttttctttaatgggagacatttaattactgattcagtctcctcactctttattggcctactcagatttgctatttctttgtgattcagtcttggtaggttatatgattttaggactttatccatttctttcaggttgtctaattagtttgcatatagttgttcacagtactttcttatgatcctttgtactttgtgttatcagctgtaatatctcttttttcatttatgattttatttatttgagccttctctcttttttcttagtctaagaaaaaagctaagattttttcaattttgtttatctttttaaaagccaattttttgtttcattagtcttttaaattgcttttctagtttttattccatttatttatgctttgatctttgttgtttccttcattctgctaatgttgcatttagtttatccttgttttttagttacttgagatgtaacttttttttacttttagatctttcttcttttttaatgtaggcatttattgctatatatttccctctcagaactacttttgctgcatcccataatactctcaagatattttcaaattttttcatttttttaaccctatagttttttaggagcacattgttcaatttccatatatttgttaattttacataatttttcctgttattgctttctagttttatataattatggttggaaaagatacttcatatgattttgatcttctcaaatttgttaagactttttgtggcctaatatttgatctatcttggaaaatgttctgtatgcacttggaaagaatgtgcatttgttgctgttggatagaatattctgaatatgtgtgttatgtctgttatagttcaagcaaatgcttttttagttgatttctctatttgggttatctatctattgttgaaagtaggatactgaaattccctacaatgattgtgttgcagtctgtgtctctcttcagatctcttaatgagatctgtagttgcatatgcaggtgcttcaaagttgggtgtatagatctttacaattgttttatcctcttgatgaattgaccctttatcattttattatgacctttgtttttatagtttttggcctaaagtctgttttgtctgaaataagtatagatgcccccattcccctttggctttctttgcatgttctaccttctcctattccttcactttcagtctatgacttttccataaggtgaaaagacctaactatatgctatatgtaggtagcatataggtatagtctaacttcttaagacttattttgtggcctaacatatgatctatcttggaaaattgttggtatacacttgaaaaaaatgtgtattttgttgctgttggatggaatcttctgtatatgtgtgttatgtctgtttgatgtagttcaaattaatgctttttaaattgattttctatttggattatctgtctatgacttgtctgtaaggtgaaaaagacccaattatgtgctatatgtagctagcatatagttgggtcttttaaaaaattaatctatttagctactctatgccttttgattacagaatttaatccacttacatttaaaacagttgttgatagataagaacttacaagtgccattttggtattcgtttgatgattgtttgcagatcctttattcctttctgtacctttgcttactttcactggtttcatggctttctgtaataatatgctttggatctttcctttttatcttttgtacatctattatagcctttttcttgtggttaccctaatgcttacataaagcctctcatactttaaaactggctattttaagctgataatcacccaactttgatagccaagaaaaactctacacttttatttcctcttctccttgtttgtgtttgatgtcacagtttacatcttttaataatatgcatccattaacccattatttaaattttagttgtgtttaacagttttgccttttaaactttttactgaagattatcattgacttgcccattgttatgtcagttttatagtgttttggatttgacttttctttcattaaaaagtgcttacttttaccagtaagttctatacttttatatgttttcatatcagtaattagcatcctcttccttaatcttaaaaatttgctcttagcatttcttcaaaggcaggtctaatgcagatgtaccagtgataaactagacccgccattctcttcttttatttgtctgagaaagtatttatcactccttccttttttctgaaaaacagagttgcaatgtatagtattattggttgacagtttttttctctttcataattttgagtatatcatctcacttacttctggcctagaatgtttcttctgaaatatgtactgataatctaatagacgttctcacatatataacaatttgcttttcctttgctgctttcaaggctctctttttgtttttaacttgtttccttttttaaaaataatttaaacatgtatttcatatttggggagtcggacatgtacagatttgttgcatgggtatattgcattatgctgaggtttggaatatgaatgatcccattaccgaggtagtgagcatggtacccaatagttattcaaccctcttttccctctctcccccacccccacatctagtactccccagtgtctgttgttgccatctttatttccatgagtacctaatgctcagctcccactaaaagtgagaacatgtggtatttggttttctgttccttcgttaacttgcttaggataatggcctaaatatgtatgcattagatgtttgttggagattattttattgattatttattttattttattttattttattgatacataataattatacatatgtatgggacatatgatattttgatacattcatacaaagagtaatgatcaaatcagggtaattaggatatccatcgccttaaacattgatcatttctttgtgttaggaacagttcaaatcttttagttagtttgaaatatacattgaattattgttaactttagttacccccgctgtgctggcaaacactacaactttcttattctttctttgtaactttatgtttgcacccattaaccaacctctcttgattctctcctctacccttctcagcctcttataactatcattctaccctctaactccatgaaatcagcgattttagctcccaaaatttgtctttctgtgcctagcttatttgacatcatataatgacctctggttccatctatgttgctgcaagtgcaagatttccttcctttttacagctcaatagtattccattgtgtatatataccacctcttctcttttttctttttttagtttttttttataaatttatatatgtttatgggatacaagtgcattttgttacacatgtagtggtgaagtcagtgcttttagggtatatatcacacgaataatatacattgcatccattaaccagtttctcatcatctttccccctcctaccttgtcacccttctgagtctctaattatctatcattccactctctacatctgtgtgtacacctttttaaatgagaacgtgtgatatttgtcttctgtgtctggatttctgcaaaagacataatgtcattatttttatggccaaataatattccattgggcttactgcattttttaatccatctatccattgatgaaaacttatcttggctattgttattagtgctacaataaacacgggggtgcaggtatttcttttatatattgatttgttgatttgctttttttgggaggggtggtaaatacccagtagtggaattgccagaacatatggtagtcttatttttagtttttatgataaatcttcatactgttttccataatggctatactaatttacattcctaccaagagtgtaagagttcttttttctctgcgtcctcaccagcatctgctatttttttccttctgataatagccattctaactgaagtgagataatttctcattgtggttttgatttgcattgccttgatgattagtgatgttaagcattttttcatataccagttggacatttgtatgtcattttttttgagaaattattcatgtcccttgcctgctttttaatgtaattatttgttgtgtttgtttgttttgttttgctgtttacttgtttgagttcttgtatgttctggatattatttttgtcagatgaatagtttgcaaatgttttctcccattctataggttatctcttcactctgttgattgtttcttttgctgtgcagtagctttttagtttaatatagtcctggtgttggtccatttgcactggtataaggaatacctgaggctgggtaatttatgtctttttggcttatgtttcttcaggctgtacaagaagcatggtgccagtatctgcttctggtgagggcttcaggaagcttccacccataccagaagaagaaggggagcaggcatcacacgacaagagaggagaaaagagagagggaagggaggtgccagacacattttaacaattagattttatgggaactaaaagtgagagttcactgaatcccacaagaaggataccaagccattagtgtgaagacatccatccccatgactcaaacacctcctattaggccctacctacaacattagggatcaaatttcaacacaagatttggagaggacaaatagccaaattatatcactctgatttgtctgttttttcttttgttgcctgtgcttttgaggtcttagccataaaatagttgcctagaccagtgttctgaagtgttcaccctgtttttgtagtgtcaggtctgatagtctttaatatattttgagtttatttttgtgtatagtgagaggggtatggttttttgtttattattattattattattattattattattattattattatactttaagttttagggtacatgtgcacaatgtgcaggttagttacatatgtacacatgtgccatgctggcgtgctgcacccattaactcgtcatttagcattaggtatatctcctaatgctatccctcccctctccccccaccccacaacagtccccagactgtgatgttccccttcctgtgtccatgtgttctcattgttcaattcccatctatgagtgagaacatgcagtgtttggttttttgtccctgcaaaagtttactgagaatgatgatttccaatttcatccatgtccctacaaaggacatgaactcatcattttttatggctgcatagtattccatggtgtatatgtgccacattttcttaatccagtctatcattgttggacatctgggttggttccaagtctttgctattgttaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttttttcctgactttttaatgattgccattctaactggcgtgagatggtatctcattgtggttttgatttgcatttctctgatggccagtgatgatgagcattttttcatgtgtcttttggctgcataaatgtcttcttttgagaagtgtctgttcatgtcctttgcccactttttgatggggttgtttgtttttttcttgtaaatgtgtttgagttcattgtagattctggatattagccctttgtcagatgagtaggttgcgaaaattttctcccattttgtagattgcctgttcactctgatggtagtttcttttgctgtgcagaagctctttagtttaattagatcccatttgtcaattttggcttttgttgccattgcttttggtgttttggacatgaagtccttgcccatgcctatgtcttgaatggtaatgcctaggttttcttctagggtttttatggttttaggtctaacgtttaagtctttaatctatcttgaattaatttttgtataaggtgtaaggaagggatccagtttcagctttctacatatggctggccagttttcccagcaccatttattaaatagggaatgctttccccatttcttgtttttctcaggtttgtcaaagatcagatagttgtagatatgcagcgttgtttctgagggctctgttctgttccattgatctatatctctgttttggtaccagtaccatgctcttttggttactgtagccttgtagtatagtttgaagtcaggtagcatgatgcctccagctttgttcttttggcttaggattgacttggtgatgcgggctcttttttggttccatatgaactttaaagtaatttttccaattctgtgaagaaagtcattggtagcttgatggggatggcattgaatctataaattaccttgggcagtacggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatctgcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccacttttcaaagggaatgcttccagtttttgcccattcagtatgatattggctgtgggtttgtcatagatagctcttattattttgagatacgtcccatcaatacctaatttattgagagtttttagcatgaagcgttgttgaattttttcaaaggccttttctgcatctattgagataatcatgtggtttttgtctttggttctgtttatatgctggattacatttattgatttgcgtatattgaaccagccttgaatcccagggatgaagcccacttgatcatggtggataagctttttgatgtgctactggattcgctttgccagtattttattgaggatttttgcatcaatgttcatcaaggatattggtctaaaattctcttttttggttgtgtctctgcccggctttggtatcaggatgatgctggcctcataaaatgagttaaggaggagtccctctttttctattgattggaatagtttcagaaggaatggtaccagttcctccttgtacctctggtagaattcggctgtgaatccatctggtcctggactctttttggttggtaagctgttgattattgccacaatttcagatcctgttattggtctattcagagattcatcttattcctggtttagtcttgggagagtgtatgtgtcgaggaatttatccgtgtcttctagattttctagtttatttgcgtagaggtgtttgtagtattctctgatggtagtttgtatttctgtgggattggtggtgatatcccctttatcattttttattgcatctatttgattcttctctctttttttctttattagtcttgctagtggtctatcaattttgttgatcctttcaaaaaaccagctcctggattcattaattttttgaagattttttttttgtctctatttccttctgttctgctctgattttagttatttcttgccttctgctagcttttgaatttgtttgttcttgcttttctagtccttttaattgtgatattagggtgtcaattttggatatttcctgctttctcttgtgggcatttagtgctataaatttccctctacacactactttgaatgtgtctcagggattctggtatgttgtgtctttgttctcattggtttcaaagaacatctttatttctgccttcatttcattatgtacccagtagtcattcaggagcaggttgttcagtttccatgtagttgagcagttttgagtgagtttcttaatcctgagttctagtttgattgcactgtggtctgagagacagtttgttataatttctgttctttttcatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgagtatccttgttaactttctgtcttgttgatctgtctaatgttgacagtggggtgttaaagtctcccattattaatgtgtgggagtctaagtctctttgtaggtcattcaggacttgctttatgaatctgggtgctcctgtattgggtgcatatatatgggatatccagctctcctggcaccattattgaagagggtatctgttcaccaaggtgtgttcgtggtgcctttgtaaaaattcagttggctataaatccttgaatatatatgctgtccagtgcttcaagtgctctgcagtgcttcaataatcacggggattattgaaatccccgactattattttatgggggtctctctctctctttagctctaagaatatttgctttatatatctgggtgctttggtattgggtgcatatatatttatgattgatatatcatcttggtaaattgatcccttgattattatataatgttcttctttttctctttttctgtttttaatgtaaagtctcttttgtctgctattagttattcctgcatgcttttgatttccatttttgtggaataattttttaattccttcacattcagtctatatgtatctttacaggtggagtaaatttcttttaggcagcatacagtcagatttttttaaatccatttaacctgtttacatcttttaatcagaaatttaaaacagtttgcattccaggttatcattgttaggtgataacttactcctgtcattttgttatttgttttctgattgtttcatatatccgtttttctttattcatcttttattgtttgcctttacaattttttgggttttcaaagtgataatgttggattccttttagtttttttttctgtatgcactctactagtaaattttatacttttttgttttcattatggtagatatcatcttttcacttccaaatatagggattccttaagcatttcttgtaaggcctgtgtagtggtgatgaattccttctgtttttgtttgtctgggaaagaatttacttgcctttcagattcgaatagtagctttgctgggtatagtattttttattggcagttttttgttgttgctgtttgtttgtttttcttttgcacttgggatatttcatcctattctctcctggcctgtaagctttctgctgagaagctactgttggtttgatggagactcccttatatgtgagttgactttttccttactgtttggagaattctttctttgtatttgacttttggcagtttgatgataatattccttggaggaagcttttggattgaatctgttggaagatctgtgagcttcctgtatttgaatgtccatatttattgtaagacttaagaagccttcatttagctctgctgtggtctttattatttatttattatttaagctattatatttaataatataaaatggttttctattccattggctttcttctcaccctctgggacactgaagttttgaatattttgtcactttataatgtttcatgtgttacataggcttcgttcattctttttttactcttttttttttttttagttttgtctggctgggttatctcaaaagacctgtcttcaggtttataaattcttcactctgcttgaccttctctattgttgaagttctcaattatgttttttcattcattaaatatttagttccatgattttttctttataatgatgtttatctctttgttgaatttcttattcagattatgaattttctaattcattcgtattgtttatctgggttctcttgctctgtgtttctttagtattaccatttttaattaatttttaagtatttcatatatttccttttctatgaaatttgttactagagaattatcgtgttgctttgcaggtgtcatgtttccttgctttctcttatttcttgggttcttgcatttactatctgcacacctggtgtaacagtcactttttctaattttatcaattagcttttatagggaaagcctttttcctatagtcacatgtaaggaaatcagattagcagcagatttctcagcagaggggatgtcagcagggcttcagggatctatagatgcactagctgtagggtctcagggtacaatgtattctcatgaggacttggctctcaaaacctatgtaactatagtattggtttggtaggatgctttggttttgtttctggcagggcatagtagtgtgttctctgtaccattcctttggctgtaatcagtatcattaatgtcttggagttcctctgtggtttaagctgccgttattagtggaggctatggcaatgcattgctgtggatgggatgctaggcatgctggtcctcaggtgccagtggtggtggcgtcagtatgcataacattggcagtggcagtagtggtggtgagccaaccctcaggcccatgagtggtgcatgctggagccagcagtggcagtgcaggactgggcaggccagtccctgacccctgagaaacacacttgggtgcagactgcaagaaagaaattggcctttcctaatgctcctggatgacatgcacatgctacagtgggggacagggtgagctgatcttcagggtcttggaaggtgtgtgtgtgtgtacctgcagtcggcaggtgggttggatcagtccccaggtccaggatgatacatgcaagtactggttgcagcagcagtggctttcagggcgcaatatagtctggtgaggctgggctctcaaaatagcagaatgctgcagctgcttgggttttggggggtttatgggacaaggatgggcctgtctttgggtccctggatgctgtatgcaagcaccagtggtggtgggcaggacacagaatccagaggacatgaaaagttgctgcatctgtggtgtgtagagcagccctgtcctcatgtctcctgatggtgcatggggatgccagcagtggcaggcaggatggaccaatccccaggcctccagatgacctgtgtgggtataggcagcagtggtgatgtgcaggacaaatctctcctcaggtcccaggatgacatgtggatgggcccataaccaaggcccttgaaggcacttgcaggtgtgtggcagcattgctcctgtgaggggcagggttgctctgcatggcagtggtcctaggcaggtggctctcaagccctggggaatatacactttgtctcgcttttttctcatggcagcctctctggtgtgctttaccacatgttccctggggtgtaaggcactgcatgggctagagtagtggaaactcagctgcactgccgtgtccagctagtgtcatgatactgcagtcctcgggaaggacatagggggatgtcagcagagcttcagtaacgtaaatgcaggagcttttagccctctgggcacaggatagtccagtgaggcctgggctctcaaaatagcacaatattgctgctgtttgggtcttggaggggttacaggacccagcgtgaactccttctttgaattaatccaatcaagtgaactcgcagcagctcctattccagtctcagggcctgtgagagccaaagggttctcctgtgttaggaatgtaggagcgggcggtgggaatttaaaccactggggatcttttgttcacctttttcccacaatgggaggttcctcctgactctgagctgatcctgaggggccagctacttcacttctctctccttcctcgcctcagaagttctctgtctcttccctgctgaattccactgttctctcccagatgctgtattccacatgtggttacctacttggtgtttaggtccctctgtgtggaggaggcaagtgccaggtacctctagtttacccatcttgaagtctcctgcacatttaaaatgttgatatatattgccaatttttccctaatgggaaaagcagtgtatattttactttttgtcagtctgacaaatatctcattaaattgtcatttctttaaatatgaacatagttatacatttttcacatgtctaaaggccattgtaaatgagaatttcttatcctctaactttttaatgaactagtttattaattgttattaatttataaaaatcatttgaatattaagaaaatttaactatttgtcagaagtgctctaaacatttaggtagcttttaacattatccaatttaaattttacagtgaatattaattttctaatatagtgaatactagagctgcaactccgtcataatttgtaatcttattctctaagtgtcttttcttcttatggctttgttttcttatttcatagaaaataagacatcatcttaccactttgcatgcttttaaattaaatttatcttctgctcttcagctggtttttcagagatctgtgttaaccttggtgacagtgtctgtcaacataggccagccaggtcacctgcattatattcatctgaatgcttatattcacctgaatgcttattccagacttaccaaatctctgagagtaggggtcaggaatctgcattttaacaagctcagactaaggtttgtgaactactctaaataatccagatgattatttagaacaatttttctttgtttttaatttcttttcatgagaattacgctgttttcttttcttttcttttcttttttttgagatggagtctcactttgttaccaggctggagtgcagtggcgcgatctcagctcactgcaacgtccacctcccggcttcaagccattcacctgcctcagcctcccaagtagctgggattacaggtgcgtgccaccatgcccagctaatttttatatttttggtagaaatggagtttcaccccgtctgcctctgcctcccagggtgctgggatgactgtcatgagccactgcgcccagccctgttttcttcacattacttattttctgtctttgccattgcataggatgttaaggttattttaattgtgagaaacactctccctacaatgcaaaatgccactggcatttctttgtctccctctcacctttttacctaccttttaccaacagaaacacacatattcacggaacatacacaaacacacacagtacatacacacacacacatgcacactcacacacttcctggctagttatcttctggaagtggtcttccatacctttcatacattgaattatttgttgcagggttgggaaggattatgaatcagaactctggcttccctgaaaaaaaaaaaccagcatctaggaagctgatgattagctacacagttttctcttatatgcattcatacctggcaagcaactggaggtgaggaagagatgaacagcaagagtcaggattatagtgggagacatggtcttaggtgctcaaacacatctgaatgggtcattgtattgcagttttataaatccagttgttttgaaaatttcccctaggtcctagccatggttattgattggttttactttttagcgagcatggaagtattcataattttctgtgttcacttatgcgttttcagtgtaaaattgagacatgatacattaggaactcctatccagatgttattttaaaaccatgagctgaattgaacatgtcagaactaaaatggcatacagagaaaggaaatttagacttattaaacaaatacattatcagtaaagtaagtaaataactattcctgccaataatacattttaaattgatcaaatatttaggatgtttttacttcctgtcaaaatataaactaagtgaacatgttttcactttatcttcatgacctatcacttgggcccatctccttagtaaataataaggagatgaaggcaaattcagaaaagctaaggaaaaaagagcttagttgaaatctaccaaaaagagaaattcctacagtttgtttttgtatgctgtaaatcattgatagaaatcaatttcctcccacaaaaaaggatctcaattacaggttacatttaaataagtaatgagaaaatgtaccataaatttcaagaggtaaaatccacaaagatttgagtgttttaataaaaaactataagtaatgattttgtaataaaagttataagattctgagacatacttgaaactgattatttatgagtggttaatttgaactattatggatgaattttttttttgttttatcaacaattcttagcaaaaaaatttactgacacaatcagggccttttattttaatacagaaaaaaaaatgagtaagatgcagcagtgacttttccccattggaagctataaaccagcaaagctgtaggccaagtccaatgttgattagtctgattgatgatccacttcattcccagtaagacctagaagaaaatgaagaaatggaaatggcaaagaaactggatacaatctttacattctttcatccatttatctattcatctattcatccatctatggttctaagcaaacaagattgagcaaggatacaaaatttcaataagttaccatttctggtctcaggttatttagtaggaaagaggtgagaggtaaggctatgtagtggaaagacacagaaccaagattagacttcatgcctcaccgcttctaccacaatcatcactgctaccacccaagtgtccaagctgccctgtcccttgttctactgcagtagccttctgcatctccttctgcctccactttctcatccctgtcttctgttcaccagatagcaaccgaagtcatgttttacagatgtaaatcagaccaaaatcatgcagttttattccataactcttagaggaaaatgtctcagtcatgggttacaagatcctatgtgacctagtccgggtttctctctgaacccagatctcaacactcccctgaactcactttgcttcagtcacactggcctccttgcatctctttgagcttgtcaagcacacttttttgcttgagggccatttcactgtctgtattctccaccaggaatgctcttccagaagatggctctgtggtttgctttttgacttcattcagttctgctctcttgtcatctcatgagccaccttccgtgagcaccctatcaaaaaaggcactccaggcccacttcctccccttacattacattatatattttttttccagaacacatacctcacattatacttcacattatattgaatggcatttattgtctgccacttgtcactatattataagctccatgatggcagggacaccgtgtctttttctttgctgtatttcctgtatagaaaatagtacccagtggccgggcatggtggctcatgcccataatcccagcactttgggaagctgaggtggccgcatcacttgaggttaggagtttgagaccaacctggtcaacgtggtgaaaacccagatctattaaaacacacacacacacacacacacacacacacacacacacaatatcagtgtggtggcgggcgcttgtaatcctagctgctccagaggctgaagcaggcgaatcacttgaacccccaggaggtggaggctgcagtgagccaagatcacgccactgcactacagctagggtgacagagcaagactccatctcaaagaaaaaaaaaaaaagaaaaagaaaagaaaagaaaaaagaacatagcacctggttcatagtagaatagtcaataaatatatgttgtataaaggaatgaaatccacattttagtccttagttctaattctcacagatatactttgtactatatttatttataggattatgggtaaatatgcaaagtaagtgaaacttatcttttttaatacacttagtcaatgatttgtcaattaatgccaagagctttggacacctatcttttatcattatgatccagcctgttggctgtctcttttttaaaaataccctttctctttccatcccattctttttctttataactatccatctctatttccaacatcagattatgtggatctacctgtatactgcttcctaatttttcaggtctatggcttggacaagtcatgcagcattcttccaagtcatatcatggagtgactcttcctctaaacatgccagtatggctttagatctagaccagaactagatataagccaagattcaagtaggtcaatcagagagtatatctaagaggaatgtccaactggaacatacctcatagatcaaggccagaattctaagtggatcaatcagagagtatatctatgaggaatgtccaaccagaacatactcatagatctaggccagaattctacgtagatcaatcagagagtgtatctatgaggtatgtccaacctcacatcattcctggtttaatgaacccagggatcctggattcattccgggtttctgctgaggaattgtttgtgactatgagcagaactaccaactgctactcctctcaagaataaagcttcctttggcatgagtttcagtggtcataaagtaaggcactatttctttaattttctttgctttttttcctggtattttgctaagatttaataacagaaatgtgtcatgaaagaaacttctatatcttttttcttaccctacaaaaattaactatatttgttcctccaaagtcattgattctaaagaaagtttattaccataatggccaggcacagtggctcacacctgtaatcccagcactgtgggaggctaaggcgagtggattacttgaggtcaggagtttgggaccagcctggccaacataatgaaacaccatctctactagcaatacaaaagttagccaggtgtagtgacactcacctgtaatctcaatgacttggtaggctgaggcaggataattgcttgacctcaggaggtggaggttgccatgagccaagattgtgccactgcactccagcctgggcaacagagcaagattccatctcaaaaaaaaaaaaaaaaaaaaaaagacagagagagagaaaagaaatttgattaccataatttacaattgtgactaatctttccttttttcctattttcctctctagaggattcacattggtccagatgatttttcctgacatattacgtatagtcatttattttttcatttttattactctaacctttaaccttgttaacactatagcttacttttggcagccaggattttgatgatttcttgcctccaaagatatcccaacattataagatctttataaagtttctctaaaatggaaaatggcaactcatcctaccttattttttcaacttctaattacatggcttaccattcttagcatataaaaaagaactcatgatcccatctaaatattgttaatgtgaagttataattaccttggaaatgcttacgtgtgttttgtatctatcatagtctgtcatagtttagaaccaacgtttcctggtgataaaattttgtgtttgtgagcacacaatagctagtaaaacattatacatactgagtcctaatacaggctttttatttcatattgtttccagaccattcatattaccacctattagagctagagcagtctgccaaacatggagagggataattaaaatagtcttaatgaaattatatgttacaaactataggataaagcagtgtttatgcaataaaatgatgtcacaaagtaaggactgaaaaacaacactgtgatgatagcagcaaattttcctttggcatgagaataggtcaagaatataccattcctattatgtaaaccaaaacataattgtacactatacagaaaaaaactcatgaataaacactgactttctgaagaaaatatattattttcaagtgaatgcttgtaagcaccatttaaaggaaaatagtcacattcttcccaattgccaagccttttccttgtacagttttaatgaaccatttttattctggtagtaaaatattcacatttctcattgaaattcaaagattaaattttgtacaaaattatactgcagtttggaaaactaattaaatgttttattttgtaaatgtaatgagctagttaaatctttgttgccaaaattaaaaatgtaggaggattgatggctaaataaattctaagagtcattcacatcagttgagattgatgccattttgtcaacgcagtctaccactaagcagaagataatttgagtagaaataaaggtaatttgaactatatttttgaatttgatatgacaatatcttacattgattatttggtaggcattagttaggatataattgtagtttattttaaatatctcctgtataatatgtgattactcattatggaaggcatatatgaacacataagaaaaacaggcacttggattttggaacaataacagctcactttttatagaatcatttaagaggcattaactacccagaatgtaactgagagaccacaaatatgaaacaaggatgacaggaaggtaaaatatgtattagattatccacaaagcctatgtattttacttgtatgattactccccattcaaagcctgtatacttttatcttagcatgaacttaacaaatttgattaactggttttctgtgcagtggtgcatcaattcatagtggagtcagctagagttacactgatacagttccaacagggcaaggagacagcctcaatgtatgtgtgtatatatacatctatatgtatgtatatgtatgcaagaagaaagaagcaggaaattagaaagcagagcactctggaggataattaataagtgggtattaagcttggaaaatcttgttgtgatgtagcagagccccaaattcaatcatacagcaaggaaggctggaaaatgtagtctggttgtgtacctgagaggaaaaggacatagtttggtaaccagttagttaaacctgccacaaatactggggttcatgatgatttctgtactacaagtcactgcaaacaaaccaacaaaatcttatgtttagtatttgccacttaagggcaaacatcacaggtagatctcattatatagaagcatatcatttcttttcctttttgtttgtactgtcctcaagatcagacttgtatcaccaattaactcaatatattgaaaatcttttattatatcagctgaagtgcataatgcatgaaaaaacccaattactcttttgttgaactggcagaatgggcaaacagatactgagctcccctgtttctgtccacggagaacaataaatatcagctgatagtgcatgagagaaatatagcataaagggataaagattaattcccatgggtttagaagcaactttgtaaggaggaaactattagtaatttttctaatgttttttcccagcaaagaggctggtaaaaccctgatacttagagttatcatagcaggtacactcttaggaactagaatgagtagtctctagataagaataaaactagttttaattctttagaaagatttaggtatctttcctatctcctttcccatatccatcctcaacgggaagacttgtgaagtgaagaagtggtctgcctatgtgtggctgcagtaaagtagacagaagtgtttcttttgtgggaacaacaggaatgaagagactgcaggaatgtagggagtttgcagagtccaggaggatgaattggaggagatctataagttctgagcagagcagccagagaaggaggaagaaacaactcgaattgaagaacaaatgggttaagcaaatgaactgaaggtcttgtctgaaaaactgaccagaatgcggcctactgctggcttttacctgctttccaaagtgtagaggctactgcattgcaagggacagggattgggaaacttttttttttttttaatggcatggcataaattcaacattcacccagacttaccaccaaaatatttaaaaacatgagtagagagacaggaaaaagctcaaggttttaattggaaacatagttacataattttgcggacatgcacacatcttaaatagtatcccatttaagtaagaaaaatgtcttgttttatgtttcttttgacataaattcctctctcccactaaataccactatcggcagatcatttcattattaagttgttcacttaaagcacaaagtacagctaaattcatctcctccaggagaccacaacatcctgtacctgtcgaaaatcaaggcacttgccatattgtattgaattgaaagttaacatatcaccctttcttcctaagctccatctacttcagatcaatgtgtttatatttatatttccaatgcctcacatgcaacctggggcaagagacacacccagtaaacattttttggtagtaaatgaaactgagttgcttttttctttagcattctcttcatgtacaaatgctcttggaagaaataacacattaattcaggctcattcctaacatttgcagaggcaagagcatagatgaagatccacataccatagacctaaatagttataatttataaatctaactaataaactgttaaataaaacatatcctaacttcctaccaaaggaaaaaaaaaccttcatatcaacatgataaaagttgtacgtaatagcagttatattttaagatgctaaaagctggaaaaatgcaaaagttaaaatgtaattatcaatatgcatatttgagtgttgtgcttagattggtaatatttttgtttttaaataaatgtatgcataaatcagtatattttttcagaaaatatactttctcacctttattttagcaaaatcactaatttgttcttataataaaaattttcaaatattttgcatttggcttaatgtggtgccaaacaaacaatacctttcctaagtcacatgatatctgcttgctttcattattttctgtttttaaaatttaggcacacctggccgggcacggtggctcacgcttgtaatcccagtactttgggaggccgaggcggggggatcacgaggtcaggagatccagaccatggtgaaaccccgtctctactaaaaatacaaaaaattagccgggcgtggtagcgggcgcctgtaagtcccagctattcggagaggctgaggcaggagaatggtgtcaacccgggaggcggagcttgtagtaagccgagatcacaccactgcactccagcctgggcgacaaagcgagactccatctcaaaaaaaaaaaaacaatttaggcacagcttcactttgaaatgttttctctctttttgcttttcagcctttactttttctactcatatattttctttttctacctaatcagagtttacacagcttgttaatatttaaaggattaaaaaataaaaggttgccgtattccaaacacacatttgagtctatagtttatacaaaggttcaatttaaactttcaaatacaaaaattaaaacaaaattatctctatatgtgttctcagatacagtttatatatagttttcagaaggttttttctaaagtacccaaaatatttatttaaatgaaaacaaaatacaaattattaatattagatataaatttctaaggtaaatcatttgaatacagctaaaatttagttaaacctcatgtatctagattttaaaaataaaaactattgaccattttaacattaaatggccatctagttggcaaagaagtatcaggcttcatgtatattaacatagaaatttacatgcacaaatttaaacataatatgaattatttaatacttaacatagttctcagccattatgtacacctgttttgattaatggtactgcagtgatttatgagtatcttcagacacatacagttgaaccaaaggaaagtaagcaagtgggtgcttgttaatgatgctttattatgcaataatctgctgcatttctgctatccaaaggaagaatttggcaagttaattagtttgccccttctcttacctcagtgcttccagagcacaaatttctccccacactccaaagcagtatctttctgttgtcagcaatggtacaacccgcaaaccttggtagcatttggacattgtcaccttttgattctaggacacaggaggaaaaatgttccaaaatgtttctctgggtcttagagggtgttaatcataagagtaggtggtgttactcacaagaggaaatatttagtattctggcttgttctgtgccagcaccaagtgtaagatcccaagtgatagaggagcccaagagctatttaatgatgagtctatatttgtgataagttgaaccttctaaattcatcagtccccgagcgaaggtctccatgatctgggtttcagggtagtattgtgtgaaatttctacctgagtttatcaagtaaatgttttctcttaaagagcacagggatattagacatctgaagaaagacgttaggggagagcttacactgaatggtgaaaacagtgaaatgaatttggaggaacctaaagcaaaatatcatcttgactaaaatcttgtttgggagtttggcctagaagtattagtttattactcttgtttctatgtgagtacatgtctttatgttcccctccctcccttcctgcctctctccctcactctctcctctctctctctttctgtctgctctacaacttgtcttgaattaatcattgttcagataatttggaaatgtttgacctggggttgagttctctcttatgttcacgattgggattttagtccctctatattccggttttgaaaagcagggatgcctttaatttgtttataacaacctaattcttcaaatagtgttttaagaatttagcttggaatgtaaagtataggatgtttctgctataaatcaaagtccttaggagactcacagacctcaagcagaatttctcagagggcacattcaacctggatatagctaggtatattttaggtttcattatgtttacagttgtagtgaaaactggccaaatattattaaggagggaaaaatagcatagataaacattctcagtaacattattatttgtctctattccccagccctgtatgtccaggtcacaatagcttaacaactgtgataagctatattttttgagcaagagagaaaaaaatgccacatattaggaaatcctgctaagaatgtatcaaaaaagccaaggggtgcaagataactttaggtaaacctacagaatgaagaagaaatcatgtgcctcataagttagagatattttctctccttttcaactattttaatgctttagggggtaaataactaggccagaaatgtgatctactcacttcatatctccaatattgattaatcaatgattatagctcctgactcatgttttatgcatgcttagaacaacatggcacatgtatacatacgtaacaaacctgcacgttgtgcacatgtaccctaaaacttaaagaataattttaaaaaaagaattttaattctctctgtcactttgcatcaagctaaaagcagtaaaaatatgaaaatttgcagataaacagaaattttagtatgttattactctgtaactacatctgacttttcacatttttcagtaagctggattagaacattgaagttattttgcattactgcttgacctattctatgtgggacttataattatttctgcattttataaaattttaggtcagcttttagcaattcattatacctttacatctaatatactattttcttccttttagaaattctattaataaaaatagattggaacatagcagcattgttggcaaaccaagctttattaaatatttaattttatctgttatagaacatgaaaatcagcggttatgcaagagcaccgattatatgaatttgcatttcaaagttaaatggttttataatgaatatgtgcgtgaacttcctgccttcaaggatgctgttcctgaatactccttgtaagtagtgattttaacacacacaccctcagatctaaattcacattcctgtaaaattacacctgaattgtgtaccactaaaatctcttcacataatcttcattggaatgcagaaatttccattatgaagttaacattaaaggatttgcatgtctttgggaaccatatttaattgaattgtgttgcatatttcaaatacgccctacctggatattcaactcaaagacaaaaaatgcataataagacatggctcatgtgataacatgaatgattttctgtaaaaataccagaacacagatttttttggggaaagtatggtgcttgtatattgacctatatattcagattttcctttctattcaaacttgtaactctcttaggaattcatatttctaaaaatagaaatagtggtttaacagggaactttctcataaatatgcctctttcaaacacattttaatcacacaaggactcatgtaataatttgcatttgatatgtattagaattctgttttattctattgatggggtcttccctatggcaggcactttccaagtgctgtagagcaatagaaaataaagacccccaccctgaaaggaacttatactctaggagatgctgataagcttaaatatcattataaagcaaggcaaagtgaaatatgtgctaatttaaggagcataagcaaagcgcaatagggtttcacagaagagagaaattacctctatttggggaactccacacaatatttatagatgggatagcatttgatgtagactttataaaatttgccaggttacagaaagaaaagggagaaaaagcattaagatgaaaatgaaagttatgagcataattatggaggtaagaatatatgagctatcatccataggaagtaaggcatatttccatttttataaaattaatagaaagtaatattttaaaaaaataatgtaggaaaagtagttttgagctagattgttataaataaatattgtgaagcttgtaccacattcatcaggcattgtgggagttggaagagacaaggaatggggggcagagaagagatttagaaggtaatgagtgatttagagatgaaattagaacagccctttaacacaacttttctcatacaaagtatataagaagtaaggggacagtgggataacttaaaaatgccgtactatggggtatagggtgttggggagattttggtcaaaagatacaacattttagttaagtaggaggaatgagttcaagagatctattatacaacatggtgactgtaattagtgtatcatactctgaaaagttgctaagagaacatattttacatgttctcaccataaaaatgataagtatgtgaagtaatgcatttgttaattattttagtttagccattccacaatatatacatatttcaaaacaacatgttatacttggtaaatacatacaacttcttttgtcaaataaaacatacttaaaataaatacaataaaattatagtctttatgttaaataaaggccatactgaaaatatagagtgattgcagcaagtatgtaaagggtgaagatgtgggagagaaattttgaagatagaatttacagaatttgtcaactaaagacatatggggttaaaagaaagaggaaaggtgaagattccttaaagaactaaaagtagatctaccatttaatccagcaatcccacttctgggtatctacccaaaggaaaagaagtcatatacaaaaaagatctttgcacatgcatgtttatagcagcacaattcacaatttcaaaaatgtggaaccagcccaaatgcccatcaatcaacaagtggataaagaaattgtggtgtgtgtgtgtatatatatatatatgtacaccatggaatactactcagccataaaaaggaatgaaataatgacattcacagcaacctggatggaactggagaccattattctaagtgaagtaactcaggaatggaaaaccaaacattatatgttttcactcataagtgggagctgagctatgaagaagcaaagaggcatgagaatgatacaatggactttgaggacttgagggaaagggaagttgggggggaaggataaaagactacacattgggtacagtaaacactgcttagataatgggtgcaccaaaatctcagaaatcaccactaaagaacttattcatgtaaccaaacaccacgtgttcccctcaaaacctattgaaatgaaaaaaatttaaaaatagaaaaataaacaagaaagaggaaagagttaaatatgaagtctgtatgcctaagttgttggtagtatcattgatcaggaatagagaagtaaaacagaggagctatttgccagatgcttctgcttctggctctgtctagacactctacgctaaactaaaatcagactaatattttccctgatggccaacaaaaaaggtaaataaaattaaacagcatcagaaagacaacaaaggcaaccaggacttgagaatctaagatccctgagaaaagaaaaatgcactaaggtgagtcctgtattttgttgcatcttctctcccatgttttcacccccatacatctgccaatttgcaatacggggcttgcagagcaaacagccaacagtagctcagagtttacagctgtctccctggactggagaaacaatatgggttatggggctatgaaggctgcttggatttgtgagaccaagatcccagagaaaaggaaaccacagagatatgagtccaacatgctacaggcagttcccactgaaggcattttctgatgcctaatttacctatgtgttgagattggggcagaagaaaatcaagtagaaagtggccactaagagattgggaactaagtagatactttagcagtctcatagtgctgaagggacaaatgttagagatcaaggctggtcccctttgtgcctacttacagtaacagtctctccttctgttgcagcagtaaccaccttctgatgcctaatagcatagattagttttatagatttttatactttttataaatggaatcatacattgtgtacaaaaaataagaaagaaggaacattataaacactctaggctttcaggtgagatttttgaaggtctctgccctagaaataatgacaaagtggaaatagaccaacctaaaacccaacactgtctagatcaaaggtccacagcttttcatggacaatatataacattcatcaaaaaattaaaggctaccagacaacaggactaaataactatctggagattatgcttcttcagcaatgaattgaaaaaccagaccccaacaaacagtaagaacaaagaagtttgaaaaatctgaataaaacatttagagatatctatctatataggtatctacatttctatatctatatctgatcatccagagtttccataatttttcattgacaatgcttacacacaaaaacacccatataaaatttataaacaaaaacaataaaatacatattgttattaggaacacatggtacatttaccaaaatagactgcctcctgagccataaaacaaaactaatacatgttaaggggagaaatcatgtattatatattcttgacactgtagaattaagacacaaatcaactccaagaagataattagataattaaatacagaaaagcagcagaatattctaaatactcatgagtaaaaaaagaaatcatggtaaaaattacaaaatattttgaattaagtgctaataaaatatggcatatccaattttgtagaatgcagctaaaacaggaagtagatgaaaattcaaaatgtttttgaagtagaattttaaaagtaagtgtggtctatttaaaactttattaaatttctgtattatagccacaaacaattagaaaatcatatataaattgtaccatttaaataacattaaaatcaccacaaataaatgtgatgaacggcgtacaagccatgttttcaagcaactataaaatattatgagagaaatttaagatgaactaaatgaaatctgtaacattcctaaaaagatgcattattataaagatagcaattccccccacatggacctacagtttcaatacaaccctatgcaaatttcaaaagatatttttgtgcaaattgacaagacttttaaaatgcatgtagaaatgcaaagtgcttaaaaatacaaaggcaatctacaaactggagaactacattattggttagctaataaagtagagttcttaagagagtgtcatgttaatgcatttctcagtcctttctcacactgctataaagaaatacctgagtctaggtaaaaaataaataggtttaattggctcacagttctgcaggctgtacaagaagcatagtggcttctgcttctgggaagtccccaggaagctttcaatcatggcaaaaggcaaagagagaatggggcatctcacatggggggagcaggagcaagagagagtgaggtgggatgtgctgcacagttttaaataaccagatctcatgagaactcaaacactatcacaagaacagcaccaaggggatagttctaaactattcataaaaactccacctgcatgatcaaagcacctcctaccaggccccacctccaacattgaggactacagtttgacatgagttttggtggggacacagatccaaaccatatcagtgcataacaaataaaccaagggaataaaatagtccagaggccaattcacatgtatggcatgatgacctgatttgcatcaaagatgcaaattcaatgcggtgggggaataaagggtgttctaaataaatggtgctagatcaactgggcacacatacagaaaaaagaatttatgctcagaatggagaaaaaaatatcctacacaatttccaaaaatcagttgtccatagattatagatcataactaaggagtctgaggtaagcacccacgatcggttacagattagtgtgaatgggtagaagctatatggcaaagaatttaaaaatgaggaaatgcgttgatagggaagagagcacacaaggtctacattttacaagagtttgaattttgaagggaattacagagtaactgttggaaactaagcatatttgaggcagcatgcgaagaaccaagacgggggtagaggttggaggtaaagaggaggagactgatttgatggagaacaggtaaaggtctctgaggaagcaaaactgcaagagagaatgaaaggagattgttgattctaaattactctcatatgcaaaaagagcagcattcctgttaattttatgcaaatgatgtcctttgtggtatgtaacattattaatttgttataggtggtttgaaccttttgtcatgcaatggctagatgaaaacgaagatgtgtcaatggaattccttcatggagcactgggaagagacaaaaaagatggagtgagtttaaattaccttaagaaagttcattgccatgattcagtcacattgcttacttttaacctaatgggaattattagactcattgttattaattgtttccattccccagtgaccaaaattaatttaaaacacaatttcagtggtctggtcagaaccctagaaacttgcctacatttattaaaaaaaaaaaaaatcaatcacccatttttcccaagattttctttaattcttacattaatctgaatctacaggtttcctaaccttgtacaaaacatctttgttgtcctggaacttttccaggatttctagattaggagcagacattctcccagtccctgtgaagcagctcccaaaatcgtgagccacaaccgtcttgctaagctaacctattgcctgtggagaaaatgaaagacaaaagaaccagtacctcaattcagcagtggaaaaaccaattagcagtagcttgccccatgatattagttccaccacactttcaagaaaaggagattaatgattttaaagtgggtaagcattttattactgggaaatgtaaatatgtgatacgggagattcagttgttgatgggaaacagtgaagatttttccattccgcctctaatgtactgtttgggatggtttcacctcctctccccacagttccagcagacatctgagcatgctctcttttcttgctccgtggttgatgtctttgctcagctgaatcagagctttgaaattattaagaaactggaatgccctaatcctgaagcattatctcacttaatgagaagatttgcaaaggtaggttaaataaaatgagtcttctttttctctgggtctgtggcaatctgaaaaatgctattgttttgtggtgttagtcttctctgtcaccccatcccagtttatttgtaattctgtactagtaaattcagttgtttccaggattcccatctgatttcctacacttcctgtttctttaatatggatttatcatcttaaaaacctatttattgttcacttcgaggactcagttacttataatcgaagaaattaccatggatttccaaattactcccatttcaaatgtggtgttttctagctgaaagtaagccttggcaatttcacattcaaattgccaagtgttttagcagacattgtagtatagtgcaatgtatattgaacttggagccatgaaaactgatttctgattacaaatcaaccaataattgtaattgaatctcaatagttcaagttttttatgaatttagttttcatatttgacatattgattttgataaaccaagttcatcttaaggccccttctcctcttaaaatctaaaatggcttaccatgtgcttactactttcccaagagtttcaagggaaatataagaaataaaagaagcagccactgtctatcaaatctcagaaaaaatccatataatatgcaagaccacatgacataaactaattgaaagatgacgtgaaaagggacacaattcagcttcaagcttagtgagatcaaccgtaaattgagtggagggaaatctgatgagagccgaaatagacagaggcttcatgacaagggcagggctcatagaagactaaaacggagaagttagaaaagtattctaagccagaggaatagcgggaacaaaggaagaggtaaagctgagactgacatgggaagggcagggagaaacaacccttgtggggagaagcagtaggaaatgttgggagagtgaagataccccagatcttgaagaactttgcttcccaggttgagaagtttagacttaatgtgctggtcaacttaggaaacgcagaacctttggagatttttatgcagggtagtgacataacaaacatagtaatttagggaaactacttacacagttctatgtctggctgatctaaatataagtctgattccatggattgaatgatgactgaggttttaggctgttcattcaacaagtgcttgcctatatgcctcactcgcacacactataagccaccttgagggatgtagtcatgaataagcataatctgtgacctcagaaaacttgtatggaagggccaaagctgcaaacaactatgacaaagtcaaatgttataatcagagcatctcagaagttgaaagaggcccagaatatagataaagaagcagagacagacagagagacactaaactgtattatatttatttgccatgaaatattctgatctcatcttcattaattaagactaacctcctacttttaaaatattaaataatagccagtaatcatttatttaaaccattcttagagatgactttctgagtccccttagatgattctaatttcccaatatagcgaaatctgtagagcataattctaaaaattctctaagtcttttcttgatgagcagctgtgtttgggtgaatgccaagaaaagaatgaaactgggtcattaggaatagtgtttgacaaagtatgtcacgtactattcttggaattctgtaggatgtaggggaagcaggctcatatgagaatttaaaaatctcagggttaatatatttaggttaatatatttagtaacatatgataattgtacctgatattagaaaagtaactagaattcaccctcagaatagtcaggcaggtaggttatgtaagttgggcgacatgagtgcacggtaacagagtagaaagaatgctgaattgagattcctagaccctgagctgcagccacccgtttgtagctctgacctttcttcagctgtaatactgaacatagccacaatatgcctgcttgggtataaccaaatgtactgaatggaagtataaaagggtgggaggtcacaaggaaggtcatattagaatcacactcaggaaaatacattctctgaagcaagaagaaaagaatcagcttccatgtattactgaggagatgtgtgcttttattggtgcaataaaaaattcaattaagtaaaacatttttaatccatggaaattcaacaatatccaattgtcagcaggatatagtgtaagaacaatgagaagcattttctggaaaagaagaaattagtgattttcattgaaaaagaaattctattttattggaatgatttaaaaatctcttgccagcatttctctttttaactcttgcagtaacttactatacagaataataaataaaaagcaaaatcaattaaacataaatataaaaataagaaacatcagtcaaatccattttaccattatcagcctttccttttttttttttttctttttgagacagagtctcactctgtcactggagtgcagtggcacaatctccgctcactgcaaccttcacctcccgggttcaagtgattctcctgcctcagcctcccaagagtagctgggattacaggtgttcaccaccatacccggctaattttttgcatttttagtagagacagggtttctccatgttggccaggctggtcccaaactcattatcagcatttctatctataatttgtattttatataacaaagtagataaaaatcgtttgtgtttactataattagccatttcacaagaactgcaaactattgcaatttgtttttatttcatcagatgtgactgactaattagtcttgaaaactctacgcttctaagtattggaatccttatatcaaaatatactaaaatcccattatctttatgggatttatattgatttaaacagtctcctggagatcagacacattaattgtatctgtagagatttaaaaatttttgcattttaaaatgggatttaaagggacaatttattcttactaaacaggatataagactaaaaaaggtaccaaacaaaatgcttcaaatttcatatcaagaacattcagaagctatgatgagtgataaaatgggcacatgagtagttaatattcctatgattatagtgctgctcttgacaagtatgggtaatttaattttaaaaatagatatgaagtaatgttatttttaatattgcctaaaaacaaataaacaaatattaagtcctgggtatgagtctggctgtttgccaggtgctgcagatactgtggtaaatgacgcacacatatttatttctattccttgttctctgggaacataattctaatttttaacaataataatgataattcattgagcattattatatgctaatcactttatacattttcttattcttcacaaccatctaattaaatgggtactattattttccctaatttccatccatgatgaaacagactaaaaacgtttaaataattgaaatgatatagatagaatcaaccactaaactatactcacttctcattctggtgtgatcagaattaagttagaaatttggagaatagaatctcactatttgttttttacccttaaggtcaaacctaggcatttatggtgacagaaatgggagaccctatcttatgttggatgtgttaaaatacattacataaatccgtgaagtcacatttcttcacaatatgacagttttcttgtcttccttgtgttgctctaatactgcattgttccatgcataaaatgtgaatgaaaagatggattttgaaccacacttcttatctcactgatcataagagcagtacactagatggaataactggaagtgttgacaggatatttagcccactcctaacagggtggcattagctcagaaaaacacaatgcctttgtctgagtaattgatggccgtcccactcaatgctccaccagtacctgtgtgtcaaatcagaactgattgtagctgaaagatatttcagtcaccctgtctaatcctttaaatgcagcagaatcactctctgtactgccacactcctattagaatttcattttatttaatctggaactttttgaatagcagctctttataggcatccgtaaaagagccctctactcctcatgactatttctttagaacaagatgcaacagtccctgctaggctgtttgttccctctgtctgcactatactctcttctgaagaccagtagttccccaaagataaaatcatgacctaagctcacacacccagaagtcttatgttccaggccttgccaggtgccccgtccatcacagcttttctctgaagagttacctccaccctgccatgcattcgttaagatagtggttctcaaactttgtatgcattggaattaccttagacttgttaaaacccagacagctggagcccacctctggcatttctgactcagtaatttaggataggaccaaataatgtgcatgtccaacaagttcccaggtgatgcttataatggtgctgattccagaactacattccgagaaacaatgagttaagcatgtcataagcaacagcttattagtattaaagagctattgtgtgatagtggtttacttagctgaataaattagaatgaaattgaagttgcccacaaaatgtactttgcacactctcattcaagtgtacattgtacattagtaaagatgggagttattacggcagtgtgcttgcaactcttataggcacacagctttaagctatattcttttttttttttttttttgagacaatctcgctctgtcgcccaggctggatatattctatatgactgtgcactttgtcttacctgcagcccatcctgacttgctaaccattggcatttgtaggctattacgtgtgagatcccaggattccttgtctctaagcataaattcaagggactaaggttttcctatgaagtagactcaagctgtaggccatagggcatacttcaagaattatcgtaaagggtatccagcttgctctttcttctttagaaaacgataacaaaggcaaaaaacaaaatctatgctgttcagcaagtcacccggcagctgtaggatgtaggggaagcagaatcataagaattaaaaaatctcacatggcagtaagttgtagaggattttcacacagcccaaactttaccttaagcaagttacaatgtctgagttacaacgattgcctaaagtcaggtttatggtttgtgtttatatgttgttgtgtatgcaatacaatataataattcttcaagtttataatgtcatcaagaagctgtagattgagagtagtattcatacgtacaaacgaataagtatttcataggtaagtccaaagtaattgaacagtatgtctaaagtaaaatttgaagagacacatttgaagataattcagtctgatcagtcatctgtttaccaggatttattggtctgctgcttgataagattttatattttcaaggtcaactttctatttgagctgatgcatattatcacgttactgtgtacttcaacgaagtattgattttctgtctgtgtgttatctcttatttcaggatttcattgtgattttcaaagtgtgtaagcaagcttataatcaatttagcgaattcaggtttataaattaaacatctcttcttcagcttaactctttggagtgtctccctcagttgattttgagccactaagaaaattcaggcatatgttgtacaaataagaaaataaaagcttttttgtctttacttttctatcaaaagagatgacatttctactgctattgttgccttatctcttctaagaaaatcatatctacatttggcttatgataatttaatctatgtataaaagcagtgagtgcaaacacattcatgcatctttaagtaattgaaataaaatttaattaacatggtttattttcctctgctttgcataattaatgaaaacagagggcattcttaggctcagaaacagttgttagagggagaaaaaaatgtagaactaagatgaaaaagacagcaagaagttaacttaggattaaactttatagcatatttgtaaactacatacttacctgggtaaagttcacaatgttttctttcttagactatcaataaagtgctgctccagtatgctgcaattgtatcaagtgatttcagttcacattgtgataaggaaaatgtggtaagtaaaaaatgtctctactttcaagtatctctcagttgagatttacttcttcaaagtatgagtaagcaagataaattgttgactttcagttttcacataggataataagaaataaggatcttaagaagctggaaacttctccagggttcttgaactggttttaatacaggatttacaggaaggtagagagtgtctcaatgccagccaacttgtggttttccatgtagataaggaacaagactagaataaatcattgaaaataaacatactcataaaatactggagctgagaaaaacaagggacttaaaaattagatgagtattggcaccaactagtttcattttggcattaatactcaaataagtgtaatttagtctttcagttttcaaataaattgcaaacgttaatatatggaacaatgctgatttctattctgaattattaaaatagcttttttagatgattgagaaaatatttataaaattcaaactagtattgcaacttaatcaaaggcataaagaaaagctagataaaggtatttgaaatatagtaagatttattttatgatggaaggtgaaagctttcttattcaatctgtaatattaggagaaatacattggcagcattgtaaacattttgaaaaacagtagctctgaaaaaaaaaagtgtttaaaaagtgagtatagggtttttttttaaaaaaaagaaaaaccagttttttccccctccaaaaatcagtttcgctatcaggtgaatctaaattattctaaagaaagctactagttttctccctgaaacctcattgacctcttgctgacagctcattaagataagtcagtcctaatggttcttgagaattctataagatgcttcttttccttaaattaatatgctgcccagaaattttattagaactttttgacaactcaaacaattatttcttattgctattgattatactcaaaaagcaagatatttatttattgaaagtatattatttctgattacaagataatacatgtctaaagtgttacattgaaaatcaaaacagtatctgataatttcacaaaaggatcctgtttatactaggacagccaaattgaagattttgaaaggtgaccatgagctcctaaggctaattcctgccattcagaaaggcaaattagtttttaaaagcccctgcagagttccactttatgtattaacattctatattatattttacatttaataaacactgagataaaaatcataacccagtatttattatattattctatgtactctttctgtaggttttatacttggaaaaattaaatctttataaaaagaaacaaaagccctccaaatattacagcaaaggaacttccttttccttccctcagtgcttttcttccataattactaatatcttgaccagccttatacactgttgcttaaatgccaagtatcattttagcttttataaaagaatatcacttggttactaggcttatgttttcattcaaggcaaattgaaatgcttttgtacatttccatgagtatatatagttactattacagatacttatttataattattttaatatcagatttcaatatcaagatcactgaaacttgtacatctttcagtatatctatggcaatatatctatttcatctgcaaattgagctagaaacatctaaagatagacatcatttaagatacgaccataatataggccgggcgcggtggctcacacccataattccagcactttgggcggctgaggtgggcagatcacctgaggtcaggagttcaagaccagcctggccaacatggtgaaaccctgtctctactaaaaatataaaattaaccaggtgtggtggcgtgcacctgtaatccaagctacttgggaggctgaggcaggagaattgcttgaacccgggagatggaggttgcagtgagccaagattgtgccattgcactccagcctggccaaaaaagagtgaaactctgtctcaaaaacatacaaacaaaaaagatatgaccaaaacatttgagttctccgggttcagaattaaagaccagagttaaataaaatatccatgtcagaataatttgttttctactgtaacattttaaattggaaatgggtcaaaatatttttatttatttaatttcacattccaaaatatagcaagacatcacaatctaaattagaattacttttattttaaataatctttaaaatatttttaaactcagaaacactttggccatgtagaagtgttcctagtctgaaactttcatattcactatgtttcagtttcctaactttgttccagattgagataaaattaaaggtattattctatttttagggaaaaaatcaagatataaaaataggaagatataaattgactttaacatagtttgttttatcttactaaactcaaaaagcaatatccctgaattagggtaatgtttcctttgctgtcagtttccttttttcatttactatgaagttgttctttttttcatttactatgaagttgtcgaaagtaaaaactgtttcatgattaaatttaaggtgaatttgtataatctgttcccagtagcagtttgatgaattgattcagtaaaactgcactttgaacatttcaaggtcagggaactcttaatgaaaagggagagtctcaaatttatttttgtttccctccggataactgcatctcctcttttttctctgtagtctaacttggggtcaatagcaatccatgtcaagtgagccaaactgtccatgttcattttgttctcagtagctctttttcatcagaaatcatcatagtaagaagagttggcagttgacctttatttataaagctagtactagggtcctgttacatgtgacaataaagattagcttgaatgttaatatcaaataatctaagaagagtctatcaagctaacttagacatgggaaacaaggtgataataaccactcacttgtgtagtcttcctgtttctcattataagtcattgttttactttgaccttggatttctccctggtaggattgcccagattcacaccaaatcttccctttctgcaattaaaagtaaatgtcaatgaccctacctcctaatgaaaagataggctattggcttagtttgtggattttggttcaagatgctgaatcctctgaaaatgtggccctactcactatggaaaggactaagcccagatcaagtagttctcacttatggctatggatcagaatcatttgtggaacattttgattcagctaattaaaacagaatctttgggggatacatctcagatatctgtgttaaaaaataaagtttttaagtgactggaatcaaggaaacagaaaggaattattaaattgtttgcataaatcaaagtgatgatgtggtcactttaagagtcaagtagaaagtttttcaaaggtcattaatgtggctcaagtaataataaaatctttccactgataagagctaacacctctctgacatcccttgagtcctttgcatgactctggttattgggttatttctcagcaacttggaagatacatccattttccttcctttgtctatttctctttctgtgtctgtttttctctgatatactggctcttaggaatcaatatacagcaaagattaaatgattctataactattatgaattgttttctaattatgaattaatgtttactattctaagttcacatctagacctgtcacaaagctttacatctttgttattattatattatctggctccttggaaacaagtggagaaacattttctaagcatgtattatatgtacaccactgtgcagtagtttgtgagtaagaaaagcagaaagagacacagcagcatgtacaatgtatttaacgttagctggtgagagtgaaaagcaactcaaatgtaaagcaatgtaaaacaaatgccaagtgagtgataagataaaatccaggaaaaaagaacgctctaacctgaatgatggatatgagtcaaataagcaagtaggaaaatgagaagaaaaacacaggttaaagccagaagaaaaacacttcgaataccagcatgtggtctttacctgcagccagaaaatatatttaagtttatttttaaaatgtttttgcatttaaaaaatcacatggtattttcttttctaaaacagtaaaataacagaagaatttaagctaacctttttctaaaagtaaatctataaaaacaaaaagtgtgcttactttctaagtatgaaatgttacaatgttaaagataaaagaaactttagcagcaagtctccaatggtttattgtctgagtatgtttttaaatttcattccccaatgtggcattatgtttctctgtttccattcttaactgttacaaactataatgttgaaatagcagaattagtatatacatctaatataataggaatccaagatagctattttccaccacttataagttaaactcattcaataattttatataaaaagattgctcataatagtctttttttctatatttaaagccctgtatcttgatgaacaatattcaacaattgcgggtccagctggaaaaaatgtttgaatccatgggagggaaggaggtgggtatctttttctcctacatttgctaaaaacctacttagagattattagcagcatatctcttgctatgaaagtgtcttaatcaagtttttacatggttaactaagaacaggaaatgataataatctcaaatgtcattaacaactaaaatgattattatccacaacagaatactttagtaaatacattagaagtgtgaatgggaggcagaagatagtagcctttggtcttctgtgtgtgcgcatgtatgtttgtgtgtgtagtcatatatacacacatatatatttgtatgctaatgacttgtaaaattccacaaattgtgtttttcactgtcttgtacaatgtcagcttgatatcaatgtttattctgcaatatgctttgtggtgctattggtttttgatgtactggagtttatttttcacattgagaaagctctgtcaaaaatgtgttgtgtgatgtgtctgtaatgtgtcatgtctttgtccaacatctttgacttgcaattccatgagcagaagaaggaaggagaaagattcttttatgaggtttgtgatagtaagcatcttatcccttacctggctgttccctccaaccctcactccatacctaaagaccattgcattttctacttattcccatttgcttgtttggaacagacagacagtgaaatactagctatgcacctgcatcttcctgcctgccacagtcttttctttcataaactgacctaagcattcagggattgaggactggagaaggtgctgagagggagggtcatgaagcagggtttctccccatgcccttattccgctggaaacaatctcaagggcagctatgtcaagaatatgtagatatatacttctgtttaagattcctttacattgttccttcccgtgggaaagtttatgagatgtgcgtaatgctaggatgcatttcaaagtaaatatcccttttatttctaaacttatgtgactacaaatgtttcttttaagattggctccttcccatgtgattttgcttttaaccccaaggagatgtttttacacttctccaatgtctgtttctttttcagtattttgaaaaatgaacttgctatttagcattctgcaatggtgaagcactagaatatatgtgtgatgatgcaaaactttaaaaaaatgaacctttatgagctgtgccttcattgcaatctcagttttatttgtataaaataaggcctcattccctaaagtgtgttaatgctttatgtaaagtttgagggcattgatcttattttaaaattattctgctgaattaggtaagcacaaccaattaaggaatataatgtgagatttccttttcaattttactgatgttttatattcagacttgaagtccacttagcatttagaaaagtgatgaagaaattattgatttcatgtgggaaatattatctccttcctataaattttaaagcccacaaatcatttaagaataaagttatatttaaaatgtcatatttccataaatttatccttatgctacttatgctatttcattactattctgtgtttgaactctaatgtgaataacatattgttgaactgaatttaaccagataaatcagacctgtacttaaaggaaactggatgggccaagccacttgctaattaaaaatgttataaagtggcttgttcaccaatcaaaaatgaattccttatttcagatagaattgctggtttgaaatatacaggtttcacgctattcattttatttcaaatagatgactaaaccatagaactcctcctcttattgaagaacataatgaaaacagaaatactgagcttggtaccttcttcctttaaaactcttgcaatgtctacttgctaaactcctcagacacgatttaagaagaaagcgtaaataaatcagtgaaataaaatgaatgcctagcttctaacgatgtaatcttctcctttctttttctaaatattttttttcatttctttccttcctctctttacccttttctgtgattttctgtttctcctgttttctttttctcctctctatgcatagatcttttctcttactgtgttccattttcagctcaaagttttaggtagggccagtcagcatttgcatagagattgatgaaatgtcaggaggaagcaagacttgcattcaagtctgagtgcatcatgtgtcctcccagaaaatagaagcttaattgatacagaattatgatagaatttctgattactctggggtctcaaggcaacagaatttcaaaataataagcagagttcttccaatattgttgtataaacatggcagtatctaaatggtttccttaacttggggcttttataaagatgaaaaaggatttgattgaaaattatagaattcaccctttgatatgagaaaattacagaattcaccctttgatatgcaacacttgatacagacatgttcaggggcctttaaaagttatacaatgtgttctaattcaaattcccagttttttccttacagtggaactggttgtaaaacctttcactggtattataaccaattccactgtaaataagggaaatattccaggctagaccttattcttcatttaagagtttctttttatcttatcccccaccatctgtgctgatatatgtacttcttgctataaaaattaaatagcaaataattgcttgtgcacttgctcaaaatggtttttaatgctatgtgtttattagctggcttctaacaacagcattgctttcctctaatattatactatctgcaaagtgctggctgcttacaggcatgactgcgtgctactgcagctccctgctgctttaaccttatcaccatgtagttgaggcagctgttttttcttcacagaatcagcctcttttccccctggaaataaaaagagtgtttaaaaccctttttcagtggaaaaattcactctctgtatggagttcaaatggaagcattgcttaacaccatgatgatcgtgggattatgttgttgacaatggttccaaaaacagtcacttaagcaatcattgttagacagttgcatgcacaatatcctatgggccatgtcagcacatttactttctaatgccctatttagggaaaaaaaaagtcaaaagagaaaagcaaaccactaattttcttctcctctaaagtgattttccaacacacttctctgcatacaaatcaggggcatgttttggcataacatctctgattcctctagagaatatataaaaaaaaatctcacaaaccacgaagaaaaactaacctttaggaatggagtacagagtctgtttttttaaaaagcacctctggtgattttttatgtggatacagttttgggaatcactatactaaaacaagtaaaatagccaacccgtgttatagatgtactagagctacaagttaatttgcactacaatccccatataatattatctgtccctttataacacaataacaacaaaatgattatcagggtgccatgtaataattttcattcattggtgagtgattacgttaggttacattatgttaatagcttaattatttcatgaatataatttattatctatcaattgcaaataattacttagcttgtattcattttgtaacaaaaacacattgctgcagcccatgaaaaggacttatcattaatttgtaatctaatatatacaggtatatgaaaaaatccaaaatttaatttcttttcaggaagttataagatatgcattttgaaactctaaagaacttgtgttatgatcattgatttagaaggtgcattaatccttcacaatattttattggtgcaatcgttttaaatggtagaatccatagttatccataagcccactaactgttgatgttacttcaaattgtagttagctgttattaagacattcagggaaaaaggagggttcgtttgttcagctaaattattttcatctgttgaccacaggcagctccattaggtataatgataatgctatttgtattgttatgactcaaaaaaggattgactcttctgtgtcataccatggtggtaaaatttcccatgagagtaacttcacataagtccaggcagaatagagccaaggaatctggaccataaccccatcattttaaaaatatggatattgtaatggtcaactaaattatccttttatttcagagatgtatatctatgtcgcttttaatttttaatgacaaatttgatgtgtcaactagaaattgcatctgactgcccaaaagtgtgtgtatgtagctcattgaaattcattgtaatacctattagccacatggactaagtcattagctaagcaaccctagaccaggaaggaaaaacattaatcttcatcatttttcacttgccactagcctctcaactttaaacgtgctgaggcaacaggagatgaaagatcagagcttcaaaggaaataatactccatgccagtagttcttcttgaacttcagcacgcatcagaactacctgatgagtttatgaaaaacacacatcactgaactctacccccagtgtatttgattcagtacgtttggggcagggccaggtgatttgcatttctaacgaatctctgggtgacgctgatgctactggtctggggaccatgcattgagaattactgctatatgctttctgaaaaagaatcaggccaggtgtggtagctcgttcctgtaatcccagcactttgggaggccaaagtgggtggatcacctgaggtcaagagttcgagatcagcctaacatggcaaaatcctgtttctactaaaaataccaaaaattagccaggcatggtggtgggcgcctgtaatcccagctactcaggaggctgaagcgggagaatcacttgaaccctagaggcggaggttgcagtgagcagagatcgcaccacggcactccagcctggaaaacggagtgagatgctgtctcaaaaaaaaaaaaagtatcagataattagaaaataacacagaatacccgtttttcttatttgtacaccagtcctgaccagcctactttctgtgttttgaatcttaagaacacctgagattcaaggtgtttgtatggaaattggaacagcatgcaagagtgcaggcaagtatttgtattaaagaataggatagtcccaaaataaaggtagtcgatttgcaatcatatacaaaattcttgcagttttttaagattctggcctttatgcttgaattttatatgtaatcttataaaaaatggtgttatagttaacagaggccaaattttacattcaggtttctaatctgtctcaccttttcttcttaatatagaaatataagttactagttaataaattaataagaattaatctactgttctcatattttcaggaattacaaaatatagaataaattataaagtatatattagatagtaaaatagacaatttcaaattgtcacattatatctttcagttctaaaactgttttctaaaccaatttgaaaagttcttcgtatttagttagaatatccattgttgcctacttacatgtagtttatctgcaggtgggcagaaattggggtacaaaataaaaacattttttaatgcctggggtctcaaggagcttacaaggtgtaaggaacttggtaaaacataattagactagagatgccttttagcacttactgaaggatattcagaagccagctgttccacgtctttctccaccactgtaagcacctcttcctcttggggctgactgctgtatgaaaaaaaggtctgagcacactgaatatgatgacagaatttactccttcgctaattcattcaacaaatatttatttgctgagcacttgttatgagctgtaaattttactaggaactggagatacattaattactaagatgcagaccccaccctcaaagaacttagaagtttttaggggaatcagagcaattaaagagataaggtttgtgagagaaaaacaacaaggacactcctaaatgtgaagatatccttcagatgaaagttttaattgttataacttatcctgcaacaattcagaaataaactcaaacctcacctcttgttgtataaatagaggtaaaaagggaaatgtaatttggctgacgtcagtaaaagcaaccagttatagcttcatagccccagataataaggagaattgaatatttgaagtgctggccttttattgtggcaacatgcacagactgcctggtttctttctcctcctaatcatctctgcaattagatttaataaattgaacttaatggaaaattaagagaataataagggccaataaagcaaattatattaaagtgatttaataaatatgtttaataatttagcactactaccacataaagtttagctaactgctaagcttgtgaaattaagaaaaggtgctgctgaggaggttgaaaggttttttggttggcgagccatgtcaaaatgaaatacagacccaggcaggtgacgcttgttaacctcatttcccagagcatttaagagagctcacagggttactcatatactgccaagtctctttttaaactcacctctctctgaaccttaagaaaacttaaggagaaaggacacatgccccagcaaggaaggagagggagacggcttcactttaactgccatcttctataataaatctatttcattatcttgttgtgatcaccttcagttgctcatgcctgctttaacaaaccataaaccaatgccattactggtaaaatttaacttctttaacccagtcagttctcttgtttgccctactaagcagaatagtcctcagacaccctgagataatggctcacagagaacactctgtccccagcacttgatggtcaacaggtcctgaattcagttgactgggtggactatattcacatcgctgagcagtggtttataacacatgcaggaatgtgaagaaacagccaaatgggtcagacagagtaggtcaggggaaaagggcagaacaaaattctgaacataaagtgtctcgttgattctattcctaacttatccctacccagtccattttcacaattagccaatagatgcaacatgtaagccctaaattcctttcccattgttataaaacggggattcctgtttttttaatgaacattctcagaagagaatttcttcagaggaaatagcttctaagaatgcagctcttcagtccccatgtggctccaaaagcataacacattatctgtgctttggttttacccatttggaaacaacgaggaagttgaactatgtgatttcagaaattctttttttttctaaatttctgtcattataaggacaatccgcatgttagcaatccatgaagtagaggaatagtgtatgtgttgcaggtgagaagggaaaaaatgtataagagaaaagaatgtcacatcactcatataaagcctgaaggtgtaatttaaagaaaaacagttcatagaaacagaaaaagccaaaattccttatattcactaactcaaaactatattgagtgaattataaaaggtaaggcaatctttttttttccttcagttgtctagactgaagaacctcatttaacatatctcaaaggcattttgttgatttgaagcacagtgacagttggatttactgcatactctctttaattaggatgggagacagctattgatgttcaactttttgaaacccagaagttagaaacatgaatttatacaactgatacctctagcataacattcatgcaaatctgaataggataaagaaaatgccatagtctgtctgaaaattgtcgtgtaagttcttggagtttctccttaagaggcattttaaaacgaaacaaaaaacagggtagtatggttagagctgggcacatttgtttccggtagagaggaccgtgtattcttttacttctgacaacaaaccacagtattcatgctgacaccacaggcttatgaagtgatttagggcatttccaggaaagtaccctacttctagattcactagggaatttttgctgaattctcagtcatatattttaagttgaagtagaccctataagatgaaaagattccggtcaagtggaagatttgaaggaaaatgatgttttaaaaagaaaacataaaaaaagcaagagcccagataagattgtgagaagttgcttgaagcaattccctggtggaaagccagcttgaaggatgatacgccagtgtcatgatcatatttgggtttattacaccagttaggaggatgaaggggggaaacaggaaataggaacacaatgtgtagatgattacagtaggctagaggagaaaaattcagaatctggaagtgaagaggaaaaggcaggtggataaaacatttcagagatatcaccaatcatatttggtatggaagtaaatatggagggaagaaaacagaagtcaaagatgactttcacatttctgccttaaacaattgtaggccattaaccaaatcagaggaaataagaagataaataaattaagaatagtaataagttgtgctttgatatgctacagctgaagcatgtatgagccatcaaagtggaagtttactaggtacttggaaatatagacatgattctcaggcatgctgttaagaatgttgataatagatttggggcccttagcatatgggtgataattgaagccatgggcatgaatttaattgctcaaggggagtacagagtaaaaagaaaagaagactgaaaaaggagaattgaaggacactaatatttcagggatatacagaggaggaaagttaacagaagacagacaaatcacaggcagttagagaagcagggaaggaccttgggaaacagagcaaacaacagtatgaatgaaggctaagataaataaggtccttgaaattaagaaatcattggtgaccatatggaaacacgtcagtggcatatctgtaacagaagcaagccacattgcagagaactaatgaatgtttaggagaaaaggatgtggagtcaacaagtctgacactgttgtaagcagtctgaagatcaaaagaaggaaggatattggctagatgtcaatgagaatgtagttccaaataagtttggcttctctttcattgtctgttgtttattttaacataaatgttacttgagcatatttataggatggggtaataaaattaatggtagagggaatgaaaagggaaagagataattgatggaacaaaatccgaaagaaggaaccaagagtgcaagttaaacagcatttttcttggaaataaggctttttcatggaactagaggtgaaatttttatttattaatgttttaatgcaaaaatattggagagtatgaaacctaccagaataatgattaaattttggcccctggtgagatggccaggaagttaccttccttcctgatttgcacttctttacagaaaataaccgataacactgatgagctgaacacaggaaagatagctttgtagctcgtaggaaatgaaggaaatgagatagtaataaagactgtgaagaagaaataaaattcacactaaagatctttaatttcttccatgcaaagtctatttttcaagagtttatattgagctatctgaagagtttaaatgacttttaaatgactttgcaactcattgcttgtaactctagcaagagcttgagggtcagtttaacaattgctgctgtaagagaatatataacatgtattttctttagacctctagggaaataatcttttctggaaaacaaacaaacatgcagtgtgggtatggtaaccattcttctgaaccaaacaaatagcagggaaacacctgacatggtctggcaatgagatagatatttgaaatcaggattaacttgataactctggaatatatggtttctaaggaatgaaagatttcaagggcaaaatatcctattcatagttaatgcaaggtatcagtccaaggagatgaagatgatataggactgcttctgtgagggaatttttatgcttctgtctatcctcacttccttcctcaacatgtggtgaatgcccatgcatgcaggacactggaacagatacccaggatagaaaagtatgaacaagttctatggaagaggtagatttataagagagcatttagagagaacactgcatacacagttatagtaaagagcatagtcagtgtagaggctagatctactaactgcctagggctagctacacttgagcgaaaatttgcaaaaggagataagtgaattatcttttaaagaaaaaggaaaagtaagccttaaggaaaataacttaagatgaaggaaaataacttaaaagatgtctttctggccaggcgcggtggctcacgcctgtaatcccagcactttgggaggccaaggcaggtggatcacctgaggtcaggagttcaagaccagcctggtcaacatggtgaaaccccatctctactaaaaatacaaaaaaaaaaaaaaagctggacatggtggcaggtgcctgtaatcccagctactctggagggtgaggcaggagaattgcttgaacccaggaggtggaggttgcagtgagccaagatcgggccactgcactccagcctgggcaacagagcgagattctgtctcaaaaacaaaacaaaacaacaacaacaacaacaacaaaaagtcttgcctactagctggctctcccagacaagttatatctattaccacagctcaatggtataaaatacctcaatggtgtaaaactcagttaatacctatgtgggattatagtttattctgatcatctgaaccatactttggcagcctagattttgaaattcccaagcccttcgtagagtggggaattaaatctgtcttgaaaactttattttaaattcagaatttgactcaaaatccttaaattttcattgtgtatattcctcattacatagaaactttatttttttagccagccaaccaattaagttgttcatacacatgctaattgagtttctactttagaatacactgtgacttatgaatattcgaaatttttctgttctttccctcttaatttttgcttttaacaataactctaaataacaatacaaaaagattcaagataattttgatgttatactacttatataactaggataagctttaaacctttgaaaaaatattagattgccttttacctttacaaggtacccaataattttaaaaatatgctattgataattcaggcaatgagctctcagctcccaatctattatttcttaaaattttacaaaatttgtaggagtaagaaaaatgtcctcaatttggacacatagagtaatgcagaagaactcaaaaactggtagttttgctacctaaagagattgttttattattagatgagtatgataattatgtccattatgctcattattgaaaaagatctgcaatttgaagagccatgtacactggcctcagaattgctttgcctgttttaatggtatgattcagatcatgtaaacgttaaatacttaactgaaactaaaacttttccttttgtgggagggactggttacataacagagacattccgtctgcacctgcttagaaacatacctatgtatccagaaattaaaactgtcatccaatgttcaaatcgctgtagtctggcagttttaggttgtcaactaataattatttgatgagaaatatctattcaccaaatacctaaggtggactaaaataattctataagaaaatagcataattttgtgcaagtgacctatgtagccatttctgtatgaccttgaaggccttatctggtgataatcctacctcaatgtgaacaaattacctcagtgtgtatattaaactaatatggaaaccaaaacacattttaaataagaagcaacccccatttcctgaaggaaatactgctttcagagcgattcccttggaggtggtagaggtatgggtggggaactaccacccatgtgagcaggaagtggagagcctgaagaaagccacatggcagaacttatctctcattccctcttccccaacatttttatcaaatgaaatcaaggtaaaattgttattagcacaataacaagaaaatatcatttaaaaaaattcagcctgcatgattccttaggattggagtggaaaatccacatatgttttcttggttaggggttagggagttatagtttgttaggcaaattgtgattaaattcattatccatattttaagtctttttaaaataagtatgtactatctaattgtctttctgaattacttccctgcaactggttttagctgaatagaactctagaaagtatgaagctcacagatatgttaattttctcactcttatagaagtctctatctgttatgatatgttaattttctcactcttatagaagtctctatctgttatggtagcctgtgtgtctggacaagagctgtcaccataactgattactgagacagaagaaaaaagatacaaggaatccagaaaaatcacattgcctctgatagagggcagaagctaaccaatcctgaaagttaggcggacttgagttaaaactgatataaaggattggtttgatataattaataaagtctcaaatgccaaatgcaatatttgattttcattccaatgtttttagtcacatcaggacaacttagagctacccagctgcagagatatgtaaataattcttcttcctaacagttccttagtatcagaaaatagtcttggaggattataggacttatgtccaatgcaccctcatagggatacttcttggttctgtatcggctcccaggagtttaaactgatattaggtcctatatttagttggcattcttagattctcttacttatactaagtcatgctttaatttgttttactccccaaacttggctttatcctgtcctcttcttttcaatagtagatcagcttgggcaagaactaatgatattaatggtaggaaactaaatttctaaaggtagaaagaaagagtcacgttccaatttcagagaatatttcagattgctatttacgtgaatttctctctgcttgatacaatagacctattatcctgaactttcagctgtaaattagcaaccaggaagaaaagtcaggactatcgtctccagaaaaacatgggcgtgcttggataccttgtctatcctattactcttaattccaaagttggggaaatatgaaaacacctttaaataatgcacaacacaatattcaaaagttaatttttaacaacttttattcttaatgtgcctatttatttacagggatattaaagatttaaataaattttgaagcaacacatatattcagctgaagtataacaggttttctaaattacggaattatcatgttctggaggatatttttgtcatgccttgcatctcattgctataaccaacaaaggctttgttatctagctgttacttgtatgcatgccctgcatttcaaacaattttttgtatatgagaaccccttggtttctttaaagtttcctaaatgtttagatttgatttcaaagaccaaaaaaaaaaaaaaagaagagaaaaaagcttacatgttgtttgaagttaccatataataatcaaaatgcttgtaagcaaaacagaggcatgctttctcaaaactccaaagtaatattgtttatggtctctctgcagctagattctgaagctagtactattctaaaagaacttcaggttaagctcagtggggtcctggatgagctcagcgtcacttatggtgaaaggtaagtggcctctgttgtcattatctaaattagataattaggtgtcagttcatgatattcttgccttcaatgctgtttcctctgactgactaaatctacttaacttcaagacccaatctaaatgtcattttctctgaaacatctgttatgaccccacaatctaatagtgctatcttgctatgcactccctagaactctgtgcatccttcggtcggataacacctataacactatcctcagagttttgttttacctgtctatttcccacactcaggacagaaaccatatctcacacctatatgcagttctagtgtttagagctgggtgactggctattgaaagactaaagacagggagggaagaaaagagaaaaacttcacatatataagaagtatgagttgtattcataccatgcatatcagtgtggttgccgtcagtatagctggatcaacaaccctataccaaattgtcaggattcttggttttagggcctagcaatctgaatacaactaccccatgggaaggagtttggaaactattgatatatctatatattttaaatgtttgttaaaactggctttatctgtgatatgaatctaaagaaagataagttcaccctagttaaatttcacttcagttctgtaggaaaaatctatcacctcatcaaaatgttaaaatagctaggaaagaaaatatatttttgaagaggttcattaatatagaatttgctttaaatattagttaaataactgatgtattattttaaactatgtgttcaattttcaaaagagactataaagattgctcttcagggccgggtacggtggcttatgcctgtaatcccagcactttgggaggctgaggcaggtggatcacgaggtcaggagatcgagaccatcctggctaatacagtgaaaccccgtctctactaaaagtataaaacaaacaaacaaaaaagtagccgggcgtggtgacgggcacctgtagtcccagttactcaggaggctgaggcaggagaatggcgtgaaccctggaggtggagcttgcagtgagccgagatcgcaccactgcactccagcctgggcaacagagactccgtctagaaaaaaaaaaaaaaaaaaaaaaaagattgctctcttcaggtagggactatctctggccaccactcatcacctgttgttgtgttttagaaagatccactattaataaacatttatcaattagttatgccattttttaaataagaaagacaaaagactctgaaagcatcatatttttcttcttagatgtaggaataaagcagagtgaagaataatctcccacttagccttctcttcattatcagaggtgtgtctgtaacttccttaagcaaggtggccttgtcttcatggaactcaccttcagggctcagctgctgagccagagcagccttgctgtgttgagccaagggtagtcattctgcctctgcagtgttgttagctgattggatgatcctgcctacttcaccgggatgttagtcagcaatttcaaggttctgtttacctgaagttggagaaacatagattgttccagagatgtagggttcattggctctgacttggggtgacactgagagatgaagaggcctttgctgagccatttcaggtgtgtctctctttgttctagttgcaaattaacatggggttagcagaaagactgttgccttcagtcacagaggcaacattagagactatttagcaaagttagggggaggaaaaaaaagaggtcaggaatagctagagttgttcagaactttatggaaaataagatgactaaacagagtagaaactagaatataagtaaagtatatttaaattattttctgtaaaatatctaaatcattctgatgataagtgctttttgttttgtttggggaggtggaatattcaggttataaaggctagaatatgttttctgattcgaaagatatctggataaaccacagttatgaaagaaggagtagtatccttaggaggacacttgaagagctttatttgtatgaagccagctattttagcctaaacagtaaaacctgcggctacccagaatccatttattattgattttttaaatataggaaagaatttagtactctgttcaattagggtttattaggactattggaataaatgggctacatgtcatgctttcctaataaaaaatataattattatatccttgttgctatgttgctgtggctttattcctcacactaccaatcaggtctatattatactgtcagggtagaaaagtctacagtaatcaatgtgatcatgctgtgaagtcacaatgcacaattttagtctgaacctactcttcttaaggtctaaattggcagtgtagagttttagaattaagtgcataattaattgtaaaaaatccacttgattttatgttattaaaactcataattaaataattctactatatgcagctgttaggatgtctttgctgtaaagtcagagctgagccaaaccacacatttgtggaatcctgacatgctcacagggcacctacctgggaactgagactaagtgatataacctcaacaataacttgaagatggtcttaaaactttcaaaaggtgtgccactagggtttctgcttacacatgttttgcagtttggtttttggtttgctcctttttttttttttttcttattaaccaacacctttagtactagaggctggctagattaagtaaacaaaaaaattcaggaatatttcgtaggcattattttgtgagtgtgtggctccttgggtgctccgaaaatctttaattatttactggcactacttttattcaaaccagttaatacaggctttttttaaaccttttctttttctatttttctttttctagtctattctttttctattttttcacgtaataggagcataaataaatttcacataataggaacataactgtcacaccccttgtccagtctgtccccccaccccaatgctctaatttgaaaattagtgcaaaagaaaatcagtgcaaaatcagtctatctccccaccccaatgcactgattcgaaaatcagtgcaaaagaaagtagtcatttcaaaggtgattttgactacagccagcaggatcatggatgaccccgtggtaaatcaactagttcaaaatattttcagcatgatttgccttcctcttctattgccccaagtatctactacctttactttgattcaatacacactccaccacaaacaacatccccttcatcattttccccaccatctcttgcaacctctacctgacaaaagtgcaaaggcagcttcagccagataaaagtgaaataatcaaggatttagactctcttggatgacagcttggaagagaatgttcctttaaagcagataaatatgcagagagccaagaaatgagacaaattcaaaggggccagctgagatgcaaggatcaaggaaccaaatgtaaatgccaagcccagaggggcaagaatggtgttgtcaacagtaaagaaatccaagaattcaggagccaaaaatggagacagatcaaacctgatggtagaagtggaatcaggccttaaatatgtacacaaaattatgaacaagtgtatgtataaccctgctattaaaggcccagaagcaagaaaaacatccaagttgtgataatttaacatttattaaaatttttccatattaagcatggaaatatgtatatggaaaaccaaatatggaaaaccaaaaactagaaaaatgaaatacttaacaagatgtcaactaaaatatttccataatgtaaatgctaaaatacaagttctcatatttgctctaagaacaaaacactgtgcctgttctgttcattgatatatcttcagcacctagaacagtgattggcacataatagtttagtaaatatgtggagaatgtatgcatgaataaataaatgtgtatactttatttaataaaagcattatatagtgaacattcctaaacttctacttaaaatctgaggaatttatgcacttagatacttctcaaatactaactgtatcatcattgtgtgtggaggaggagaggagtgggaatgacttgactgcaatactaaaatgaattccctccttctcctcattaccattccaatcatttgaccattttccaagctttcattgatcttcattctcctaagtagtttttcttgcctgcccacacatttgttattattactcctattgctggaaacatgagaatagcagacaatatagaggaatggtggtgatgctaacagtctccaagatttgaatatcttactacttgccatgcttacttaggtaagaaccatcaaaactggtgtaggggatatacagaatgaaaaaagcaatacgaaatattgctcttcgtgacatttaaatccttagagtgggtgaggcaatagaggtaggtggaaggagatggtccattgatgcattcaacacatatttcctttttaatagctttattgagctataattaccatgtaaaaattatgtatatttaaggtatacaactttgttttgatatacatatccattataaaatgatggccacattccagataattgacgtatctatcaccttcatggagttgccatttgtgtgtttgtctgtgtgcatgtgtgtgtactgagaacattaagatctgtcctcttagcaaatttcaagtatataatgcagcagttttaactactgtcccaatatttcctgcataacctctttgtgccaagcatggcatcctgtgccatggtatgggcatgcagcactaaacaaaacaaaattcctgctctcatggggcttacattatagggagggaaacaggcaataagcaaataaattaaattatgcagtgcgtcatataatgaagaatgccattgagaaaaaaagaacaataagggaacagagatggataggaatgccatttcagcttgagtgaacaaggaagatttctctgaagtgatatttgatatatgcctgaaattaacgagggaccaagagagccatgagaatttccttccatggcagagggaatataacagtggccatgagataagagtgtcctcagagaattctaagaacaccaggaggtctattgtggctggtgcaatgaaacagaaggaagagtggcaagaaatgagatcagtgagattgccagcgccagattatgctgggctttcagtctgtcaaatacaactagagttttttctaagtggagttggaagctattgaagatttttagcaaaggaggaacatgatctggtttttattttaaaaggctatctgtagagggttgaacagaagcaatttaggaaattattgcacaggttcaagtgggaggatggtaaaggggtctatagtggcattttcggaagtaataataaatcctcagatttaggatacatttcgctgacaggttggatgttgagtatgagaaactcatcagactttgaagtggaaagattgcatgggcagttaaataaaatagtctggagtttgggttagaagtcaggtctgcagatgtgaatttgagaaccaccagtatatagatgctatggaagccatgggactagatgtgattgccaagaaagtgactgctgatggagaagtgaagtggtccaaggatgaagcccagaggatcacagtgtaggatttccaaacaaaatacagaacaccctcagttaaacttgaattttagatacataaggaataatttttagtataattgtgttacagatattacatggccatgtttgtactaaaactattcactgtctgaaattcaaatttaactcagtgtccagtgctttcatttgataaatatggcaaccttactccaatggttagaggtcaggcagttgagaaggagcagcctgtgaggtcagaggaaagccgagaaggtgtggagtcacagaatccaaatgaagaaggtgtatccagatgccaagagtgtttctttttttttttttaacaacaaattttattgaaatataattcacataccataaaattctcccatttcaaatacgcaggtgagtggtttctagcatattcacggaattgtgcaactctcagcaaaatctaactttagaacactgatatcaccacaaaaaagaaaccctatacccattagcaataagtcccattccactctcctttccagccctaggaaaccactaatctcctttctgtctctatggatttgcttattctggatattttatataaattgagtcatacaatatgtggtcttttgtgactggcttctttacttaacacaatgcttttaagcatatggttgatttatatggtggcagtggcagtacttcatttttcttgtaaatttatgttatgttcaggggtatatgtgcaggtttgttacataggtaaacttgtgtcacaggggtttgttatacacattataatacatcatccaggtattaagcctactacccattagttgtttttcctgatcctctccctcttcccaccctctgccctccaatagaccccactgtgagttgttcccctccacgtgtccatgcgttctcatcatttagctccattgtggaagacagtgtggcaattcctcaaagacctaaagacagaaataccatttgacccaggaatcccattactgggtatatactcaaaggaatataaatcattctaccataaagacacatgcatgcatatgctcattgcaacactattcacaatagcaaagtaaggcatcaacctaaatgcccatcaaccctagactggataaagaaactatggtacatatacaccatgaaatactattcagccaaaaaaaggaacaacatcatgtcctttgcagggacatggatggagttggaggccgttatcattagcaaactaacacatgaacagaaaaccaaatactgcaagagtctttttagagcagtcattttcccaaaccgtgctcagaggaacatctcaactgtgactatcagaggtggggactgaatgaacctccactcaaattaattcaacctgaagaacagcacttttatctgccttacttataagtattacacgtaagctttcattggaacaaaaatttttgcagttaaacattgaattcgaaaactcatgagcaggggaattcacaccagttgaaacagatcaaaatcctcagggtgaaattggaacaggctcaggcaaaatgtattcttatattttagaatttatattctttatttttagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacgtaagtttttttgcccagttttctctttacttattgccctaaatttgacctttaaggctttaagaaaaacattgttttcctctgtgtaaggtagcattaaaagtctttctatagaaataaatgaattcaaagataaataaataaattcattaaaaagcaacatacctttaattgattactagataaaaataaattaggaatgactttgtacaagaaaggaaagaaagaggggaaataaattttataactaaggaggttgctgttctgaggcagagaaagatttagaacttcatgttccttggataccatattgttttcaatcctcctggacatagagaaagactgagctgagtccagaatagctgatttcatgtcagaaacctgatgaaaaagagaatagcacaaatatgactagaattaacttagctcagaggcaagcagatagctgcctgacccaaccttcaataacgatttattgagtgctcacctgtatcaaaccatattttacacactggacagtgaagaaaaagaaagccgaagtccctgataccatggagattacagtttaatagtggtgggagtgcatgggaatgcaggccattatgactgactaagacaaattcttaacctgaaagtttggttggttgctctgtttgtttttaaggtttttgttctgttcctactcttagaagttctaatttagtaagtttgaggcagggtcagagcacctacaatttgtaatgtgtccacagttgggattgggaatcattgatctaaagcaaccagaaacatgatttcgtaaacagtgatactcaaaaccagaactgaatgtacaagagaaaagtgaataataattttgaatgcctaccaagggaccagtgtcatatatgttagtttacataatctcatttattattgttgtggcaaactaatatcaaaaggaccaagatttaaataaaagaaaaattacaatgtctttccttaaagacaaggacaacagtcaccccactgtgctgctgctgccaccagcacacgtaaacaccactgcatcgctgccaccagccattgccccagcaaagtgctttggccagcactctccatcagactgttgttaccagaagaccaggaacaccttcgcccctccagtgcagcaggtgcttgtccttgaggagacagaaaacaaagtaatgggcctggtaccaggccccagggttaggacatgcaatccaggaatgccaagttaagccttggccccctgaaatcttccagaaatgaagccagttgactttgactgaacccaatatataccacagtcaaatcctcaaagcctcaaaggcatgaaagaatataaaagcaaaaaaacactattcgaacaacagcaacttaaaagattaaaggaacattagcccatgcagatgagaaagaaccagcatgagaactctggcaactcaaaaagccagagtgtcttactacctccaaacaaccacactagctacccagcaatagttcttaaccaggcagatgtggctgaaatgacagataaagaatttggcatctggataggaaaaaagatgaaaattcaggagaaagtcaaaagccaatccaaggaacccaaggaatctaatgatacaagggctaaaagacaaaatagccattttaagaaagaatcaaagtggtctgatggagctgcaaaactcactataagaatttcctaatataatcagcagtcttagtatccaagctaagttttataagcataggagaaattatatccttttcagacaagcaaatgctaaggaaatttgttaccctagacctgcctctcaagatgtccctaagggagtgctaaacatgaaaatgaaagatcaatacctgccaacacaaaaatacgcttaagtatatcaactataggcactataaagtaactacacaatcaagtctgcataacaaccagctaaagacgcaacaacaggataaaatcgcacatatcaatatcaaccttgaatataaatggactaaatgtcccacttaaaaggcaggaagctgtctttaagagactcatctcacatgcaatgacacccatagtctcaaagtaaagggatggagaaaaatctacctaaaaaatggaaaacaaaaaagagcaggggttgctattgtaacttcagacaaaataggcttttaacaaacaatgatccaaaaaaacccaatatcattatataatgataaagggttcaattcaacaagacttagctatcctacacatatatccacctaacactggagtatctggatttataaagcaatttcttagagacctatgaaaagacatagataaatacacaataatatcaccatcccactgagacagatcactgaggcagaaaactaacaaagatattcaggacctaaactctacacttgaccaaaaggatctaacagacatctacaggatactcaacccaacaaaaacagaatatacattctcctcatctgcacttggcacacactctaaaatcaatcacacaatcagccacaaaacaattgtcaatgaattcaaaaaatttgaaatcataccaaccatactctcaaacaacagtacaataaaattagaaattaatactaagatgatctctcaaaactatacaattacatggaaattaagcattctgctcctgaatgacttttgacaatgaatttaagacagaaatcaagtaatcctttgaaaattgtaaaagaaaaggtataacataccagaatctctgggacatagctaaagcagtgttaagaaaaaagtatatagtgctcaacatccagatcaaaaagttagaaattatcaatttaacaacctagaaaagctaggaaaacaagagtaaatcataaaccaaccgaaaagccagcagaagaaaaatcaccagaatcagttgaactgaatcaaattgagagatgagaaaccatacaaaagatcagtgaaacagagtttgttttttgaaagcataaataagattggtagaccactagctagactaataagggaaaaagtgagaagattcaaataaacacaatcagaaatgacaaagtgagcattaccaccgaccccacagaaatccagataaccctcagagactattacagagacctctatgcacacaaactggaaaacctaaaagaaatgaataaattcccagaaacatacaaactaccaagattgaaccaggaagaaattgaaaccctgaacagaccaataatgagttctgaaatggaatcagtaataataaaagcctaccaaccagaaaaggccctggagcagatggattcacagccaaattttatgagatgcgtaaaaaagagctagtaccaatcctattgaaactattccaaaaattgaggaggaggtactactccacaactcattcaatgaggccagcatcattctgatactaaaagctggcaaagacacaacaaaaaaggaaaacttcaggtcaatatcttgatgaacatagatgcaaaaaccctcaacaaaatactaacagatcaaaccaagcagcatatcaaaaagctatctcaggattatcatgtaggatttattcctaggatgcaaggtggtttaacagatgcaaatcaataaatgtgattcaccatataaacagaactaaatacaaaacccacatgatcatctcaatagatgcagaaaaggctttcaataaaattcaacatcgcctcatgttaaaaaccctcaacaaactaggcattaagggaacacacttcaaaataataagaaccatctatgacaaacccacaaccaacatcatactgaatgggcaaaagctggaagcattccccttgagaaccagaacaagacaaggatgctcactctcactactcctattcaacatagtactagaagtcctaaccaaagcaatcaggcaagagaaataaataaaaggcatccaaataggaagagagaaagtcaatctctgttcacatatgatgtgatcgtatacatacaaaaccctatagtctctgcccaaaagattctagatctgataaacaactttagcaaagtttcaggatacaaaattaatatacaaaaatcagtagtatttctatgcaccaacagcatccaaactgagagccaaatcgagaacacagttccattcacaatagccacatacacacatacaagaaaatccctagaaatacagctaatgagagaggtgaaagatctctagaacaagaattacaaaatattgctgaaagaaatcagagatgacacaaacaaatggaaaaatattccatgctcatggataggaagactcaatattgttaaaatggctatactaccaaagcaacttacagtttgaatcctattcctatcaaactaccagcaatatttttcacagaattagaaaaaaaaaatttcaaaattcatttagaaccaaaaaagagtctgaatagtcaaagtaatcctaagcaaaaagaacaaagccagaggcctcacaggacctgacttcaaactataccataaagctacagtaatcaaaacagcatggtactggtacaaaaacagacacatagaccaatgaaacagattagagaacccagaaataaagccacacacctacaaccatctgatcttcaacaaagtcaacaaaaacaagcaggaagggaaagaacttcctagtcaacaaatggtgttgttagaataactggctagccatatgcagaagattaaaactggaccctttcctttcactgtatacaaaaatcaactcaagatggattaaagatttaaatgtaaaacctaaaactataaaaccctagaagaaacctaggaaaaaccattctggacataggccctggcagtttttatgatgaagattccaaaagcaattgcaacaaaaactaaaaacaaaaaataggactaattaaagagcttctacagagcaaaagaaactattgtcagagtaaacagacatcttacagaataggagaaaatatttgcaaactatgtatctgacaatggtctaatatccagactctataaggagcttaaatacattaacaagcaaaaaaaaaaaaaaaaaaaaaaaaaaaaaaacccattaaaaatgagcaaagcatatgagtagacacttctcaaaagaagacatacaagcagctaacaagcataaagaaaaatgctgaacgtcactaatcattgaagaaatgaaaatcaaagccacaatgagataccatctcacaccaatcaggatgactattagtaaaaagttaaaaaataacagatcctgatgaggttgtgtagaaaagggaatgcttatacactgctggtaggaatgtaagttaattcatccactgtggaaaacagcttggagagttctcaactaacttaaaacagaacctccattcaacccagcaattccattactgggcatatatccaaagaatataaattgttctaccgtaaagacacatgcatgcgtatgttcattgcagcactgttcacaatagcaaagacaaggaatcaacctaaatagcccatcaatggtagactggataaagaaaatgtggtacatatacatcatggaatactacacagccataaaaatgaatgagatcatgacctctgcggcaacatggatggaactggaggccattatcctttgtgaactaacacgggaacaggaaaccaaatactgcatgttctcacttataagtgagagctaaacactgagtacaaataggcacaaagaagggaacaatagacactagagcctacttaagagtggagggcgggaggagggtgagaatcaaaaactacgtattgggtactatacttgttacctgggtgacaaaataatctgtacaccaaacacccacagcatgcaattttcccatgtaacaaatttgcacacgtgccttctgaatttaaataagagttggaaaggaaaaaaaagttggatattcttccaggtaattaaacttatttagtgcatttctttttctttccatctaaattttcccacagtcataattataaaatatttaaataggtaaggataaaaaagaaataactcataggaaaatatcttctgtatactatgacttctgttttaattccatttacctttggttgccttcttactacataagtctaatgttgttatttatttaatgtcaatatttggtaggaaaattaagccttatgttttgttctctgtggggaaatatctagaagataggtatataggtaagtagataataggatgtaggtagggaagtaggtgcagaagaaaagcagaagaaaggagagaggaaagggaagaagtaaagaaagagagaaggagaattacttttcctcatttctttagttagttaatgtagactttcacttttacaacataattttctatacattctctggacatttttatcttagtatacgactcttttctatggacaacacagaaatggatcactataaacaccccaacattggttgtgaatgtgatggtgatgaatagcaggcccaagcgatcccaattcacttcaacctctcactggaatgccttctgttttttagaagtccaatcagtagtttggagaagtattatttattattagcaaaactatttgctttctatgtcctgtggccaaggttgtggaacataacagaaagttttaagtaatcttggtacttccaactattagctgagtgactttgaatccatttcaccatctataaaacggggctaatagataaaatgggttgactcttattttcagtacattttgattcttatttttactcagtcttactaaagtataattagaaaattatgtcaccatatgtgtcatatcttttaattattggtggaaagagataacgtataaagttaggaaataatctatgagctttaagcatttgtaaaagacatttaaaacttttgaaagaaatatgtcatggagaattgcagaaatcctcagggctaattcagaatgcataacttaaaagccactgcataggggagatgcttaaaagccagatattgattctgttttcaaggagctaatagtttaggaggagaaataagaaaggaatacaaataaacgtaagatgtaaagtgataatgagtacaatatttatttctacttcaaagaatgaataaaaatttgatttggattgggtatttaaaggtggataaagtttagatatatgaaaatgagggacaggcattccaaggggagggaaaacaactaggtaaattttcatgaaaatgcgattaattatatgacaggaaatctttattgccaaccaatacacatggcatttgaaaattgtctgattaattagttttgtattcagccaatctagatagctcaggttctaaaatatatgcttttcagcttacattatcaagttgattaattcagactgaattaaagaggcatttgctagtttgccattattttctattatttaaaataaacaatagaggtttgaaagtcttcaaggtggtttgagaaaattcccttagaaatcatgttatattgcgaatgtataagctctttttgtctttgtgcagcctctctaaataaaacatcttccttctttatgttgcactttctccactaagaccttaccccttcacaaattgaggtgtaaactgcatttttaactaaaagaaatcctacgagctgcgcacgtgacaatgattttattcctatttttttagttccggtctaagcagggttagtcagcatgccaagtatgtgagctgaccgtaaacacaagattaattcttagacttggatctttggaaagtggaaattgtacatctgcagcaaaattggcagagttgttgtgtctccaatcataccaggaatttttctgtggatagcctttgttattctgccatgacacatctgctgttttgtaccctatgtccatgccaaatactcaccagcaagctaaaaatggtacccctgaaaaacagttttcaaattacaggagccggagttccacatacatgcctcaggggtccccaaccttcctctttatccagagaaggttgctttcacatatttttatatattgggcttttacatacacagtgttaggataaatactttaacataaaaatgtgtcttgaaaatctctgtatatgcctctcacatgtcacatgcctttcaatgttatccactgtaattatataaatacaattatgtatatctttaaatattaaaaacagccaaatgtgtctgtcatgactagagcccaggttataatttccgagtccaaaagcatacagagtagcattatagggagtcaatgaggctgccctgaaatatatgacccatctttggctctctgtgaaacaggtttaattcacttagagactcaaagaggccagggtcatatgatagtatatttaatagatacttaggcagcactgtgtcttcaaataggctggaacatcctgcataagcacattcatcagaggtagtatgggacattggaagacaggctggatttagaagagtcaaactttgaatctaacttactagcttcacttccgtggacaagtacccaagcctctgtgcctgtttttgagttgtaatatgggtatactagtaaatgagaaatatatacagaagaagtttctaaagaatagcttgtataggtattatacaaatgctagataatgttacatcattatgtcaccatgagaagaatttgtaaggaataccttacacctattaaaataggtaaatttttattcttgattgaaattatatacacctttgccatgttgttatgttggtccagtgcccagtagtgctgaaaatgtatttccttggtgttcctagaccatgaacattggcgtatactaaatacacatcggggtgagggtgaaaatcgtgtgctttgggagactgactccactgtggagaatggtctgccttctgctgctgtaacatgggtgaaaaatatgggttccgttgtccttttctcaactgtcatgccaaacctaggtgaccgatatcagaaattgctctaggtttaataagtcttaaatatgaataaaaagggatcatttgcctttaaagatattttactttgtgtgctttaaaagttatttttcattgttttcaaagaacttatttatttctgccttgatttcgttatttacccaggagtcatttaggagcaggttgttcagcttccatgtagtcatgcggttttgagtgagtttcttaatcctgagttctaatttgattgcactgtggtctgagagactctttgttatgatttctgttcttttgcacttgctgaggagtgttttacttccaattatgtggtcaattttagaataagtgcaatgtggtgctgagaagaatgtatattctgttgatatgtggtggagagttctgtagaagtctattaggtccacttggtccagagctgagttcaagtccggaatatccttgttaattttctgtctcattgatctgtctaatattgacagtagggtgttaaagtctcccactattattgtatgggagactaagtctctttgtaggtctctaagaacttgctttatgaatctgggtgctcctgtattgcgtgcatatatatttatattagttagctcttcttgttgcattgatccctttaccattttgtaatccccttctttgtctttttcgatctttgttggtttaaagtctgttttatcagagactaggtttgcaacccttgctttttttgcttttgatgtgcttggttaatattcctccattcctttattttgagcctatgtgtgtcttagcacatgagatgggtctcctgaatacagcacactgatgggtcttgactctttatccagtttaccagtctgtgtcttttaattggggtatttagtccatttacatttaagattaatattgttatgtgtgaatttggtcctgtcgctatgatgctacctggttattttgcccattagttgatgcagtttcttcatagtgtcaatggtctttagaatttggcatgtttttgcagtggctgataccaggttttcctttccacatttactggttcctttgggagctcttgtaaggcagacctggtggtgacaaaatatctcagcatttgcttgtctgtaaaggattttatgtctccttcactaacgaagacacaacataccagaatctctgggacacagctaaagcagtgttgagagggaaatttatagcactaaatgcccacaggaaaaagagggaaagatctaaaatcaacacactaacatcaaaattaaaagaactagagaagcaagaaaaacaaattcaaaagctaggagaaaagaagtaactaagatcagagcagaactgaaggagatagagaaatgaaaaacccttcaaaaaatcagtgaatctaggagctggttttttgaaaagattaataaaaattgatagactactagcaagactaataaagaaaaaaagagagaagaatcaaatagatacaataaaaaatgataaaggtgatatcaccactgatcccacagaaatacaaactaccttctgagaatactataaacacctgtatgcaaataaactagaaaatctagaacaaatggataaattcctggacacatataccctccccagacaaacccaggaagaagtcaaatccctgaatagaccaataacaagttctgaaactgaggcagtaattaataatgtaccaaccaaaaaaagcccaggaccagatagattcacagccgaattctaccagaggtacaaagaggagctgatactattccttctgaaactattccaaacaatagaaaaagagggactcatccttaactgattttatgaagccagcatcatcctgataacaaaacctggcagagatacaacaaaaaaagagaatttcaggccaatatccctgatgaacatcgatgcaaaaatcctcaataaaatactggaaaaccaaatccagcagcacatcaaaaagcttatctaccatgatcaaatcggattcaccccaggatccaaggctggttcaacatacacaaatcagtaaatgtaatccatcacataaacagaaccagcaacttaaaacacatgattatctcaatggatgcagaaaaggcctttgataaaattcaacagcccttgatgctaaaaaaactctcaataaaataggtattgatggaacgtatctcaaaataataagagctatttatgacaaacccacagccaatatcatactgaatgggcaaaagctggaagcattcccttcgaaaaccagcacaagacaaggatgccctctctcaccactcctgtttaacatagtattggaagttctggccagggcaatgaggcaagagaaagaaataaaggatattcaaataggaaaagaggaagtcaaattgtctctgtttgcagatgacatgattgtatatttggaaaaccccatcgcctcagcccaaaatctcctgaagctgataagaaccttaagcaaagtctcaggatacaaaatcaatgtgcaaaaatcactagcattcctatacaccaataatagaaaaacagagagccaaatcatgagtgaactcccattcacaattgctacaaagagaataaaataccaaggaatacaacttacaagggaagtgaaggacctctccaaggagaactacaaaccactactcaaggaaataagagaggacacaaacaaatggaaataaatttcatgttcatggataggaagaatcaatattgtgaaaatggccatactgcccaaagtaatttatcaattcaatgctatccccatcaagctaccattaactttcttcacataattggaaaaaactactttaactttcatatggaatcaaaaaagagcctgtatagccaagacaatcctaagcaaaaagaacacagctggaggcatcatgctacctgacttcaaactaaactgcaaggctacagtaaccaaaacagcatggtactggtaccagaacagatatatagaccaatggaacagaacagtggactcagaaataacaccacacatccacaaccacctgatattgaacaaacctgacaaaaacaagcaatggggaaacgattccctatttaacaaatgatgttgggaaaactggctagccatatgcagaaaactgaaagtggaccccttccttacaccttatacaaaaattaactcaaggtggactaaagacttaaacctaagacctaaaaccataacatccctagaagaaaacctaggcaataccatttaggacatagacatgggcaaaaacttcatgactaaaacaccaaaaccaatggcaacaaaagccgaaactgacaaatgggatctaattaaactaaagagcttctgcacagcaaaagaaaccatcatcagagtgaacaggcaatctacagaatgggagaaaatgtttgcaatatatccatctgggctaatatcctacaaggaacttaaatcttagtctacttaatctataaggaacttaaacaaatttacaagaaaaaaatatcaaaaagtggacaaggatatgaacagacacttctcaaaagaagacatttatgcggctaacaaacatgaaaaaaagctcattattactggtcattattactggtcatttgcattagaaatgcaaatcaaaaccacagtgagataccatctcacgccagttagagtgatcactaaaaagtcaggaaatcacggatgctggagagaatgtggagaaataggaacacttttaaactgttggtgggagtgtaaattagttcgaccattttgaaagacagtgtggcgattcctcaaggatctagaactagaaataccatttgacccagcaatcccattactgactatatacccaaaggattataaatcattcttctgtaaagacacatgcacacataagtttattgcagcactattgacaatatcaaaacttggaaccaacccaaatgtccatcaatgatagactggataaagaaaatgtggcacatatacaccatggaataccatgcagccatgaaaagggatgagttcatgtcctttgcagggacatggatgaagctggaaaccatcattctcagcaaactaacacaggaacagaaaatgaaacaccgcatgttctcactcataagtgggagttgaacaatgagaacacgtggacacagggaggggaacatcacacaccagggcctgtcgccgggtggagggctgggtgagggatagcattaggagaaatacctaatgtagatgtcggcttgatgggtgcatcaaaccaccatggcatgtgtatacctatgtaacaaacctgcacattctgcacacgtatcccaaaacttaaagtataatgggaaaaaagttatttatctttccaaagcctgttgatttagaaaacaacgtaagaaaagaagtatgctgatttcattttccatcaaatatagagaattatctaatgtacagaatcatgaaatagttttttgagattatacattttgtataataatttagtaaatggaatttagcatttgaaaatcgtaaaggcctaaattgataccttgatctgaaatttaaaagtgaatatatatatatatttttttttcagattaagtctctcagcaaaaatctgtgagaaaacagtcctaaagcgagttttaaaagagttatggaagctagttctcaacaaaatagaaaaacaaattgttcttcctcctctgacagatcaaacagtaagtatataaagtttagttatgctttcattaacccatctgtttttggtttaagtgaatggttttcatccagatgaaatactaattaaatccctttggggaaaaagtgtttggtatccagtttcttaacaatgatcattcaaatgatagtttcctatccaagtcaattttaaataatggcaatagcagtcagacttcacgttgcttgacagtcagaacttaacctcttaaaacatgtatcaaagttctatttatagtgttatctggtttacacatacaatttttatttaattttaccgacctcaagaaaatagaattaagatacaatgtatccctgtgcttctttcttaaattttacagtttaaggagatagttacaccactgctatttggatttttttttcacctttctattatgctttcatctcttacctccccacttggaagttaatagaggaggcatcttttagtgaatctgaaaaatgtgattgtatcacacaaagaaaaaggaaaagaaccagaaagatcaattggctgcaaaattagacactggtcaagtggatacacagagccaggtatctctgttcacatatcctgagccaaacaagggaaaaataacactaacaagcacctgttacggggcaatgtatttttttctccgtgactgaggaagataaattgatgcaaataatgagtaagtataaatggaaataaaatatgcattattatacattagttatacacactcagtccatgtttattcagtgaaagcatatgcctagaaaacactttcttataaagtgttccgagatgcaaatatgcctgtgtttttgttgatttactgccagacagtgagtgataaaatataaattactttgagtttcgcttaatgccatgaatgtgtgctttaatcattttatagcctacatatatataggttctaagtcacatttataaatacacacacacatacacattctacttcaatacataatatatttccataacaccagttagcactcatgtagttgttcaatagaggaatgtcagtataatctggaagttgggttggtttatatataaatttccctaggtcagaggctctcgaatgtaatagaaaaactataacttcagccgaaaaagaaaaagctctcaccttggctacttcacagacctgttttaaaaaggaaaaaagaggagagtaactgtacatcatgggttccctctctggaaaactgaagcttgcatgactgtcacagattgcaggctaccttttcccgtctgctggtagctccacttgcgtgagcattgtctcagcccacttttgaactcttgttttgttgttgttgttttgtttcttttgcttttttttttttttttttttttttttttttggagacagaatctcgctctttcgcccaggctggagtgcagtggcgcgatctcggctcactgcaagctccacctcccaggttcacgccattctcctgcctcagcctcccaagtagctgggactacaggcgcctgccaccatgcccggctaatttttttgtatttttagtagagacggggtttcaccgtgttagccaggatattttgcatttttaatattccttgaggcaaccattagcttcactgagttccctgctagctgtccaagccatatcccaaagtagcagttatggttttgattgttcttcaaagtagcaattatggttttgattgttctttagtaacagaattgcaagggcttggactgttctgcccattgctgtttttcccataagccctattatttttagtgtgcaattttgtagaatgtgaggtttttcaagaatgtatatattatgttacagtagaaatgctatctatgacatttcattttctgtataaggttttccctaggaaagcttaccatcacctaaaatttctctagcattgagatatccaagtatgaatacatatcatttattcattcattaaataaatattctttgagctcctactatgtactaggcactgtgctaggtgacggggcaaaatatgagcaaaattaaccacggtcactattctcaaacttatagtctttaattctccaataaaatacacactccgataaaacatctagataacatttgttcagaatagctaattttccttcctgtgacaatatttcaagctctaatgaacttggccaaatttagtacttttccagtcacatacaccaacagacatgcctctagtttttcattctagtaaagcattggatagtttattccagtgtttttcaaattcatttccccagggccttggggttctagagaaagcctctggctgagggaggggttaagagggtagtcgctaatagactggacagcattttagaaggagcaattccaccttctttagccccgtatcttcagattttgcatacatttatttttgcagggagtagaatgaggaagttgcctctgctaaaaataaatgaataaaagttaaagatcactgatttaatccatatactacattaaactggctacattagtagcaacctagtcattaacctaaacttaagactttgaaaagtgggacacctatgaggactgttatactgccagcggtactagatatatttgacccaatctttataatagaccaattaagggcatctggcataagccataagtcttataagggaaataaagaaattatctgttgactgcatttctattgtgactaatactgaatatcttaagactgagtcttctctcactttttctttgtttctagggaccccagatgattttcattgcagctaaagatcttggacaattatccaaactgaaggtaataaaaataaggaaattacttattcatggaaagtagtgagttaactacagttctgcaagcatcctcctcctagtaatagtatctagcatggcaggattaagaagatgtgtgtgtgatttcacaatctgctttaggaatttttaactttgtattgcagcatttagcattattgcttctggattaaattagagagcatattttctttcatatattaaactggcttgatgtgaacaaagacaaaatggaacactgcatagaaatccagtgaagtctagagaagtcttcaaaccaagaaacacagtacgggaaaatgaaactcatcaaagcaggcactgaacttgtcaacatgttcaataccattacaagtgggagatgttctgactaaatgaccttgtgcttagttataatttgagattcccaaaacactggatttaggcaggaaacttcagtccctgttcctctagcataggaacttgactggctaaaatacatgctatttttattccatttctacctactagaatgtagttaagggatgagttccagacacaggtaaccttgtttcaaattcttcctcaaatgcttcctactatgtgacatgggccaaagtatttaacctccctaatcttcagatgtggctcttgtaaaatgcaaaaaaagaataatatcagttataaggattgttgtgagtgtaaatgagacaagacatacattatctttgcttggtaactgcaaagtgtatgtcacctcccacttgcagttggagctatcttcattcctcccccagctggtagctcaaagttaggtgccattgagtattggattgtttcatatgtacagcacaggggaaaaacaaaatgtataattatttactgaggtaaaatatgtgccttataatttcagtattctattttatcatccacattatcccattcctaacacaaaaattaaaaccagtaatccatctggaagatataactatcacctaaaattgtcacccacacatgttcagtgctgttgatggttggaaggaaagataaaaggtagatgtcactgccaaactattattttgaatcttggatctttatccctttctgtatcccttttattacctccctgggatttctggagcctactttgaaaagtggatttatacactgcggaagtttctcacataaaaccatgaaggtgaaataacataggtcttactacaaaagaaatggccctggccatgcatctaatatctgtgtgatgttagtaagcacactgcatctccccaggcttcagtttcctgagttgagtgttctatcagctagaactatttcattttcaagtgatggaaagccaaacataagcaaacagggaatttactgctacatgaaattttatagtccaggggtaactctggtttctgttactgcttgattagggattcaaacaattttacaggacccagatactcactgcctctcaactctgcccttctccttgtttgatacgttgccataacagaccttcatttctgtgtgtaagttggttgtctctgctctcacatcctttgatgttacatcttttgaacttcaaatcttgtagagaaaaacacccatctcagtgcaaggaatcacagcaaagtctcctggaatatcagtagctctgaggaagtatgatcaccattcccaaaccagtcaccatggtctgagaagtgacatgtgccaattggcttaactgacatactcaccctgaggtttgggtacaacccaatccaaatcctatgaactctgatcgagatagagactggttccctagagggtatatacatgctctgtgggaaaaatcagggtccacagaaaacataacactttagcatgctttgtggtcccattattttctcaattcactgaattcttttttaattctaataacctaaaagcacactataaatacaatgacctaacaggattatttcaacaacactgaaataacatgaaggactaaagatagtctttgtgtctattgatgatgagaaaaataacttcgttctgtatcatattccattattggcttttgagttttttatttttaaattatcagtccatttagttattactatttgaattacagagcaataaatctcctacagtattatgcaaaaacctgaaactccagctggcatgaagaacttcaaattgtataaaactatttcctcttattttattagaatgtcactcccatttaaaaaaaatgttaaactatgggtctttaaatttttaatatattaatttgaaagcagatatgatgtgctgaaaaggtgctatttgaaataattgtactgatagaaaatttcagaactcctatttaggagtattgatagataactgcctaaaggaacacaagatcaagaaaaatgaaacaatgtggggaactaattggttttctgtgtttggctatgatttgggattattccattaaacatgtatttattcaacaatttgacattttctattacttcataatctggaatttcattaggtgtaatatatattatatataattatattatatattacaatatataatataaaattatgtattatatataattatattgtacaatatataatgtaatatataattatatattatatacaattatattatatattacaatgtatattatatattacagcatataatataatatataattatataattatatattacaatatataatataattatatattacaatatataatataattatatattacaatatataatataattatatattatattatatataattatatattatatattatatataataatataattatatattatattgtatataattatatattatatataattatattatattgtacaatatataatatataattatataattatattatatattgtacaatataatataattatataattatattatattgtactatataatataattatataattatatattatatataattatattatattgtacaatatataatataatatatattatatagtacaatatataatatatagtacaatatataatataatatataatatattatatagtacaatataatataatatataattatattatatagtacaatatataatatatattaatatataatatatattgtattctatattactatatatatattaatatataatatatattgtattctatattacattatataatatatattgtattctatattacaatatatattatatattgtattctatattacaatatataatatatattgtattctatattacaatatataatatatattgtattctatattacaatatataatatatattgtattctatattacaatatataatatatattgtattctatattacaatatataatatatagtattctatattacaatatatattatatactgtattctatattacaatatatattatatactgtattctatattacaatatatattatatattgtattctatattacaatatatattatatattgtattctatattacaatatagaatattatatattgtattctatattacaatatagaatattatatataatatataattgaatatattgtaatatataatataatatataattatattatattatgtattagtatattatattatatattgtaatatataatattatatataatatataatataattataatatataatatatattacagaaaacatttataatgtgtattacatataatatatattaaatatatgctatatataacatatatttgcctcaaaatatttcatataatcagatttatttgacataaaaaaatgcataaatcttcaggaactggtgatataatattaaaaccaattgatgaaaatacacctgagactctgagtttactgcatgctttttacttgggcaataactcattgctggcctctttcagagatccccttacttgaatgatctgttgctaaattctaaaaaattatttctagtaagaattatatttctagcaccagcgtatatcacttattagcatctgttagaaaataatgtgaccacattgttaaaccagtcaagattgatgaagccagataaatttatttaatagaaaatatttttaattacttgtctgaaagcattttcccctataattcagcaaacatttctattactctttgagtctcaatgggtatataatattgctatttaaaaactgtgaaatgaactcatatgattaacttgaaatccccgtatcagagaaagattcagtaagatgtataaatatatatcatggatccatgaaacattataccatgttgttagcagtatccaaagacaatgattctattggagcatataaaatctgtgacacacattgaaggaagtacaatccaattaccaaaaatttactgagtgcctagcagataacaactgccaaaatagacacggaaaagctgaaggagtgagcgagacatagatagattattatcttcaggaagtcgtggcaactaccaaataaaacagtaagataaaggccaaaatagaaggacaagccactgggtgtgattgcgtggtttgtgcattatgcaaaaatgcatacctaaaggagcaagtgacagccaaaattgagcccatgttccacttgccaagccgtatgtgttaacttgaagctgtcctcttataaaaaataagacaccttttattatttaccaaaggcactgctttactcttcattccatacctgctcagagctatgttcccccacgtgggacttttcttctaattcacaaagtcacctacataagtttaagctccagaaggacaaacgttttccctgtattaaacaatatatctcattctctgcgaacagtgctggcacaaaataaacactcaataaatatttgttgagtgttgtcgaatagaataatggcagccctgggatgattgtatcagttttgggggatcagacatttttaaatttttcccttagtttttatttcctttattattttctttttctgccatcatttccctaaataagctttgtatgatgggttgaaacagaccacagtgaacaacgaagaaattccattgtaaaataatgaaataagttttaaaatcagttctaaaatacttaaaatgattataaaatatttaaaatattcacagccaaatttagttaattccttggggcttttcccaggaatgagtaagaattgagggcatctaagaagaagaataaagtggaggcattatatttaaaatagactttatcagtaataattgggagaggcttaaatttgctccttaaatccttttcatgattgatagtcctcaacgtgacagacataaaccaaggaagtcaggtgacaaaatttcatcacgcattttccaggtttctctcttttttccctaacattagtttgcaagtgaaaataaagccacacctctatcaaagcacttctttttaagtaaatattgaacatttcttcctttgacagagaggagatttataaaatatatgacaatcattttattttaaatgcattcaggtgcagaagatatttcaaataggaagtttggcatatggggataatacagattatgttttcaagtagttgttgaatacatgaactggttgttttataagcaattcttcacctgttttccaggagcacatgattcgagaggatgccaggggtctgacgccaagacaatgcgctataatggaggtagtcctggctaccatcaaggtgagattataatgctcctatatatacatcgagagaggcccccatttacctccagagataggtagccctgatcttagccatgtatcagtagagctgcgccattcaaagagatagtagatagttgaatagatataggttggtgcaatagtaattgtggtttttgccattaatactattgcaccaacctaatacattcctggaggatgccagatttacccctgtctatctccttatgacatccacaatagactgtccttatacttgcttcttttgtctctctctaaagcataagtgaaacctatgttttaacacatgttctcaaagacatgtaccctaaaacccagataaacagatgctttgagaatattttgggtagacagaatttgtttttatatgttttctatgcatgttgaaattatttttaaaatatcaaccctcccttctcgcttagtaagtacaataatttcatttcattttctgctgaatacccaaagatgtcgtttgtacgcatcagctgttttcatagccaaagattaaaagttattgtagtgtatgctaaatatgtgcagatctcaaaatgtaacctagaagttattttcaaataatttcttttatatttatatccatatatatttatatgtgaaagtttattaaagagtttgaaagatgagtttgtcttctaaattcaaatgatgtccaaagtttttactcttcactgggggaaacatctactatccaagatatgtgaatagcatagctactaactatactgtaactgttagctaccatgacccatttgtagagcatagaacagttctactggatagaaacaatggtattcatttcaacagagttctatctgaataacagtcacatactttcacaaaactgtcacctcgtggcttttgttttgcagtttcagcatttaatatgaggcagtcttttgctgctgcagtggtaaaaactgccacattaaagttgggaggtgagagttttgtgacacctggaggcacctggatcacagaaatggagtttctaaagaggtagccaaaatgttgtctggaaatatggaaaatttgcaaaataatttttaggaaaaaatgaacaacatgaaaaagaaatacaataaaaaactttaaaagtttttttaaattattttcaaaaatttgaggaagaaataactaatctttggagttatagtagcactaatagctttataaaaggacatgctagtagaaaaaaaataagctctagcatgcaccatgaagaggaagaaaagaaaaaaatttggcatctgaattcaactcttcatgcattttattaggtcaatgcatggctttaggaaaggaaggaaaatgtgtcctgtggaaatagggaatggtattcactgtgttcacagatctggcttctgtctctaacttcaacatttctctaatttttattgatggggccagatgatcaccacctgctggctgagttcttctcagagtctaagataatgttgatcctcaagcaaattccttttatcttgacagctcaactatcctatcttcctgtttatatcatctatactaatattttaattcagtctcagacaccagacaccggccttgttctttgtggacaaaactactatttggtgtcctaggtccagtaaatgggtccatgccatttgtcttgtttctccaggactggagtctgactctggtcctcctgagccccaaagcgtgtgtcagttctccagttcccctcttccctaacttctgtgatgccaactctttctctaggcacctccatgctaggcctgctgtgcctgctattagactctcttgaccctgtgccctgcccatctgccaaggtattcacctgatatctgattttcaatgactgtcatcagtttgccaaagctgagactccctttatcttgtctgtctgtgagatttgcaccaacttactgtcctaccaaacattaattgtgagattgactacaaaggaattcaagagaaggaagagtacaacttaaaagagttttaactccaagaactaaagattcaatgtctccccggagcccagccaaaggagcactataatgcaagcagagaccttatgagaaagatgaccttagaccaaaggagcagacgctacccatgctaatttccaacggctgctaaagagataatctttaattcctcttcagctcaatttaattgaataagctagaaatgagaaaacaaagaaggaaaatgctatgaagtttttagaatataggctgaaataatgttttacattttcaaatttctcttatgtacgtgcatcatttcacctgccttgtaaatatcctgggtgttagataggtcaagaatgattaagaaaatgtggcacatatacaccatggaatactatgcagccataaaaaatgatgagttcatgtcctttgtagggacatggatgaaattggaaatcatcattctcagtaaactatcgcaagaacgaaaaaccaaacaccacatattctcactcacaggtgggaattgaataatgagaacacatggacacaagaaggggaacatcacgctctggggactgttgtggggtggggagaggtgggagggatagcattgggagatatacctaatgctagatgacgagttagtgggtgcagcacaccagcatgtcacatgtatacatatgtaactaacctgcacattgtgcacatgtaccctaaaacttaaagtataataataaaaaaagaatgattattcacctttgataatagagaaaattaaaagtgaagagatttcagttgtttttccgaggccatagctctgctagtaattggcagagctgagaaaggactccaaattctaaagccagtgtccttgcttctatgtcacattttttcaatcagtatgtacgaagtttaagtaaaatgtagcaggctaaaagggatacttcttcaaagagattacttcttgctatattaaaataccacgtcaattacttagattattttctaattattttaaaataatgtaaaacctttcagcctctatacaatattgatgaaaatattaacttttctaaatattaaaactttaattggactggaactattttataacaccagtcacatgtagcttctattataagtcaagagtgtcaaatatggcaggagtaacaaaaattatgatcatctgctgcaggtaggatggttgggctttgagacattccatttacccggaaaagcaaccaaatcaacaatgtttgaaagtaaaagtagaaaagtggcagctatgagacagataatcagtcacccaatctatatgtgcaaactaatagggaggccaatagggaaactttaaaggcgttctagctggactttgagttccaaccccatatctcaagaagactcaggactgacatgagattcccctaaatgtagatttctttcaaagagaaatagcagttacactttgacctgaaaaaatgctgaatgatttaatttttaaattcccccagaacccctgttatatgggcctgaacatgacactacattatatgttgcaaatatatttggcttcatgcagtggcaatactgaggtttctccaaaaacaataaacatgtgaatcaggaccctctagaaatctgcatttcttggtataaggaaaggaatttaactataaattcaaatatagctttggaacttattactttcttatttaatcctagataataccatttcttatgttcaggactccaggcaaacataagagcatggtgatgaaccacattttattcctctgtgtttcttaccctcgcagaggttctgccctatcctgctatctccattgtccatggggtgattccaagggctttttctcagcatcttcttttcaccattacaagtatagcttttgccttggttaaaatccagctactcatgagaagaacaaaataacctacctagtttagaggattgcaattcaaatatcattatttgagagcttactgtaggtagaaaatatggtgagcaatgaggaggtggttggagatgagagcacctgcctttgacttgggaacaaaaacatctatagtcagcaaaataattgtgatcaaaggatgggggagggcagagagggtgatgaattttctctgaatttccagggaaaagcttcccagagaaggacatttggggatgtagaggataaagagggaaaaaacaatgggagaaagacattgcaggcctatagaaaacacagcatgagtgaccgaagagaaggcattggccggcatgaaaactttaaatagtctagtgtagaagaactgatcatgactggctgagtatcacagggaatgaaagaggaacattggattggagccagcatgctgcggcttaaacaccaaagtaaagaatctcaactttagtttgtcagcaaaagagaaacactgaaatattttatgggcgggaagaacatattatgatgtgtaaaagaggactccagttgtggtagaaaataattttttaaaatatctgtcaaataatttctaaaaaaagaaaactttagtggctaacctctaaaattataaagttaaggtgggttatgattatatctaagtctgcaaaatgagctgtctgcctggatttgccgaaaatatgatacaggtgttggaaagaacaaagtaatgatggaaaattgctaccaaaatagtatatttaacaaaaaaagggaattcttcttataatcttgtaaggaaacaatagcatgttcccatgagtcagtaaaaatattatattgtgcaagatcttcaatcttgaaaagtttgaagagttagaagaattcagagagttttattgggattataaaaaaatagcttgccaagcatgcaggcaatatttttcctgattttttaaaatttagcagtactattttttttttgcctctcaaatcacaaccaggtctcaagtgctttattttctgaaaagtcatgaagaaaaagaaaatctagttatttttcaagatagagaaaatgatacttcatatatagctccttcctacccccgcggtgataatagtgctccttatcacacatcctgacatttgtgacaccaatgtattaatgtatctagggtggaagcctttacaaatgtcataaggtggctatgaattacaaaagtaaataaaatactggaaactacatgggaaattataccactaacaagtataatatcaggataggaggtgattaagagagagagagagaaagacaccaatgtgcaaattattctcctctcctatggaaataatactactacttaaaagattattgaaagaaaattacatgagtcatcacatacaaagcaattaaagcaggcatatagaaaacgcttcacaaatattaagttgtcacttatattgcctgatgattggttcattttggaggcttctctttctactcttaagcccaagaccccacatactctactgcaaccagtgtgtttcttttttcctcctttcccaataaacccttaattccctctcaaaggagctgactattaaatctgactcttttccccaagcaatagttcaaatccttaaggctttgttctctggccttttggattcctgggcccagcactttttccctataagagcacagccctggttagattctttaacacctgagactcccctttgagaagcagtgctgttcattctctccgggagtttctagtccagattaaaagctgagagaggtacattgaaaatgaaataatgatacatgttaacttataacagtgtaagagatggaacaggtgatccaaatactaattgagggaaacagattaaaaatatcataaagttttagaggatgtgatcaaccagtatggactcgagatcaggaaaagctgcaatggtcttgaaagacagatgggcgtttacaggctggatagaaagtttttttttggaggaagactcatgacatgaacatcaacaggaaaaaggaatttcaccagggaaaggcacaagacaagaaggcttggaggcagtgagtagactactctgtggactggcctggacttaactaggtgtttgcataatgaagcagtgtaaaatgaggttgatgggaaatgtttaggttgaaaatacagaggtccttttgtgccctcagtatatttcataaaagaggattcatcgatgattttaaaaggttatgctaaagtcatttcaccaatagggaatcttaaggaaatgcacaaattagattgcatagttcaagattgtagccagagatttgagttccagttatttagttcataagatgatgagagctatcagcaaggtggtggctttaggaggagaaagggaaagatggatatgagtgacacaagccagggagagttgttggaacttggcaactgaatatggggcaaaaaggaaaaggagcccaaaatgcctcagagatttcagccccagcgactgagaaagcatggttccaccaagaaaaatgggagacagccaggaaggctattttcctagtgccatgttggagttagatgcaatggcaggaatgtggaaatcaatatttaagaacctgcttgagataggggctgatgcttaaaacccaatgctgagttctatttgagttctatgttattctgccaattaaatatatttcttacaattggaaagaactccagcattcacatagctcttccagttagagtaatcaccatttgacaacaccaaaggtagaatggatatttctgctaccattctataaatgaattaactgatagcctaagaggttaaataaattatgcaaaagtctgactgtataggggacagatgaagaattatattttctagcatattataaggatcagagaatcaaagaggttaagaggattctagactctcagaattggaaacatgactgagcatctcccactcttgccacgtcatctacaatgttgtccgcacatggtcttccggccaccacttaatagcagccagtgacgggacctcactaacttacaagtggaagttttgatttttaagatgcattattattggaaatttttgatgaatgtgtcaaagaaaaatctgctctcctgctatgtattggtgctccttctgttctttggaactactataaaattattctgttcccttttctgtgtgatagactttcagatatcgaagaaaactatcatgccatcctatatcatctgaagctgtttattgaataacatgccttgtagaccttatgaaattctggtcatctatttttaaaaggcctccacttttcatatttcttataaatgatgaagcccaagaatgaacttaatataccagatgtgttctaaccaatgaagaatgttcctgccttaccaaacccttatacttgacctgtctacctctgttgatgcatggtcagatttcacttgctttaatagctgccttctcacttatgaaatcatgttgaatttgaaagcaaataaatctttatgacttttaaaaattttctgttgttaagccacatcacccctattctgtactttgtggtaaacatgaatattgatatgtattatgaattctggctttttactttcctctttgccatctcattctagaaatgtagacccagcattccagactaccgggacccttctaaagccaaattttgtcatccaatgtaacaactttaagcttcagctcaattgcatatctgtcaaacatgctttctgcctttgtttttttaagtccatagcaaaaatatcagccatgatagagaggaagagagaatgtcatccagctaatgtctttatccttctttgcactaaatgaccaactcctccatagtccttcaactgagaggttacaaattcttttcttcaataaggaggaaatgacctgtcctaactgttttttgcccattttttcctgctacattaggccagtctaagtaaaacatctgaacaaatcaaactgaagtttcttacattatactgcaggccatagaggaattacaagaaaccaagtcttggtcttttgtttagaatcaatggaaaataatgcacttttcacatatttaatgttttcattttactgggctttaaaccccacatttacaaattcctttctagcatgttatcccccaacaaaatgcccattataatgagtagtaatcaactatactgcactgagctatggatagtgggttttgtctaataattaagatatttacttccatacatcaccctcacatttatatccttcaaacccaagcctcagcaaaatgcagattctactctccagttccttcagagtcatgggcacagagtcaaatttgaatgtaaaatctctgaatgccaaggtccatgtaataactgcagccccctttctcctgattatctgtgccagtaaggtaaccagactggtgctcttatatgctgtcattccaggttttgaacactgtgtgaaaggttttcataaagtagaattctcgtcaagtttgcatttgcataaccatagaaatcaccttcttcactgttgaagtgaggagcctatggcgtatgttatttgtctgtgtccattgaatgggatattttcattcttaccacctggcaatttgttttctcttctgacatagctaccctctgtcctgggtttctgtctcgggacatttcatattgtaaaatgcactcaaaagacaaagacattagtttctgcccttaaaaaacttctgttcagtaaatatcctgctagagactttaacggaataacaagtaaaactctatggctaaaaaagaggaagtcagttgagtatcgtaatctaaaactttagggacctttgggttttcctcatgtacaagcacacaccttatttatgatttcatttcctgattagtccccaaagtcccagagttctacaaaataatgccttaggattaaaaacatgcctttctataaaactattttaaaagattcaagcacaaatacagtttatgctttcatagcttaactctttttaccttctcctatgaagctttctaggccctcaacaatatctcaattatatgaagttcagtgacattcttctgttcttgggtttcccaaatcatatttcatggaacacttgtattcccaaaagtattagcccagtgatataggtgtcctatggcctaataattttagcaacaaggtatattaataaacgatcacacagatctctttaccacagtatgcctcagagcctctaccatgttaataagcgttgggaatttttaggagtgcagtgtcatctcttaacttccataggccctctactacctagaggcagcacaagtttagtgatgggtatagaataacagtggaaaacagtatttttaaaactatgtctgaattatacttggagaactacaaacactttagttctccttagatagtgccgagactcccagggtttgtcttggttacttggtgggattgtcctctgtctctagttcatgagggtgaattacctactggctgctaaagttaaaaacaacagtacttaaaaactcataaccaccaaagatgtcacttctttggaagcctttgctggctccttagataacagaattgcatgcctcccccattatctgtattttcaaatcatttttctaacacctgcaatgtattgttgaagtcatttgtttaaatgttggttacatttcctactagatcataatcccttttggagcaaccactgtgtctcttttgctttataatgttagcatccagcacaaggtctggctcatgatacagatttaataaatatttattaaagaaaagagggagaaaacaggtggcacagcagacactaccacagatgctgtcaagtattaaggtgactgaagaatccacagtgcaatcttacaaattagacagtaaatcctgtggtcatccttataaatgctgtcactcatactactttatatacactgttaaagaacagtttttaaaagagagtataattgtgatatccatgcagttataaaatgtgtcaaaatgttattcatcaattagtgagagaaccaggtaagatgttactactgtctcaaaggagaattccagaaaccaagcatatacaagcaataagaaaagctggaatagaggcaagacagatttatccgcaaagcaatattcagttttattccacccaaaataattaatttgtattactagggacaaaaatcatctatactattattattaattttctacaatttatagagttttaaagtagcccaaggacaatgaaaagtgaaaataacgcaaatgtgtatcatagacagaatatccactaatcttttctgctcctttttccccagaagtggcaaattttcattttatcagttttggttttccttccctctcttcctcctcctcttcctgctcctcctcgtcctcttttattataatcatctatcacttttgctcaggttttataagactggggcttacctgagaaatattaagagagaaagtgccttcctttccagagttccccccctactcttggctcagtttctagcattgctctttactctcaggcacagttatttctttggatggctccttgattcattatgtaaacagtcctccagagagcaccccaccacccttctaggtgatacagagtcaagaccaatctatatttatgtgtatccccctcaatacatccatgaaatcttttttccatccttaaatactgtgtttctcaaagaaaggaattgtcatattttttcatccattaaggcacctgaaacagttctggactaatagtcctctaaatactttcttcatgtgaaaatgttttaacattctttataagatccaggtgtagaacaatttaaaacttatgttttgtcttttactaaagagaagacattttttctgtgcctccttttcatagcatatgtagtttttgccaaagcctgtgttttcacagagcacctagctagaatcagtaaatggaatttcaaaggaccataggtttctttctgcctggggagggtatctataattgtaccagtgtttcttaagtttaaatcccatttgcctaatttctctggcctacaccctgaatctcctctacagtatactctcggaaagtacaaccagatgctagctaatacccataaaatttttctgcatctccccttgaatagggaaaaaaaaactgagaaaatcagctcattgaaatgtcttgcctgagaaattcttaaggagtgggaaagaagaatgacacatacccatttaggagagcgtctctgaataatttcttgagcttctttgacatatttcgttctgtgctaattatagatcacagtgagccacagttactagtgagtgctttgtttcctctagcattgttggtacgggaagagagaaagagaaccgtttatctaaacttaatagaatgttataaatctattatcatttataaacaggtagaaaaaaacatccttagttctatcatatatctctagacagtctgcatttccaagagatgtctgtctgtgcataacacttgtagtatgaaaaatgctaacatccctcagtgaccatatttattgtcaattaccatatatcttctctattatcttatttataaatattggaaaattttgagtttggttgaataaaaatagcaaaaaaaagtattattatatttatcagacacaaagttcaaggggtgttggatttccaaggaccactctgcttcgtcaggttggcctatatctgcaccactgtgtgattagaggatggggcagatggagtggcagacacctgacctagaatctcaaactggtatctggaaaatatgtggccggaagctaccttccctgtgaaattttgacaacccttggtatttttctcatattcaagaaacagaagtcaataaccaggttgataattgttacctaaacctgtcattctataaggattctgactgctacatcagcatgatctcatttgtttaaaatcttgcataagagataaaggcttaggccttctgggatatgaggtctgtgatgttgagtgtcatttcagagatgtctagggacctgaattagacgttaataacttagcaatgggaaaatgatggaaccatttttttgtatcttgcattgatcaaattgtattattccatttgagcttctctattagagtaataaattctgtcttccaatacttctctctaaatgcctcggcttatttttttttctttgtagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtaagtaacacataggacctgagaataaggtaaactgaatactaaaataaaatttaacatcagaattattatacatagtcccaataattttttgctgttgtgaattgaagtatcattaaaaatggagagttatggttaatagagaataccaatttttttagtgttcatgaattataattttataaataattttaataacactaagatgtatttaatactaaagctctatggaatggctgacttgttggtgattttaacttccataaaactactttaagtaaaatctactttttaatatttatgaccaagatattttcttcaattcagtataaaagactcagtggatttctggtcttggtatcttccaaaaaatgataataattccctaaatcctaatttcgaatgtaaaatccctgtgctctggggtttccataagggaaatctcattttatgctcatttcatatgaaaaaaattacaagatttctttgaaacaggccaagaggcaggcttgtttcatgtgtttcatatctttgaaactcagatatgtttcatgtgtcaaagtttccacctcataagcttctaggatattactgttcaaaaatttttctttcaagttgctttgtgatttattatattttggtgattatatgcatttaagatctggcatttctaagagattattgaaaatgtcagtacgagtcaaaagagccaaatgcaggctcaaacttcagaacctaataaaagttatactacagaaataataaaagtaagtaagaagacactaacttcattcatgaaagatccttggaaaagggaacatacagataagtttttaactgtgatgaaaataccctggactcatcattgtttcctcttggatacattaatttttctacctatatcaaagataaagctaaatgtgctaggtaggtagtctgcctataacactctgtgctttttgatactgtccaattaaaaactacaattatcccttttcatatatcccaggttatactgtgggatatttccagaaagggaaaagtcgagctcatgagagattgtcaagagatgcagaaatattcaaaacattattccctgaatgcatgctcatgctccctcaaggttttctaaactttataaatacgaatacaattctaatatatcaaataaatagtgttgtagctttactccaagaaagaaatgagtatataaaacttttgcttcatctttataggtttacatttatgtgtacacccccccctccaacacacactcatatacatatacagacagtcatccctcggtatccctgggtaattggttccaggacgtcccacggataacaaaatttatggatgctcaagtcccggatataaaaatgtataggagttgcatataacatatgcacatcctcccatatattttaaatcatctctagagtatgtagaatatgaaaaatgtaaatgattgttatatagtattgtttatggaataataacaagaaaaaaagcctatacatgttcagtacagatgcaatttttaaaaatattttccatccgcagttggttgaatctatggatgcagaatccatggatatcaagggccgactgtgtgtgtgtgtgtgcatacatctatgtatgtttgtttgtgtgtgtgtgtgtgtgtataatcaactatggtatatggaatttggcataattacctttttattacatgtattatatgaaaacattaaaaacatatgggaagaggagaggattcttaattctaataactcactgacaatataattggttttactcttagtttatttcctgttccctcattttctgttttttttctgagtattcaatttttttttcagataactgaaattggtaggatatagatacgaaatggtttttaattttctccgttagctacctgtaaatatgccttgtggaaacttatttccacctcctccagccctcctatccaccctcgcccagctgccctcaccagacatgttcaggcccaaaggacttagtgtataaaagggagcctgatgtgccacttactcctccttccccatccacttacaggtccctctattcctcagtgttttggggaatggaaactaaaggggaagaagaagaggccctcaatgcttcctatatggttgcatccaaacgctggtctctcgtgtgtgtttctggggaccctcctatctgtacatttccttgaggagtgaaatctatttcatatcaattcctgtcagtgtctcctgtgactgcctactgcagcatatgccatagattcttgctacttgaaaatccattccttgtggctagccctctggaatgggattccagcaagtaagctaaagcccaccttcctcttgtgaggttcacttgagccatacaaaactcatacatttttttcaaattgttggtggtaatggagacttctccactactacccactttctccaccctgccatttctctaaaattctcttctctacctgtacataagcatttatacttccacattaggggagggacaatgctatggcttgttgtaacatgaccatgttcaataaaaaatggaggcaagctaaaaagtcttctcagttagtgaatccaggatttctgagtaatattcattccctctctttttttgattctatcacaatcccatctcaatattcatgaccatagactgagtaataaagttagccaacaatacaccctttggaaaattgtgatgggcaagagagatcgatgaaaattagctgcattttagaattatttataaaaccataaaaatgaaaatatagtagaagatacaatacttatttctgtaacaaatcctaaagttatagtttgtacttatgacttccaaattcttctgtccagtccatgttctctttggcgccaaaggaaactcagcttccaagatcccttaagtgacagagaaatatagaaaagtttaattattggagtcttatttatataaagtgctatacaattctttgaacatttgacactggacatgctgaaatagaggcatttgggttccaccctttgtattccattggtgctcttcctgcagatgatcatttccaatcaatggtaggatccattatcctgtacctgttttattctggtggcatggtgtcaaaaatgaccaaatgaagtctcagtttccagtgtatattagtccattctcatgctgctaataaagacatatccaagagtgggtaatttataaaggaaagaggtttaatggactcacagttcagcatggctgtggaggcctcacaatcatggcagaagacaaaggaggggcaaaggcatgtcttacatggtggcaggcaagagagtgtgtgcaggggaactgccgtttataaaaccatcagatctcatgagacttaatcactagcatgatagcaacacaggaaaaacccacccctgtgattcaattacctctcaccaggtccatcccatgacgtgtgggaattatgggagctacaattccagatgagatttgggtggggcacagccaaaccatgtcacggtgtaaatattgttgcaattatccaaataactgtctaggacttagcacaataccaaatacccatgaatagtcattgtatttcatttttgttattttaacttagattttgttatatgatttaggaagatcatactggtgttatagtatcagtcaaatataaagtagtaatagctgacactgcttactgcaaacacctgccactctgcctgaggagccacaggcacaggctcggtcctatgcaggaccagctggagtgccagagggttaatgcctcagggagcagccccctaccagtgaaatacaggaagttggtgggtaagaaaggaagaagagaaaatctctatcttcctcatttgtgaccaactctgatgtgtattctacatatacagcactccagagtttccctatgagatgggatccagtttccctcagaaggctggcttgacacacacttacttactttttacttacttatttttttagcttatttacttttttttcttttctcacctcctggctcctttcccagtgtttcctgggatccctccccaggcagaccacttaccttttgatgcttgtctcaggtttacttctgggagaacccaaacctaatgtcaggtggctaaaaagcagggtgccagatcccgggtcaacatgtatctaaactctgtgccctgacctctatgtacacctctccttgaggacaagtaaaaaggctcactaccttgaatgaatgtttccctattacttgggctttttctctcatgtgttcttaatttagaaatacagaactaattaatgaaatacaacttttaaatgagtattatctgggaaaaaaatttgtatttttttccaaataataagcataatcatttaccttatgatcataaaacccaaagtgatttttttgtctctttaatttttttttttttttttttgagatggagtcttgctctgtcacccaagctagagtgcagtggcacgatctcggctcactgcggcctctgcctcctgggttccagcgattcttctgcctcagcctcctgggtagctgggattataggtgcacgccaccatgcccggcatttttgtattttttttagtagagatggatttcaccatgttggccaggctggtctcaaactcctgaccccaggtgatctgcccacgtcagcctcccaaagtgctgggattacaggtgtgagctaccgtgcccggcctgtctctttaatttttaattcatgttctgtgggggaaattactgtttcaaactgcattgaatcattatttaagtgttatttaatcaaaatgtgtgttgtataaaaagtcttgtgattctttagaaatctaagtgcacttttaaaagcatttgtgttttacttttcttattctcatataatttccccttactccattttcttcttttcctttctcatctccttctcttttttctgtttttctcccttgcttgtgttagaaaagtaactattgcatttaatataaggaaaaagccaataacttataatcaatttttttcactattttcaggctttaagacatacttccctttaaaaatatgtttaattgaattcaactttttaataaatgggtttataataaatggtttaataaatgggtttctaagtatggaaatgcctcttgtatcttgctcgtttattcttttttccttcttcacctctttcttgctcttttctctcctatttttgtactcctttcctccttcattattctcttttggaagagatttggatgtcatctttctgtagtagttagacaaaaagaaaaaaatacaaggaattgaatcccattagaaatttatgagccaaataattcaaatatgatctatcatattggaaaaacagtcttctctctctgttccaaacatggaaaataaacaaatccaaaatggatgtagaagtattcttaagtttttaagtggaactgagaatttaatatataagagtcacatgtttattattctagaaatgtactgcaatattaaaacaccatcttattctgcatccatttaacaaacatttactgagtgtcccctctgggctaagtttcatacagtgagaaatatgttcaaaggtggatatgatgttatgtatgcaagttgctctaatatggtgcttctcaagtaggggtggttttccccctcaggagacatatggcaatatctgcagagctttggttgtcacatcctggagtggtggtcatgttactggcatctagtacagaggccaggaatgctgctaaacatcctacagtgcacaggacagccttccctgtaataaaaattcatctggctctaaatagtaatagtgctcagtctaggacaccctaatctaacacaggctgaaaagtgagaagtgaaattttggtctgaggagacagaaaaggcagagaggtaggtgagtatattgggtcatgagaaggtagaagaagaaatgtattctggataaagaaactctccaggaaagtacgtacttgcgctcttattttaaaatcccaatatagcaagcatgtccacagtatatttttactggtgaagaaacataattttttttaaaacaaaattcaccacataaccccctattttaatcaatagatattattaaaagtatcttaaatttccttgcaccattaaaatatgtagaaatactgtggtaggtttaatgtaacattagcagaaattttaatatatgttggaattacgacatgttatttctccaaaatttgactcagtggtttaaaattgatagttagcttgaaatattacatttcttattgctgttttttctcaagaatgcattacttacagttttagaagctggtagaaaattcatttcttgcatcttgattacaatgttactaaaaaaaaggtttttctctaacaactatttcatgataccaagggctctttgaatatttcatgcaggagcagacagtgaaaaatgaataaaacttgaacatattaaatacagttttttcaatgaataacacaatttgaaacaaggcacaggatgattaattgctgagccatcctctgtttccttctctgagttttattgcagcttgagtgacctgaatcacaaaagctttacacagaaaagggatattttatatagaagttacaacagttccataaaaatattaatagttaatgcctatgtgaattaaaatacaagagctgaagtgtttgtactctatgatctgtcctattttttcatttttaatgagtgaagtctttgagtctctgcttattttaagtttcttaacattaaattagatcattttgatcattttaataacctgtatcctgctgaagtagagtataatgtattttaatttgagatggaaagcagatagttactgattcccatcctggaatctattaatatacttcagtatgcctagtatattgcattaatgtcatgtggagatttctcactcttctttttattggtcatttttataatttaagtggaagaaatatgtcatttatttatttgtttatttattttgagatggagtctgtctctgtcacccaagcttgagtgcagtggcataatctcgactcactgcaacctccacctcctgggttcaagtgattctcctgcctgagcctcctgaatagctgggattacaggtgcccgccaccacacccagctaatttttgtaattttagtagagacggtgtttcaccatgttggccaggctggcctcgaactcctgacctcaggtgatctgcccaccttgtatccagaatataggatgaaaagtttaaataccagattatatatccaagcacacttttattgtcaggtgtaaaatttggaagcatctcacacatagttatttgggatcataccacctaatgaaagcattatctctaattatattcctcaaactatattccagaagtagaaaataaacccttttctgaaatggttcactgtggaaagagtgaaccattttcttatcagtaatgcagaagaacttaatatttcattggcagaaaaactgttctcaaattaaaaaaaaaaaaaaatgagctttttggccaagggccaccgctgaaatttcaactggatagccacctctggaaaaaatgctgagaaatgtcttcagttcctatgcttggccattttcaacttaatactgattttaaaacatagaagttatttctcatattggctaagcttgtcagagataatcagagatctggaatcctatccagcaggtctatgtcactctctgccccttaggcaccattggactatctagaatttccttctaagacaagaggttagcatttctctagagtcttaagtgtaaaactgaggagaatctgtgaaatatggctcttcaaacattgcagtctttctgatgacattcacttcaccaaggtggatgagggtcttcagagcagtcaaagagctatgcacaaatacctttaataagaggggtactgtgatatgattctaaggatgttgactccaaaagtagaaatggcaaatattaaataaggttacagtgaagataagcaaacatcttgtgcactaaccaagttgtctacctctgtgctgttcctccctcaaatcctgcaagaccagtaacattctccacacttctcacattaagacacgatgtgtaaagattttactcacaaatagatttttaaaacttgctaaggtagttggtcaagtaggtaagtgacagggacaatgcccctcccactgtctcacactcgttttcatccgaaagaaatcagtctatcattattccttcccacagcctatgctttcttctccctagctttaaataattgggtgtagttccttctccgtactctacatgttagtatcactgaatctctcttctgttcaggagatgatctttaagctgatacttagttttcatgttggcaataaatccccgccgcaaacttctaacttcttcctctgctccccagtttcacttcattctggctgcagttactgggtaagctcagtagccaggacaccttttaagtaataaacagaggaactgacgttgtagaaatccaagctaaatgtaagaaaatacatcctgcttccaggacactctttctaatatagcctggagtctactatacacctgtaggacattgctgcattgctctgtcctccctgtctccctcttctcccctcttgtcccccaccagcacatggattcatcttgtgacagttccctagcacagtgagtcattttgtgattgataattggcaaccctctcttcttacaatgtaagccctagtaggacaggcagtttgcgtattcatctttgaaatctaagtgcccagtagagtactggatgcaaagcaggtgcttagtgagttatagaacaaatgaatgctataaaattcaatgcagaaaatctcaaattgtgtaatataacatagttctcatatttgaatgtatgtgattacagacttttattgtagcaactatgtttgtggtcctgttctagacactggaacatccaaagtgtgtatgagtatgtgtgcatccttagaaaaaagcttgtaattttacaactgatactattcactaattatcatacaagataaaagtaagtgccattggagaaatacaaaggggcatataaaattagaaagagagaaaaagactacttttttttggcaaactcttgaaatcatgatgttttattcagtctgttacatgaaactcaaaaaccgaccaggaaaaaatgaagtatgccactgtgcacagtttaggtcactgaaagatccatttatcctttcatgtgacttagttttaggagcatttgtcatatgccaggctttgtgctaggtaaattaccatgaaagtctatgccaaatatctccatttgcccctcctaatctactttcccccactccgcaggaggctgagctgtgtgggtcacagtcttgagcaggcttactccctgtttcccaagtggttcagagagcagggagcccctcctaaaagggaagactacgttcagatattccttctccaggctccctctggacaaggtcctctcagcctggctctgtcctttgactgtaagcttctcaatgtctttcctagaaaactctctctttccaggttccagtaactccttcctcccctcatggtttaccgatgagggcagttagcagttccactttcccttgtcatttccctagagcccagcgaaaccctcataaaaagtctcttctcaaaccatcctaaaattcctcaaattctggtttccatctgttcactatttatactctgatacttgaaaaatctttagagttttgccaggttttcttccatggcaactccttcatatgggtcaaagattaacatgttgaaataagcatttcaagtatcagaataatcctctttggagtgagagaaaacatcaaattttgatgactcctttgtccagaatgaacaaaagagctttccacagaaatatttccattatagtctgggcaggacatcaaaatcccgaatcccactttctcagaatacagtttatttggcccagcattttatcttttctggaaatctgaaatcagattaagacaactgggaatcatttgtaaagtcacttgtaaagtttaagagttctcacagcatagaataagcacatgtttattgcatgtgatgctgtggggaaattatcacttttaatgtactggcagactaaaatgtacatatttttagctcggaataggtgtacttctagtgtttctttcattttttgtcatgaatacttgaaagattacatttttttatcgcactcacatttttaatcaacaactgtatatatgatgcatttctttatttctcaatttggtgagagccagatcttattccaaggttatgctgaatatcagtgattagaatccctgtttcctgacttcaagtgttccctgttacttgcctctcaaatactaagattggtttaaataattatgaaggtaacatacatatattttcaaaagaaacaaaagcacttgacatttgtttacatctaaagttacgtataaagtttacctataaataaccactcacactgcagtttactaccatttataagcaccttcatgtattttcgtcacttgagtctcagaacagccctctaaagtcagacagagggccagcaccatggctcacgcctgtaatcctaacactttgggagaccaaggtgaaaactgcttgagcagggagaactgcttgaggtcagcagttcgagaccagcctggccaacgtggtgaaactccgtctctactaaaattacaagaattagccgagcatggtgaagctgggactacatgcctggctcctgggtgcccgtttgtgacagtcatctcacccaagagcaatggatgtcactgaagtgatttaagcaagagtgcaacatgggtaatagactgaagggagacaagacaggagcagacagacaagttccagcctccagtaaaaatccaggtgagacatggcatggggcttggatggtggaatagtgacaaagaaatatgggcagactcatgatgtagttcggcagtaaaataggcaagtgttagtgaaataaatcttaagttaataaaagttaggatataaaatttcttctacaggattccaaaataaagcaacaattacttctgtgtgatgaaagtgtggttgattttttttctctgcctgcttatggttttctgtactttcaaatgatcccaacatgtctagatatttatttttgaattataattttatttaaaaatataaaaaatatactttcttatgcaaagtacaatagtttaattgattgccaaggtgcagtttattcaaagtggtagattttgaagtcttttaaggccttggatttaaatctgagctggaataaacagcccagttaaactttctcttggccgggcatggtggctcatgcctgtaatcccagcactgtaggaggccgaggcaggcagatcacgaggtcaggagatcgagaccttccagctaacacagtgaaacctcgtctctactaaaaatacaaaaaaaattagccaggcatggtggcacgcacctgcagtcccagctacttgggatgctaaggcagaagaatggcttgaacctggaaggcagaggttgcagtgagccgagatcacgccactgcactccagcctgggcgacagagcaagactctgtctcaaaaaagaaaaaaacaagaaaaactttaggatttaaagaatcttataattgctttgtgagtagcacaatcgcctggagtgggacccacatgttattgtataatgcaccgattaaaattaagtgccgagttaatgataaagcaggtattttgaaaattgtgtaatacctttttgttaggggtagctatgatactttttaatatttttgttactgctgtttgttttgttttaggtctggttagaaagtaaaacagaggttagaataagttgtctgggaatcttgtggaaatactgacatgtcagaaaattactcttcaaatcactgagtcaagaaagcaaaatgcaatacaatttctctggacccactgagccaccacgcctgtttttgttcactgagaacaggtttggtgaccaatggggtcagtggcgttaattggaaactgcagactactgcctcacaacctgcacgtgtccttcacagctgatttctgagcgaagatgggacattttctcctacagttatcctttggcactggaagttaagccttgttattacgtgtttaatctatcttagaataaggaatataaggtatgttaaatggcataaaaatagtaaacctaaatctttaaaggttggaagccaaccttgtacaaacctctggtgtaaaactctctgcttatttatggaagaaaggcaagaaatgcgaaaacaggtgaatggagagctatacaggcatggcccaagcatgtgctctggttctgcctggctgcaagacctgggataagtcacttatcctctctaagcctcaattttgtcatctgtaaaaatggaaagcataataattcataccgtgtggagttgctgggagaactacaagtgataatacccatgaaacactttgcacatagaaatccccataaatgttcatcattcttatggcatcctcatcatcattagatgtgctctgtctcagaggtgactctttcgtttacaaaacattaagagagacccctcaggatgcagctccctaagcaagtaagccagtaatcacgtgttcctctgtgagctgtacctccacattcctaagaggctcttggagtgactgagagatctgtgacacctgaatgattcacacctgcagtttctaggaaccccttctccatacactccatggttgtcaaataatcatatatttattgaacctgtactgtgcacaaagcactgtgctaggtatgtgacaccagggatagattctttgctccaagaagctcatgatgaagataaaacaactgtatgaagagaaaaaagaatcatccagggtagtttatgctagatgccagatgaatctaaagataaagagtagaggctttcagaaggggagagatgactgtgatgggagagttgggagccttcggggaagatgtatggttcaaagtgggttttcaagaagatgtgggtctcaagtaaagaaaggagaaaagtaggcatgtcagaaagacacagagatcaaagcgacaagaagaccaatcagagtggagtagaaaggtgctctcaaagtatagtcccagaacagcagcctcaggattacctgctcaggctgtcataacaaaatacaaagactgagtggcttaaacacaaaaacttattttccagttctgaaggctgggaagtccaagatcaatgtgccaccaattccatttctgatgagggctctcctcctggcttgcagacagccttctacttgctgtgtcttcacatggctgagagagagatcctaagttctctggtgtctcattttataaggacactaatcccatcaggccagggccccaccctattacctcatttaaccttagttatttccttagaggcttcatctctaaatacagccacactggggattaggacttcaacaaacgaatttgggggagataccaacattctatctatagcacatggaaacttttcagaagtgctaaattttgggctttaccctgaaactactgagtcagaaactctaggagtcgggctcaaatatctcttttaatcagcctttttggtgctgctgagtttgagaaccactaaagagtcaatagggcaagtgaatggaggggagatgaaagaagtagattgtcatcagaacttggagaattttgaggctcaagaatgtggaggctggtcttagtcagtgggagacctagaaggagaggaggtcatacaggttagtgtaaaccatttattttgccatctgtttgtgggagaaaggggaggaaggaaaggaggagagaaggaaagaaggaaggaattaagagaaagggaaggaaggagagagggagggaatgaggacgggaaagaagaaggccttttggaaaacagtttcatagttcaggtgttcacattctaagtatagtaatagcaggaatggagaaaagggatgaagatgataaatattattaaaatctacaggtcatgccagggtcaagcaagcaaaggagaaaggggaattaggtaacttgtagatctgtgcaacctaccactgacgaaagtgtggaagcttagacagggagctgatttgaggcacaaattcagttttatttatttgtgctgatattaacaggaggacatctaagtgactatgtctactaagatatgagatatagttaagagagtagtcagttctgcagctaaattcaggaggtgattcttgaatcctgtgcagcctttgcaagttctgaggaagggcgcacagtgagagaggataaacgaagtcacagagaaagccactatttcaaggaaagcaaaggcccagaatgagggtgaagatgagggcagagtaaatatcaatgatatttaaacatttttgctggttagctcctcaaaaggcctctcagtctgagctctgcagaagggacgtgtttgcaagtcactgtgagtcccctgggtaaatcagtgtgcctatgaactgggccaactagccaaaactgtgaattatgacgaccaccactactgttagcctgactccttgttaaacaggataatggttttcagtaccagctgaaacaattttaaaatgttgaccatttatattacttaagtaatgtgctaccatttataagtaatataaatgttggccatttatattacttaagtaatgtgctactgaaactctaagggggtttctgtaacggtaaactgacagttctctaatgcagttcagcatcacctgtcgggcttgtttgaccacagattgctcggttacactcagagtttcttattcagtgggtctgggtggggtctgagaatttgcatttataataagctctcaggcacaactgatggtgctggtttaggaaccacaatttgagaaccgttgttaagcctcacgccacaccattcctatcatgagagccacctgtagctaattcagggtaacttgttgactgcaaactataaccataggcagtttctttagcaatataaacctctagataaaagaaacactcaaaaatcagaataggaacatatagagtcaatgaaaactattttttttccaaatgagagcatgtgttttacagcctcaaaagaatattttcatgtagactgcactaaaataacaagataaacctgaaactaaagcttaaaaaggcctttatgaaacaaaaacagtttcacacctgaggtaaagggctacatatgtccctcgattttttctcatatcttagctttcatttaaatgacattgccattttacatataatagaagaacctagaaatttgattcctgcttattagggcaaaccaaaggggttatttccaattattttcagttcagtttttcttcacgtataatagaaatgatttaaaagccaggttttgttggaaactgccataaatgtggttaatagttgctgcctcagcatccattttcaggcctgacctaagttgtctgaagcccagtctcactgtatcacctctggtctgggtaacacttcccctccctgagtggttgtttgtaatgcggcccatttgctcttcatcgcactgacccagaacccacacatcacacagctgctgaccatgatcaaacctaacggccaacaccagagtcctgtgaataagtcctgcttcctacttgttctcttaaatcagcctaagccacacccccacgggaaagccccaggacaaagctccaggccctaactgtgctctctggctccccgtggcctccagacttcccctcgggctcctgccgctctctggacctctctgggatgtgtaagtaagagatttcttctgttcctgcgttttggtttcacctcctccttgtgcctcacctgactgacaccctagaacctacctttccccttggccagggctctcctggagattggctggtttctggccccctccaaagagagacctgaagaccaaattaggaacctaaatatataaatcgcaacagaaagtttggttgtttactgacaatatatatttatactgtaaaatgtgtttatgatttagaacacactagacctattctagctctaaattgcattgctatcttgtagtatgcagttatgcctcgtttcatttcattttccaactgaagtcattttattccctcagtttataaatacctcgaattctttagccgaaaaggcaaggtaacttgatagagcatccccctttgtgaccataacctccagtgcagaacaaattaaacgtgcaaaactgtgagtgccatgtcctacattgttaaagaaaatgatgttgaaaggcagtgaaagtccttatgaagaaattcaaaagagtaaaagaatagacagatgaactggaaatggaagaagtcagtttttctttcctttaggagtaagccaatttggaaactagctggtaagtgttacagtccatttacatgacaggcattcttcgtattcactaagaaaacattatggtacaaatgttcactgtgcagagcacacctgtaatatttcatctggtcctctcagtgaccctataaggaaaatgaaacattttcagatgagaccgggcttcagggtgaaattaggtgacgggtgagacttatatagagagtaagtggtggaactggattcaaatccaaattcttccaactgtaagcacagggcattttccactaatcagcccactaaccaaagaaacctaatttttccaaacatttaaagtgatgctatggccatttgagtaaaaccaattttggcctatacttttgattccccatcaccagactaccattggttatccgatatgggcagcagaattaagaggtaatgaagtctaatagaacctctcattatttgtgtggatgcagtagtaacagagatggtgatatagtttgaacgtttggcccctccaaatctcatgttgaaatgtgatcctcagtgttggaggtagggcctgctggcaggtgtttgggtcacggggcagatccttcatgaatggcttggtaccctcctcatggtaatggctgagttcttgatgtattcattcactgagatctggttgttaaagagtgtggtactgcccccgtgtctctcttgcttcctctctcaccatgttaggtgccagctccccctttgctttctgccatgattgtaatctaccttaggcctcaaaagaagcagatgctggtgctgtgcttcttgggcagtctgcacaactatgagtcaaataaccctcttttctttataaattacccagcctcaggtattcgtttatagcaatccaaaatggactaatacagatggggacatgtaggtattaatttaacagatgcttatatattgcctgtattctcactgggactgggaagtgttagagaaatataaatgaaaacataatctcctcctaacccggaaaacttctccacaaaggtagaagagaaagaacacagttttattgagtaagcattaaaccagagtgagatgcacgtctcaggaaatcagctaagaaattgcaaagacagaaaaaaatctcacctcttaatataacaagcagatataaccttttatatacaaattctcaaggtaaacaataacttgtcctcaaggggactttacagcaccatttgtcaaacaactttcatcctaaattcccttagtaattggggtaaccgtctgtgttagacaattggctttatccaaagcaaaaataaatttctcatatctttataaaagggggttgtcttgcaacttggagtaagatacctgctgaaattaccctcctagcctcctacagaacctgataaatagagctgttatcttccttgataattttcaaagtgatgattccctggtctttgagaacagtatccttgggtcttaaaactagcaaaagactaagttagcttttaaaaatttttgtatatgtttcaaaatgacaaagaggtacaagctttctaaagtaaataccctaagaaaaggatgtttctttccttacttttaacatggagaacatattagtcatatattccttataggcttcttaacaaaatactacagattgggtaacttaaacaagagatatttattccctcacagttttcaaggctgaaagcccaagatgaaggtgccagtgggcttggtttttggtgagattgctcttcctatcttgcagacagttaccttttcattctgttctcatggccttttccccgtgcacagggaaagagatctctggtatctcttcctcctcttaaaaggacaccagttctatcatattggagccccatccttgtcacctcatctaaccttaattaactttttaaaggccctttcttccaataaagtcacattggagggtggggcttttacaaacaaatttagggggagacaaaattcagtccataacaaagagttgagcttcttatttttagttggcatttgcccttacaggaataacaagccaggctaagtccttgtcatcatgcagatgcaagtaatgcaagttgcaagtaataatcaaggaaataaacagtgatgagtgaaggcccttggcttaaggataagaagaaaccagccagctcctggttagccagggagtaaatcgttgcattcctgataatttggaaaggaaagagctagaaaagtaaatttatggaagcaggatcatccagataatcaatgatataactaagctgtacagactgttaggccatcaatcaatatttaccaaattccacttacacattcatttattcatatactcaacatttaatcacccctagattcattttatgtaccaatatggctgaaaactacccagataatgtttttccttccatcacttactaccaccatagattttatgaaattattaattaggtttcaacttagatttcaatttcaaactgttgtgtcatgttgattttacacaaatacttataaggtgaaatgacagaattttatgaaattattaggtttcaacttagatttcaatttcaaactgttgtgtcatgttgattttacacaaatacgaggtgaaatgacagaattctcctcctaccaggacagttcacaaaacccgtgaaacatttatatgactgaagcttcttcatatgtgctcagagtctattgtaaggaaacagttatctgcatgtcttcccagtttttaaaaaccaccaccaactaattcatataatagaactcactcaaaataactcaaagacagtctggacaaaatagagatatgatagtttaaaagataatgtagtcgtataacttccacatatagatagtaaactcacaactaaggagtttgggaccagccttcaggacctcagtactccactcttctaatgtatggtcattctgttggtagagtggattttcatcactggaggcagatgttacactgctcctcccctctggcaatcagacttggaggaaggcaagtgaaggccaggtgagaatgagcctccacccacctccccatgcccagccaactctctgattctctaccttgtgcatctcctctctacacaaacagcaaacatctttttactttattcagtcaaataaaaggtagacctcttcatgtaagatactgacatgttcaataataaaatatttgaagttaagttagatacattttaatgactaattgagtcatatttttaagaaataattattcactgtgcatttgttatgccaagtttcagatgagactaacattggccctgggcacaatgcatgggtgaatcattttagtctcaggaagatgggttttgtatggtgttctgtattaggcataatcacaaggtagattggagagtcctagataagatgatagagaatgggtaggacacccttcccctgaccagcagactgctggttgcatggtgaagctctttgttaaccttggcttctgcctctctagcttcccatatggttcattaatagcaatggggcacaacccattatctgctgaaatgcaacagaaatgctgatacattttcaatttatttcctgaagtaaattgaactttccccttaaatatggtcacattattaattactttaaatctcagctctgccacttactacgtgtaacattaagtaatttaacttatctatgtctcattccctcatctgtaaaatgaggttgacagtagtgtcccctaaatgtggttggtgagaagattaaataaatcaatatatgtaaacctcctagaacaatgcctagtgcataacaaatacttcatagtaaattcttttttttccataagttattggtatacaggtggtatttggttacatgagtaaattctttagtgatttgtgagtgtatactcacccaaggagtatacactgcgccatatttcttgtcttttatccctacccccttcccctcttcctcccaagttcccgaagtccattgtacattcttatgcatttgcatccttatagcttagctcccatatatcattgagaacatgcaatgtttgattttccattcctgagttgcttcacttagaataatagtcaccaatctcatctaggtcattgcaaacgctgttaattcattcctttttatggctcagtagtattccattgtatatatatacgagtttctttatccactcgttgattgatgggcatttgggttggttccacagttttgcaattgtgaattgtgttgctataaacatgcatgtgcaagtatctttttcaaataatgacttctttgcctttgggtagatacccagtagtgagattgctggatcaaatggtaattctacttttagttctttcaggaatctccacactattttccatagcagctgtactagtttacattcccaccaacagtgtagaagtgttccctgatcaccgcaatgacaccaacatctactgtttttttatttgattatggccattcttgcaagagtaaggtggtatcgcattgtggttttgatttgcatttcgttgatcattagtaatgttgagcattttgtcatatgcttgttagccatttgtatatcttcttcttcttctttttttttttttttttttttttttttgagactgagtctcactctgtcacccaggctggagtgcagtggcacaatcttggctgactgcagcctccgcctcctgggttcaagtgattctcctgcctcagcctcccgaatagctgggattacaggcacatgccaccatgcccagttaatttttgtatttttagtagagacaggatttcaccatgttgaccaggctggtcttgaactcctgacctagcaatccacctgcctcagcctcccaaagtgctgggattacaggcatgagccaccgcgcccagccagccatttgtgtatcttcttttgagaattgtctagttatgtctttagcccactttttcatcagattttttttttcttactgatttgagtttgttgtagattctggatattagtcctttgtcagaagtatagattgtgaacattttctcccactctgtggattgactgctgactgttctttttgccatgcagaagctctttattttagttaggtcccagctatttatctttgttttcattgtaattgcttttgagtttttagtcatgaaatcctatatataggagggtttttccaatgttatcgtctagaatttttatagtttcaggtcttaggtttaagtccttaatccatcttgagttgatttttgtataagatgagagatgaggatccagtttcattctcctacatgtggctagccaattatcccagcaccatttcttgcaaacggtgtccttttcccactttatgtttttgtttgctttgttgaagatcaattggctgtaagtatttgggtttatttctgggttctctattctgttccattggtatatgtgcctatttttataccagtaccactctgttttggtgactatggccttatagtatagtttaaaatcaggaagtgggatgcctccagatttgttctttttccttagtcttgctttggctatgtgggctcttatttagttccatatgaattttagaattcttttttctagctctgaagaatgatggtggtattttcatgggaattgcattgtatttgtagatggcttttggcagtatgctcattttcacaaaattgattctaacatccaggagcatgggatgtgtttccatttgtttgtgtcatctgtgttttctttcaccggtgttaagtagttttccttgcagaggtcttctgactcttttgttaggtatattcctaagggtttgtttgtttgtttgtttgcagcaattgtaaaaggggttgagttcttgatttgattctctattttgttgctgttggcgtatagaagagctactgatttgtgtacattaatcacatatccacaaactttgctgaattcctttaccagttgtatgcgctttctggaggagtccttagggtttttaaggtagacgatcatatcatcagcaaacaaggacaggttgacttcctctttaactatttagatgtcctttatttctttctcttgtctgattgctctggctaggatttccagtactgtgttgaagaggagtgctgagagtggccatccctgtcttgttctagttctcagagggaatactttcaacttttccccattcagaattatgctggctgtgggtttgtcatagatggcttttattacattaaggtatttcccttgtataccaattttgtgagggttttaatcataaagggatgctggattttgttgaatgctttttctgcatctattgagatgatcatgtgatttgtgtctttaattctgtttatgtcatgtatcacattttttgacttgtgtatgttacactatccctgcatccctggtatgaaacccacttggatcatggtggattatctttttgataggttgttggattcggttagcaagtattttgttaaggattttagcatgtatattcatcaaggatataggtctgtagttttcttttttgtgtcctttcctggttttggtattagggtgatgctggcttcacagaatgaattaaggagggtgccttctttctctgtcttgtggaatagtgtcaaaaggattggtaccaattcttccttgaatgtctggtagaattctgctgtgaatccatctggtcctggactttttttgttggtaacgttctaattatcatttcaatctcactacttgttattagtctgttcagggtatctaatttttcctgatttaggctaggagggttgtattttgccaggaatttatccatctcttctagattttctagtttatgtacataaagttgttcatagtagccttgaatgatcttttgtacttcagtcatgtcagttgtaatatttcctgttttgtatctcagtgaggttatttggattttctctttttttcttggttaatcttgctaatagtccatcaattttatttatctttccaaataaccagctttttttttcatttatcttttgtatttttgtttgtatatttgtttcaattgcatttagtactgctctgatgttggttatttcctttcttctgctgggtttgggtttggtttgttcttgttttttagttccttgatgcctgaccttagattgtctgtgtgtgctctttcaatgtttttgttacaggtgtttagggttatgaactttcctgttaacaccaccttagctgtatcccagaggttttgataggttgtataattattattgtcattgagtttgatgaatttcttaatttttatctcaatttcatttttgacccaatgctcattcaggagcaggttatttaatttccatgtatttgtgtggttttgaaagttccttttggagtttagttccagttttattccactgtggtctgagagtgcttgatataatttcagttttcttaaatgtattgaggctcattttatggcctatcatatggtctatcttggagaaagttccatgcactgctgaatagaacgtgtattctgtggttgttggatgaaatcttctgtatgtatctgttaagtccattagttccaaggtacagtttaaatccattgtttctttgtcgactttctgtcttgatgacctgtctagtgctgtcagtggagtattgaagtcccccactattattgtgttgctgtctacctcatttcctaggtcaattagtaattgacttataaaattgggagctccagtgttagctgtatatatgtttaggattgtgatattttcctgttggacaaggccttttaccattctatactgtccctttttgtctcttttaaccgctgttgctttaaagtttgttttgtcggatataagaatagctacccctgcttgcttttggtgtctttttgcatgaaatgcctttttctacccctttaagtttatgtgagcccttatgtgttaggtgagcctcctgaaggcagcagatagttggtttgtgagttcttatccgttctgtggttctgtatcttttaaacttagcatttaggccatttacatttaatgttagtattgaaatgtgaggtactattgcattcatcatgctcgttgttgcctgtgtactttgttttttgttttttttttttttttacttgtatttttgttgtataggtcttgtgtaatttatgctttaaagagatttggttttgatgtgtttccaggatttgtttcaagagttagagctccttttagcagttcttgtagtgatggcttggtaatggtgaactctctcagcatttgtttgtctgaaaataactatctctccttcatatatgatgcttggtttcactggatacaaaattcttggctaataattgttttatttgaggaggctgaagataagggcccaatcccttttagcttgtagggtttctgttgctaaatctcctgttaatctgataggttttcttttataggttacctggtgcttctgtctcatagctcttaagattctttcctttgtcttaacattggataacttgatggccatgtgcctaggcaaagatcttcttgtgatgaatttcccaggtgttctttgtgcttcttgtatttgcatctgtccaggtttctatcaaggccagagaagttttcctcgattatttctccaaatatgttttccaagcttttagaattgaattattcctcaagaacaccaattatttttaggtttggtcatttaacataatcccaggatttgttcatattttcttacttgtagaggctttgttcacattttcttattctttttgtctttgtctttgttggattgggtttattcaaagaccttatctttgagctctgaatttctttcttctacttgttcaattctattgctgagacttttcagggcatttcatgcttctaaaagtgtgtctaaagtttcctgaatttcttattgttttttctttgagatgtctatttcctttaatatttttcccttcacttcttatatcattttttggatttccttgcaccaggctttgcctttctctggtccctccctgagtagcttaactaacctcctgaattctttttcaggtgaatcagggatttcttcttggtttagatccattgctggtgaactaggtgattttgggggcatgttgaccagtcttgttttgtcatattaccagggttggttttctggttccttctcattggcataggctctatcagagggaaggtctagggctgaaggctgttctgatttttttgtgccacagggttttcccttgatgtagtactctccccattttcctgtggatgtggcttcctgtgagccatactgcagggattgttgtctctcttctgggtctagccacccagtgagtctaccctgttatgggctggtactgggggttgtctgcacagagtcttgtggtgtgaaccatctatgggtctctcagccatggataccagcgcctgttccagtggaggtgccagagggtgcagtggactccatgggggctcttagctttggtggctgaaagctctttttttgtgcgggttgacctcctgccaggaggtggcgctttccagaaagcatcagctgtagtagtgtggagaaggaccattggtgggcgatgccttagaactcccaagattgtactccctttggcttcctgctaccagggtgggtagggaaggatcatcaggtgggggcagggctaggtgtgtctgagctcaagactctccttgggcaggtcttgctgtggctgctgtgggggatgggggtgagagtcccaggtcactgaagttgtatacctaggaggattatagctgcctctgctgagtcatgcaggttgtcagggaagtgggggaaagtcgaccgtcacaggcctcacccagctcccgcacaaactgtagggccggtctcacttccatcatgccccctgcaacatccccaagtctatttctaggcagagggcaagttgggcttgaaaacttgcctgaggctttccatcttccaggttcagcttccacagtagggatgtgtgttcgggaaaggatgttggggaaaccagccccacaccacccagtgggtaccccgagtccagaagagacaaaggagttagagacagaataagtatccaaaaggcgggtccaggggaccggagcatcggaggcttgctcacggcccagagctcttgggctctgcccaatttattggtttacaagctctttgttcttagggcagatggaaggaggaggaagggatgaggaaaaggattaaacagtgaaggagaatttgtgagtcattcgataagatgtatagcagtggtggtttctgtgaatttccttgagcaaaggcatgtgtctaaactacttaagatctttaacttatcgggactgatacaggtgggagtgggtttcaggaggagcctagatgtttgattatactccactgcttcaagggagtgttatctccctgagcaacctgtggaatgccgttatgctctcggggcctaaggacatgaaggcaataaggagacttttctcctcagaggccacccatggcttcccatgggtgtctcacacagggaagaccaactcaactggcaccccagaaactctctttcccacaaaggagggtctcctttttctactcccaaagatgcagcactcaaagtatttggggtgtcgcccggtccctgcagccgccttccttcagggggtctgtggttcctctcaggattgctggtttgttcttgcagttcatctggagctaaaattcacagtgcaagcctccacaggctgctgtgtctgtggctgcaatctagtcctgcctctcgtttgtcttgatccataagtagattcttaattatggaatttgtgattattttgtttaagttatctaaggcaattgtgttcagatcttattttgccactaaaactacattggaaacacattccctaccacttgtgctaagagtggttttagtgatgcaattgcatgaaagtttctccagaaataattcagaattcttggacagcttctatttgtttaattctttggcttatctggacagattcgattttccaatgaattagacttgatcttttatagaaatgtagccaaataattgaaaagtaattttccattcattatactagttactcaatctcttaaatgattacatgaagtagataacatatttcttcaaagcataagaaatattacatatgaaaatgcctttaagaatttgaagaaaaaaaaaagtcttcaataggagttttggttgtctgcttgggcttggtttgaatgttttaacgaagcttattggtatttttggtccaaaacccagcatgactgagtcaagttgaattggacagggtttgagctactgaatctggaggttcaaaccagaaatgtgttaagttccatctcagaggttatctttatcagaaagttgtatttttttcatggcatataaatacgcttatcccaactgtgggtgttttttctaccaaaagtgctacattaaaaagaatattttctatatcacatgccaaacatgcctccctgtgaattttagataactaatttcccgcaaggaaggtgactatggaggccagctttgttgtttttacttttgtgggattttcatctaggaattggaatataaagagtatagccatgatgcaaattgaaatgactgtaagtcccaggcttgctttgaggagttaccctctgataagcatatgcacacacacgtacaacaataactcaagaggccaaatgagagcaccactagggtcaaataagaccataatgggaggcattgcacaggcaggaggactggggatatcatttgaatattttgtcttttccaactcgcatgttgacacgtgatcccccagtgttggaggtgggatctagtgggaggtgtttgggttatgggggcagatctctcatgaatggtttgctgccctccccatggaaatgagtgatttattgctctattagttcacatcagagctggttaagagcatgggacctcccttttcttttgcaatgtgacacagctacttcccctttgccttctaccatgaataaaaactcccagaggtctcaccagtagctgagcagctagtggtgccatgcttgtatagcctgcagaactgtgagccaaataaacctcttttcttaacaagttacccagtatcaggtattcctttacagcaatacaaaatggactaacacaactgggaagtcccatcttcaggaagagctgttcccaatctttttggcgccagagactggtttcatcttgggcagtttcatcccaaaactcataaggagtgcacaacccagatccctcacatgcgcaattcacaatagggttcatgttcctgtgagaatctaatgctggctgttgtgacaggaggtggagctcaggtggtaatgctcacttgcctgccgcttatctcctgctgtgcagcccagttcctaacaggccacagaccggtatcattccacagcctgggggttagggaccactgctcaggaaggtaagagccaagggcaatagcagcgtgccagcgaagaatcctaccaggtacgttaggagatagcttaacacctttggaatccagggtcctctggtaggaagatattccaccgaacctacaggccaaagtttctgtgcatgtaaggggtttattttacttagcccagggtctgtggtcctctgcttatgaactccagatacgtctggggtaagacatggaaggagagggaagaatgttgggcatggagaatcatccctgagacaccgcaaaaggggcaagagagtacccgctgtgtaaaacataataattacataagaattaaattttgatctttttcatagactggtaacctacacgacacatactaagaacttaaaatatttgagtaaataaattagtgaataatgtattaacacatagtatcagagatcagaggagactactaacattaatgatgatttcaggtgttaaagcaatcacattatgtacaatttttattgagtgtctaaaaatacatcatatccagctaataatataaacaattttccagttatacctaatactcatggagcacagtaatgactttttcaaaattgaggcattaaatgtattccagggatacaaactttgtcttaatattttatgagcaaaataattattggagctacctagcaaaggaatatgatgcctattttagatgtttacatgatagaaagcagtcaagctttaagactggtaaaaactttccaggcatattgtagaagactcctacaatgagtgaaagattttaacctctaaggtcctttattttgtttttgagatggagtctcgctttgtcgcccacgctggaataccatcttggctcactgcaaccttcacctccctagttgaaacaattcccctgcctcagcctcccgagtagctgggattacaggtgcatgccaccacacccggctaatttttgtgtatttttagtagacacagggtttcaccatgttggccagactggcctccaactgctgacctcaggcaatctgcccacctcggcctcccaaagtgctgggattaccggcatgagccaccgcgcccagcctgaaggtcctttttttaattctaaaattccatgacactgctttgggatttaaaaaattgagtgaaaacctgtccatatacagagatagttcgatgctctccagaggcacatccaggcacagcacataggatctgggtggaataaacttctgttgaatcaacctgaaggaagcagcactggcatgtgttgaggtttcctaaaagaatgcaatttgtattgatttagttcaagcactgtaaagtttaagttgtaaaattggagtcaatttctattaatttgatgatataacttttactaagcattctcaattttccctctttttaaaagaaaaattggctgtttccatgtcagaaaatacttgaagcaaaaagattaagctctgagagtttatataaaaacattcatgcacttgtcatttagcagacactcagaaaatgttagctgtattgtactgaggcacaaatacgtatttgacaagagtttgttttccttcaataacagtaggagtatttgttttgtttatttctgtaaccttggcatctgatgctcaacaaatattaaatgaaaaatcaattgtgctatggtaaaataatataataaaaagctattctaatcatattctacttttccctacttaatttctcataataatcaaacatttcagtaatagctcattttattttagtaaatatatccatattcatgatattatctggtcacacatatataggtagagaaatatcatcattcccatctggtcacacatatataggtagagaaatattatcattcccatcttaccaatgaagagaaacagaggttcagagaggttaaataatcacattagtaactagaatacaaatccctgcttcaagattccacgttcaggacattttctaataaacatgagggtttatgccagcttcagaggtacagatcaagaaaagagaaagcctgaacaatttcttctgcatttgatgcctttttgctttcttttcctttgagtttgtgtcttgtacaagcctgcagtgtaatctctatttcttcagtatctgcttgcaatcattgttacatttttatgctatttgtggataaaaatggtaagatctatttctttcactccagtaagactatccaagtttccgaaagtaagatttttccaacgatatttgttcattatggatctagggcactggaggagcctcaagagagccattgttcctgtagtagtgaaatgttccaactacccgaaacacatggttgtctagactgtttttaggaatttcctttaagtagcctacttcagtggttagttgtacagtgaaaaattcctccccacatacagacaaattttctctgggtctgtgtgaagcctattatgtttctgtcttctatggaaatgaaggacatctgcttcttttcttcttgagtagtacttataacataaaatagttaatggtctcctcactcttctttctctcgcacctcttcctaaccattgaaagtaaacttgaagagaatgataattacctaggcacttaagttagaggcattggaaagattaacttcttctcttgcttttgtagtaattgttttgaatacttttgtttttttaggaagaaatttcctaggtctaatatagcaggcatatgaccatttattaacctcttatatgaccaggtaatttggaacagagagaataatgaacaccattcctactctccagagtagtttatgatctaatttgtcagggcataataaataagtatgggacagtgagagagtgatttcatggtagcacatatttgtgtcagaacgtggtaggccctggactgtgccttgatcttatcaaagtgagacctctctaaattcctcaagagtagtgttatctagggaacactgtgtagaaaagggctatctagggagggattttaatggaggcatatgatttcgggatgagagcatttttccatgaacagaaaatggtatcaccaaaggcaaagatgtaggaatgagcaagctgtattcagagtataggggagcaggccagataagctggagcagaaggtccaatttgagaacaagatgagctcagctagattaagttagattatagggggccttttagattcctttgtccctatggtactgacctattgctaaatgcacaataattgtcagatgtgaatacacattataattcacttttttggtaccttatttttcaggtatttattgatcaataacgtgtctgaattatggattattctcaccaatcagtgtttgttttttatctttcttatacaaaataaatattttatctttgaaaacaaagctttcataccttaagaaaaccccatacatagatcatttattcattcataggactaatgttaactgagtgtccatcatggaccaagcaccaatctagatgtggatgatatagcattggatacgtaagcccatactctcaggtaatctatagtctaatgcatgggtgtccaatcttttgacttccctgggccacattggaagaataagaattgtcttaggtcacacatgaaatacactaacactaatgatagctgatgagccaaaaaaattgcaaaaaaaaaatcattgttttaagaaagtttacaaatttgagttaggctgtattcaaagccatcctgtgccacatgcagcctgtggcttgagggttggacaagcttgatctaatgggttaagctagagtaaacccctacattctcacaattctttagttccaaagaacattcaacatggcatgcaatgaatatgagtaaaataagctaaataagcaacaaacatgttttggtgacctatataccaggaactctttgggatgccgcagggaatccagagggtaatagggtctttaatgtcaatgagaagataatctcctggtgcaagaggccacaaacaaaatgacttaaaacctaagccagacctacaagaatattacaggaaagtgctgtggtttagaggagaaggagagcacttgatggtaggactgagaagaccctaggggaacaggttagggagctttggtaggatctgaatagttaccaatacacagaagaaaagacagacacaaaatgtgggcaaagtggtgtagaaattgtcttacttgaatcagaatcttgcataggctaataaaaattaactttgactctgtcagcaggaaaaagtatgcaagttctgatgatcacagagagtacaagactttctctgttccttatccatatgcttttttccctttggggacctggttgactggttcggacatccatctccctttccctgtcccccattccaaaggagttttttcactaaatttagcaacaggaagaaagaagtaaaatcatccaggtgccatccttagggtgactgccattcacttaagaacatgtttctcctcaaagtggaaatgcagaagcaggcaaaggtaaggaagtactggggaagagcatggcctggtctctgcaatctgtcgtagtgatttccagtctctcccacccactgccccatctgagaacaatgggaggattgacttgcactcccctcttacttccctccctctgtgagcccacagccagcaacccagtcctcctgtcttgccctcgctagctcctcccttggccattttattctggcatagactgaacaggcaaatatttcttcatcaattagcagctgttgaaaaggaatgagctcctgaagggcctctgaggaccaagaaagcatccaaagaaagcaaacctgtagtggtttccatggagttgtgcagcctggaggtagaaggggataactttatttcggaaacaatttaattaccctagtagcttgtttacacactacgcagagtaactaacacaattgtttctaattcttggagaacaatagatgaatttcactgggctgacagtgggacagagtgagaacaagaataggaagaaaatcctctctcacacatacctgtgccctccttactttcatggaagtgagaaacagcctttcagtggccaccatagttctaacatcaaggagctagaatattttaatatttagagatgatcagtagattatatgcttttaaatattctattttcattttaaaagcatgagcatattttagaggatgctctaagttttctttttattttgagattattaatagatcttatgtttaagtattttaacctttattgtaacatatagcacagaacaaagagccacatagaacaagtgtaaggaccacaaaagtcatcaaagaaaactttgccagtcaccccagaagttcctccatacgtctcatcagtcacagcccccaccctccctccaaagtgacttttcattgtaatcaattctttgcatttcttgatagtttttcatgcccaagattggatccttggacatcagtttcacttgttcattttcttttaaacgtgatgtcttttaaagtccctttcagtgtgattccacatatccttctgtgttcctgcaagttggcctctgtgtctggagactggactcaggtttcatccttgaggcaagataataggtaggatcagtggggagatttcacaaaggctctggtgcatctgtttagtccttcctccattcccatgtgcctcttccacatagacaccagtcacacaaagaactcttagctgtttgtggcatctctggcataatcctgttttgggaatcaaggagttaccttgacacctgtctcatggtaaatgttttccttgggtttctggcctcaataagtaattgctttgtttgtctctgtgtggatttgggaggatccaaaaattaggctgccatctctcacacatcttcctagaattctgtgaagtatgactctcttttaatcatattgaatgcattttgaaggtattgattcctcaattattgatgagaaaaacacttgacacaaatcactttactggcagcttttgaagaacacaccctgtatagtgaaagatgcttatctggttgttcattattccacagttaaattgctgccagaactgttggtagcactgcattcattcttagatatatatagaaaatcacttgtttaatactccagtgtggatctataagcactcccacccctgaaaccattcacatgtggataggaaaaatatgaagaactggccaggcacagtggctcacacctgtaatcccaacactttaggaggccaaggcaggcagatcacttgaggccaggagtttgagactatcctgggcaacatggtgaaacccccatctctacagaaaaatacaaaaattagccaggtgtagtggcaggtacctggaatgccagctacttgggaggctgaggcaggagaatcacttgaaacgggaggcagatattgcagtgagctgaggtcgcagcactgcactccagtctgggagacagagggagactccaaaaaacaaaacttctgtctagatagactttattgaaagcttacacctgagcacggcttttctttttttttcctcctacctgactgagtgcagccttcccactctttgttaccaatatctaaatgttctttcccacttattcagagcctgtgatatcctctggtttcacatgcctggtacacggttttccaggccttgatctgcctctgacgctttcaccctcagcttgttgatgtgagagctgaactcatgcccatttctttttggaggtggccttttcttcaccctacagtggactggttggtttctgttgtcatccatgtcctagcattgtgtatatcacaatgtggtctgatgacactgtcacatgtcatctaaaatttccaaaagtatgagttaaagaatgtataatttcccaccacatagatgaactaaaatatgtttagttgtgcatctaatacctgtagtttactttcagtttttccgttaagaaacacaacgaagtttgaaattacttttttccttaaaccaggaaagaaagaaagaaaacaaaagaaaaacagctgtaacacctctgagtttaggtgcataatttattgtaaacactttattttgagaggggcagttgcagttttgggggatcactgatacctctttcctcaaggggctaactttcctggggaactccctgcttccagtaaaagctccaattctaaatattgattccagaaaataagaggccacctctgtgaggccagaatccccactggtcttgtcacctttacagtcagcaattcctctaagacctctttatttctggtgggataatatttccacttgaacacctctttccagtgccagcacagggcaatactgtgtcagcagtgttctggaggactctgagttgttcagatgttgttactctgacagggcattgaaaaggaatgctgtcataatagagagcatgagaaatcaaacaaaatggagttctcctcatgcttaaaatgtagagtctaaaacctaatgaatggtctggacccagacctacctaattaacaaatctgcacttccggcacatgtaccctgcaacttaaaaaataaagtacaactgggggaaaaaaacagctctgttctgtgttgagatgggtaatttcctcatctccaaaggatgctgcatcagcaggggaactcactgggagtttattcccagcttggagttaggattcactgcctgagacgagaaacaagacctgctgggtagtaaagctggagggagaagtgatcagtgggaagctcacaaactggtaaacagtggccccaggggagggtcaaacaatcagcaaccaatttgtctgaatggcccgttaatcagtcctagctggatcagacagctgagttctaagaggggccacagtgccatgtagaatcactgaaactgcttttaagcttagcactctgagccaatccccagtcttaatgaggtgctcttcctgtgtgcttccagtgccccttatatttcctatcatagcacagatgccactggattttgtttacttatccttccacaagcttagaagctctcaaaaatactcttttgtcttgctttggagcccccatacttgtaggtcttaaccttggctgcatatcaaaactacctacagcccttttttaaaaaaaatgtagctgctggagctccacttccaaaattctaatgtaattgtcctggcatggagcccacccttgttttaaagttcctcaggtgtttccagtatacagagagggtgaggaatcatcctaaccaagttttaatgcttgaaatgcaggtgcccagtgaatgtttgatggatgatgactgagtcagtcctggattcagtcaaccaggatgcagctagaagacagcaggatctggtcaaacctgtattgctcgatcgcttaaatgctttgcgagcaatatgccatgaaggcaaacttcataacattttctctccgtataaacatcattcatggacattaggccagtgctacttgcaactatggatgacaagcctttgcaaacagggaaaataaactagagccaagtgttataccctgggcagagcactgtctgcctctgccttctttaagaagccaaaggcatccgtgtgtaaaaccattatatgacattgctaggctactcctgtttcccacttctggtgagaaagactttgcaaaatacaacaaatctgtctttggctattggtttgttattgttattaaagtataaaagaaaagtacaattagtgagcaaacattctattacttgtcgttgtagcaagtcatcttagattctatattacatttctctgaagttgaatcaatattttgcttttcagcacagatttctagcaagggcctaagacttggaatcttattgaaaatgacagaatatgatatgacaaactttgcaaagctttgcaagatttcacaaaacaaatttataacttgaaggaatttattttaaaacaaatttaagatgcatgtgttccatatttaatcagtagataacttcaaaggtcatgatgatcctataaatcatttgtgggtttcttaggggaacctagggagtcaaacttactttgtcatttagttagccttaatttttaaaaagaaagaaacttgagctatgcaagtgcattacacaaacccagagtttcagagcaagtacgcattagagatgttaaccaccagtgtttgacgatttgcgtgcggtgaactaagtgctttacattgttcaatcctcgtagtaccataaaaggaaaaaactatttcatttttccaatgaggaactaagagttaaagagattaaggaattgctcaaagtcatgctgagttaggagctaaatctcagtcttgagcatctgaccctacagcctgtggtgtcaaaccctctgctgtgctctctttctactgggaccaaattgagttgaaggtgctgcgttagccataggaattacatggatgaatgtggcacatactctgtccttagagagcttacaatttaccgaattggaaatatatgtattttgtatgcaaatgactataatcaaaatagaaaatactaagctttaaatgaattatacacagtcatggtttataaagagactatttcctgtggagaaatcagggaaggttttgtgggaaaaaaaattggcattttcatcagcttcaaatcttaaatttagttttttaaaactttttaaaaaattatgtaataaatttgacttaaatgagttggtatctagttctatgtcaaatcctgtgttatgaatgcaagtaatggttggtagtgacagatgtatgataccaaatagttgaagagtagaatgaattttaagaatgcgagagaatcttggtttgccagtgagaaccaagccacagatcacagggatatactaggccacagaaattactagaagccagtattttaacttcagaacactgtttcttatctctgtttctccatgcttgtttgtcctttttcagagtcagttcaatacattctttagaaagaaaaaatattattaatcctatcttctacctgggagttcctcagcacagtttgaatttaggagattgttagagtgaccgttcttgtagagaatacagtctttggaaattgagatctattttttattttttaaatgtttcagacaaggtattagtccattctcacactgctataaagaactacctgagaccatgaggtaatttatgaagaaaagagggttaattgactcagttatgcaggctgtacatgaagcatggctgggagacctcaggaaacttagaattatggcaaaaggcagaggggaagcaagagcatctttccatggcagacaggagagacaaagggaagggggaggtgctacacacttttaaacaagcagatctcttgagaacccattcactgtcacaagaaaggcaagggggaaatttgctcccatgatccaatcacctcccacccgttccctcccccaacactggggattacaattcaacataagatttgggtggggacacagaaccaaaccatatcagacaaacagtagtttttatttttgtgtgtttatttcataacttctcctcaaaaggaacatgctctccttgcatttatttgaaaaaacaaaaagccagtttctctccactaaacagatgaagttcaagatttttagaagacaatagcattacgggataagtcagaaaactgaaatcatgtctatgtattccaggtctttttccaaaaaaaaacacttatatttaagtttactataaacattaaatgagttgttaaaactaatgtaacagaaattaaatagatcatcttactcaaataaaaacaaaaagacgtaaaggaattaacatttataagcaccaaatatgtgttagactgtaatttcaaccagtgtcacctcattttgtcctcatgatcttgtgaagggagtgtgactatttccaaagataataaaacatgaatctcaggaatgctaaaatgattgcccagagcacaggtatgtggtacagccagaattcaaatgcaaatctttcagatcacaaaaatatcttccagtagagttatttatgtatatattttattcacttctctgaaggtacaggatgtgatgcactcatttttatttttgctttctcgtttatatttctcatcacctagcaaagtggcaggtttaatgtgttaacaaacaaatgaagaaatcatgtttgtttttagtctatattttttatatatttcagattccagattcttattcagcactgtgtcacgataaaaaacaaaatacactaaggaagaaaaggaaacactgagggtttattgcattataccctctgtttattgtatctgctgggaaatgaaaccatatatattctctatttctcttctgacaaatgttattcattctgttcattacagttccttatcttgctatactgtccttgctgaattatgttagattagaccaattattgatttaaaagatcagagcagtacattaccaccctcttgccttttctgtaggatagttaaatttgtgtatgcctgcttcttgcagagtggctgcttcaaagtgatggtgagagttacattttactatttcaacattagcttctaatgtttctgaagtctctggtattaaatgagttctcagccaaatgttctgaaccctgggaactactgctgttaattgtggtcatctcttggatgtgtttgcattgttgtccataactaagctgatttcttttcatttcattttttaatggctttttactgctgctgcttgagtattttcctgggtgagcattcttgattgattactggaatgaagtcagttctgtcttctgctgtcacccaggtaccaattattggatcactgtggacactgctccatctacccattgatgtgcattaccaattttcctctcaacactgttcagtgactcactcacatgctcacaaattcagcaatttgttcatgatagctgcttggcggggtggataatatcctggtcaaaatgactgagccacatcagtgatgtatgtattctccagacagggaaaccacagggttttaaatcaatgaactgaacttgtcatctatattttcctgctctagttttctggttctttttttatatgtttaaacattttaattaagtgctagatgtttgttaaacaattcagataatatgagagtgtatgatagcaaagctaatacactcagccaacaccatctgtgtgtattgtttattctcccagaccttcaatcatacatgtacaaatacttctttcttccccctaaaattgagtaatatgcatgtaattgtccagtctcatgctgctaataaagacatatccaagactgggtaatttctaaagaaaaaaggtttaattgacttacagttcagcatggctggggaggcctcaggaaacttacaatcatggcagaaagggaagaaaacgtgcttcttcacatggtgacaggaaagagaaatgctgagcaaaggggaaaaagctccttataaaaccatcagatctcatgataactcactcactgtcatgagaagagcatgggggaagtgccccatgattcaattacttcctaccaggtccctccaatgacatggggagattatgggaaccgcaattcaagatgagatttgggtggggacacagccaaaccatatcagtgcatattgtagtttttttttaaatagatcttatcttatatacaaaagagttccttcactgtttagtgtgcattcacagtatgtcatatgatatatgatgatgtactcactagtttactacttatagacatatcggttgtctttagctttttttttgagatggagtcttgctctgtcgcccaggcaggagcacagtggcgcgatctcggctcacttcagcctccgccttccgggttcagcaattctcctgtctccgcctccctagtatctggaattacaggcacacaccaacatgcctagctaattttttgtatttttagtagaggcagggtttcacgatgttgtccaggctggtctcaaactgatgacctcaagtgatccacccacctctaaaaatgttagtcatatgtgtctttgtgtatttgtgcaagtgtttctgtaaggcaggtttatagaaattgctaggtaaacagggatgaataatattttaataaccaccaaaataatagctagcaactagactttacatatgccaggtattttaagttcttttcaagtggtaactcatttaatctttacaacaattgaaataggtaagaactattactcctattttacagatgtgagatttgagattaagtaacttactcaaggtcatctagctgatacttagcgaagcctggattcaaacccaggcagtatggcccagagaccatcacgtaccttttacatacactgcatcactattaggtttcatctccaaaatttgtgtttcaatgaccagtttttgtttttgtatcagttattccatcaatctgaccaatagtagtaagtattaaaaaaattttagacaactatacttttttaaatttagcattaaaactgttttaatcttggcataacttcgtgatgtaataggtttgatctgtagaaaatcacagggatacacgatgaggtggcatattaagtgacaaaatggatggtatggggagaatacagtagctacaagtggccatcagtagtgttggtcagagtgattggggaagctatgtggaggtggcagagctgggaagtggagtagtatttgcatatgtgcaaggaaggattgtaaaaagggatattgctgagtgtgataagaggtaaatttgtttacaattgatagaacaatttctaaagcttaggattgaatttaaaatttccactcaaatcagcaagagcccttgggtttagaaggggttaacaggatgcaattggttaacaggatgcaatctgaaaaaacacatatagctggctaaaaaaaaggtcactggagactcccaattttcagcaaaattatgcttgaagagaaaagtaagcagagatggacagtatattcaagaaatctgattaagataacacctaaagaagagaaggtccatccataggttggctgagttcttatttctgaaataatctctggaggaacttttaagaatcctgaaagattcaactattttaaactcttctggaaaagtatatgcatatactcctttgaaaccgctatgattgtaagtaagtaagttataaatccctctttcttgataactgttatgctttagccagtattaaatcaagctctcttaatacacgttttgaaatgttccaactacatttattttatttttatttaaaaagtaacatggaattggaaaacaatagaaaatacagagtataaagatattactcaaaaaattaagcttgtgttatattttttgtaatttaatcttattttaaatgcttcatcaggcttacacacaattatgtatccatttacatgaccttgcaacataagtattttacatgatattaactctgaactgtcaagtttacaactgttgcactgatcacatggatatctcatttaatgatttactcagcaattacaaaataagtttatttctcattttcaaccagaattttataaaacaccatctgtcacatatattttgaatagtttcataattgaaattactaaactcaaatatgcagaaagcatgtaatacccaagttgctttccacctggaatcattgttttaatttctcttcccatcatcaatagtggactcgagtagttatatttttcacaaaatctctagcattaggtggttgtatttgtttaaaatatatgctaatgtgataagcaatgctagataccttaaaggtgtggaaaggttacacattttccacatgaaccagttaaatttctttttgtgaattgtctatttctttcttcatttagagtttatttatttatatgacttctttatacattagggatagtaaccgtctctctgtaacatctgttacaaaacattttcccagttgacagatggatttacaaatgttttttgtttttaagtttgtgatttgatttcaagttccaaaagattttccacatacagatatcaaatgattcctgtttaactttttccccaatagtaaaaactcctcctagaacattcaattgaataatcgtgctctttctcattgactccattcatttactctaatttcgcacagtcttattttgtttgctttaaaaggcaatttttaatgacttacatgtgttattgttgcaaacgaagtggatatttttgaaaaatcacattttaaagctaccctccaaatatgaatgaggtttgaataggaatgagcattgaattttatcacaccttattagactttgagatatttattagggtaatagttgaaaccaatcttttcttgttactataagttttaataagctttatttggtcaaaggcttgcattttgtcagtatttcacttagaatttttatacttatatgaattaattcagtggggtcctaattttgtgcttgccatgtcactattatttagaggttatattcacataaaattaggagattattatttgtctctcaagaacaagagacttctaaacaattttagaagcagacaacataattacctacatagaaagcataaatagatctatataaaaacaattagaagatttactcactacaaaatcaatagcttttttacataatagccaattagtatataaaattaaaatatcctgtttaaaataataaaacagtatacatacaaatgtagcaaaatatgtataaaacctccaaaagattttgaaattcagagcaagcaatctataaatacaatgatcaaaatcccaatagttgacatattaaaaaatgtctattaaaattgtgttgctattatttactaaatattaataggagaatgcatgaatcataaaatattcatgaatggtatactatacagtagtttaaaataagtgaattacaatgctgtctatttaacatggataaacctcaaacaatacctagtgaaataaaactgtacaatgatactcataatagtgttttcaaatattaacgaataaatatttatggatccataaaccgagtataaagacattcaaatgtaagtttctgaattcatgataatggagaaagagaccagggaggagaactcatggggccttaactatttgtgtaatatcttcttttttaaaaagctaaaaatcaaaatagagatataaatcatgataaaatgccaggcttataacctcggtttatcatgtttaatttacaatttatcttttaaataatattctcaacttttctaattgtgtcactgtgtatttggcaaatatttatctagtacgtactaggaactgttttaggtagtaattaagcatttgtgaccagggcaaagatctttccgttatggagcttatattttggtgggagaaactattatacattgcaacatcagaagtgcttgaagaaaaataaaacagggtaagaactccagccccatttcctgttgccccagctactttaattaatagcacaagtagttccccagagggacttggtggagagaggttgctgattgtcatactgctttcctttttaactcttaatcagatacaataatgttcgtgttcttctctttccttttatgaaactcaggtcaattgacttatttttttagactctggctataattgaaaagctttctttctagtgttaatatttttctctcattattgctagtgtcttattctgttttaacaccatattgcatagaacttgggtcgttgctaatacccacatccccaaactcccaagactttcataattaaagggttgtcatgagcatctctgagctggcacaaagcaaattttcgactctataggcatctattcaaagaatttgaatctctttgaatctttttgaatccataatttccctgaaaatatgtaactttcccctgtagctgttatattacaagaaagaatacttttgtgtggtagtcaggtagtcaataccaacactcactacaacccaacagctccggtcttaggctctattggctgaaatatgtattaatttttctgggcttttgaagttttgaaaattactttttatttacacatgaggaaaaactggctggattaaaattctaggatcatatactgtctccctcataactaggtattgtgtaattttttcctgaattttaggaggaaaaatacagggctgccagaatcttcttccttttcttcttggatatttattatatacttagacattttgccctttatctgtaaacatttcatccagatatatgctggtatagtttatacttttctaatttttctgaaatgcaattcttctaaaaattaaacttttagctcaagaaattttgttgtgactaattttaaaaatcctgatttatttaggaatactgttttcagagagaagctatctccagtgagttctgaagatagtatctttttcttgttctatagaatttttgtttcagatgccctttattgggttttatatgttcactcatcatcaaatgagatgtatttagacatagatttttcaatgtgtatgtgacctggattaaccttagccactttttaaatttttcgtgggtacatgagatgttttgatacaggcatgcaatgtgaaataagcacatcctggggaaggggacatctatctcctcaagcatttatccttttacttacaatccagttatactcttcaagttatttaaaaatgtaccattcagttgttattgactatagtcaccctattgtactaccaaaaagagggtctgtcttcttaacttcctttggttactgatagatgcagtggtctgaagccagggctgtggggatgcatagtcccatgactgactgacttcatctgaactaacttggctcccattactatatttatttacctcagtgatcaccaagaagaagacatcctgatgctctcatccttcaagatgtattattccctagtctcttcctgcttataatgcctggtgggaatacacactgccatatggagaatctttttttacctccacctctctctgctcgatagtcatgtttgctagtaattgtggtgcatgaatagatttgagagatgctgataggtcaagtcaaatagataatgactgtctacatctgaaacagttatcaggcattagttggggttgaaagttgttttgtttatttttccccaactgctgtgtgtttccaggtggaaacaagtaatggtgactggccaaatccacatgctacctactgcccaagttcttctcttgtttgacaatctaaccaattctgtggattccaaaagacaagctagtttgtcagtggaaagaatccagaactgaaaaataagacctaccactaatattgccccctttattgaaatgtgttcaaaatactaagcctcaacttctttatgtctaaaacaaaaagactggaccaaatgatttccaaggctccctttagccctaaaattcttccatctaaatatgtttcaatcctaaaatatttaaagttaggatacctaaattcccaaggcaattctaaaagataattaaccaacatggtgacttacctcatggatttcttactaacctctcatcaatttctcagcaacacacttcagcaaactgtagccatggagactcacttaatataaagtagtagatataagctttttcaatcaatcagcagtaagtttaaagtccagaaagccatgaaaatagggagtcctaggaaacaaagttaatttaagtatgtctacataattcctgtggagtttgtgacatataccaatgttacagtcagtgatacactgcatttcaacagtggtcccataagattataataacataacaccacacatgtttgtggtaatgatggtgtaaataagcctgctgtactcccagtcataaaaagtatagcaatataattatgtacagttagaaaagactcaagttaaaaattttaaaaaatgatgttgaggattctgaccctgtgtaggcctgggctaatagtttattaacaacaacagcaacaaaagcttttaagtaaaaaaaagtctttaaaatagaaaaaattttacagaataaggttataaagaaagatgatgtttttatacagcttgagctatgtgttactatgaaagagtcaaaaggttaaaaaatagtttacaaagtaaaaggttacagaaagtttactttattattgaagaaaatcttttataatgtagcctaagtgtttagagagtctgcagggggtacaataatgtcttaggccttcatattcactcatcactcacgcattgactcagccagggcaactttcaatcccacaagctccattcatggtaagggcccaatataggtgtcttgtttttatgttttatactatatcttctctatgtttagctatgtttagatacacaaatacaggtgttacaactgcttacactattcagtacagtaacatactgtaaaggtttgtagcctaggaacaataaactataccctaccacttagaagtgtcataggctataccacctaggtttgtgtaagtacacttgatgatgttcgcacaatgaagaaatcacctaacacatttttcagaatttatgcccgtcattaagtgacatgtgactgtagagtttagtgaagtgaaaatgcaaaataaatgtcagaaaatcttaagatagctaggtcctatataaaagtaattttttaatcttttgtttcatatcctgtcttttagtgtagccatattttaaatgccattaaaactaaaccaggtcaaaatttgctttttcctctttgatgtaaaaaagaaaaaagtggaggggcagggaggagggatatggggagaagctgttcaatgagcatcagagcacagtatatactatatcttataagttagagatctgaagtcaaatctcagctttgctctttattgacttaaacaggcaactaacatctgaatcccagtcttaccatctgtaaaatgtaaacaataccttacaagatcttatacctgaagcacttagcacaatgcctggcatacataggtaataaaaaattgtagccattattgttatcactgccatgaattcttccaaatatatattaaataacatggaaataatgagcaaagaccagggaagaaagcactggaatggatgagagagtaaaaaaagcttaagtcattgtccatttattcatcatctaccatcttggatgatgcctaatgacttacagaactgaatgtggaggtaggtcattccaatccagagtcctggacctgaagatggaggagctatggggcagatgagcttgatatttaatggtgatattgccagagtggttgaccttcataaataatctacctccttgttttgtggggcccagcaaaggtgcatggggccagattcaaatttgtcagaaacctaagcaattggttaacttataggggtcatttgagaagctgtaatgtgttttctatatcatgtttcatataggtcattaccaattaaaagcattatatgagtagtcattattaaatgtgtgagactgttcattccctcacatagcatactaaaattatggtaggtgagagattccagtaaggtgcttattaatcccgtgttataacgacagtaagcaggaatttttaatcctcaaaagctgctcttctgaagagaagttcaaataaagcagacaatgagctctttgagcttcctgccctctgtcagtgtatgctcacaagggcactactcattcttgaagtattcatgacccaataatgttagtgacaaagggcatgttgtagacacacagatggtgatttcacatgtaggctaatccctatggatttacaataagcaagactatataacaggcaaagcctctcattaaatttttctgaattgctcactaaaactttgttgaataaagaatatgatgttagattatttccatattcaaatccataggaaatggaaatataggctgcctttttgagcaaataactagtcaattgagatatcctgtgttcaaagtgctttggttcaatttcatttttaccctgggatagacaattgacaaatttcactgtacacatcatattcaaggacatagtaaagcaaatcttccgaatgtgaggtaaaatatgtggcacaatataacacacatgtaactcacatgtgactgaattaagcagcttttagagtttcagtaccaaaagcattaaatgaatcaacggaagtatatgtatagttcttttcacagtaatacaggactatgaaaataacgggagccaaactgtgcaaagtaatctggataacttacggaaaaagttaaaattccactgtgacttttaaagacattttgtcaaaaaacaaaacaaaaaacctcttactgtcaattataaacatacagggaaatttaaaatacagtaaaaatatttgtctaatgagttttaatgtaaaagtctttttaagagtagtttgaacagtgtttgcctctttcttctcatggtatagtaaggggcaagcagcttttctatgccttggaaatggatccaaacttaggactacgacaatccaccagcattgtaatcctttcagctttttatgtcatcacctacctgagagttccttaaatgtgagcctttctccatgtaaattttgctaagatatctgtatctttctcctcacttacgttaataagcccaacttcagtaacctccttggatgcttatctagaatctctccaatggcagcagtgtcaacaatccaagggtcagtaattgcttagattaactcatttgcactctacgcatgtttcactctagcattatcccttatcctttctttgctgcactttgatctttcctggccaagtccatcttttgattatccaggtttgtaaaataatcacatgggtttgtaactgcgaaacaaagtggccacactttgttgtctgtgtgtgaacaggaacacagtgaccattcacctgctttgaaagaagagactggtcactaatgacatgtatctgctatccacacagtgattactggactacagaattagcttgtgaagtttgcccttcatgcaattacacacatttaatataccatggtaactgaaatttgaaatggtcagaggacactaatgttgtttaaactgtggaagcaactactgtcagcctatttaatcaacaaatatttaattgtccacgtaatgcacatcaaagcattgtattgtatgaatgagaagtatggattactaataataaaggcattctgttaaggagaaaaatctgcataattaactgtaatactagctatagcatgagtactagagagtggtataaacatagggccatgaaagcagaatcattcagtttcaaagtgaaaattctaaatagcatgactattaagcaataacagcaatgataatcaatactttctagcccattgtttctaacccacaattgtcagaaaatttatgttcctcattgcactttagggttgtactaccttacacagccagttctcaagactatgtttgacctaattgaagagtaaattttgtcttagaaaaggaaatatgtattttgagagtctagtaaatgtttccacccaggaggtttcagaaaagtgttcaggcactgctgagtacataagcaagatttttaaagcctctgcccctgacgtcaatataaccctcaataactgattgaaaaacacacacacaggtagggtgtataaatggaagaccgccgacaagcaatttgagaaaggaaaaacttacattgtatacgtttagagtcccttcttaaaggttttaggcacatttccttagacgttacttgttttaaaacagcataagtcttccttcataactaaggacatcaaaactcacatattgccctacttagaatgttatggccaggtgcagtactttgggatctcccaatccaggttcatactgtattagttactcgtgctgcgagaaaattactcatttcttaaagtttcattctgctcacattaaagctttggctctattctcggctgggcatggcagctcacacccataattccagcactttgggaggcccaggcatggcggtccatacttctagtcccaggtacttgggaagctgaggtgggagaatcacctgagccctacaagtcgagcctagagtgagctgtgattgcaccactgcactccagcttgagcaacagagcaagaccctgtctcaaaaaaaaaaaaaaaacctctctcccaaaagcaggctataatcatgccttcagtagtacaaagagtaaaagataaaggtatgacctcctctcatgacttctttctcctggtggtagtctccctggtgttggggggaggaaggaaagaaaaaagatgactccatctgtacttcagtggtgaggggtcattgtctatttcgttagtgtgaagggttgttctaaaattcttatgtccaaagtgaccactttctgtcttccagtccttttatcatcaaatggctgtgccaaggagagaggcccttgtggtgaattgcctcatctcagcaggttctcttgaaaggttttggcccaaatcttgatgattctctcaagatagaaactgaaagtctttcagaatcttttgttccgggctttcagcatttgccttcatttttatgaaaataagatctttattaatctaatacattgcaaatgagattgcaaaagttacagtctctgtggtagaaattaaaacgccacataactttgacaaaaatactatgcttttaaaaactatactgtaaacttttgtagcataataattcattatagtttataatagcaaggaattaaacaattgaaatatggttaaattatatattcatataatggattaaatgtcaaacattaatgttttattttccaagcctgtagtcgttgatgtagtgacagctttatctacactgaactggaatgacctccatgatacatttttaggtgaaaagataaaggcctggtaacaaatagctagagcatgtgcttcagtttggggaaaaatgtgtatgttcataaaagatatgttaatgtgaatatagtaagaggttggtgttatcctcatttcacaaataagaaaacagaagcttaagaaaatagaatcatagaatcagtggtgacatactgtgatttgaattcatgtttatctgaaccgaaatcacaggccctttccaacacaataagtttaacccctgactaatcttttccaggagacagttgactttttaaaatgctatcggtacaccttataaataaattgttgtaatatatttgcatgtggggctcccctggccaactatgagtttcatgaaggcagggaccctaacaaagctacctttctgttcccagtgctccggtatggcacattgtggaaaagctcttaaagtaataaaaagcaatggtgcatccttgtgtgcaagaaatgaatataacttcattaagtggctagtaaatcaaccctagttctttaaactatcataatagtaacagaatgtcttaggatttctgcaggcccaatgacattttagttcaatggggtaattattacatccaagcttcaaacttgcatttcatacttaagtgaatatttatcatcacctattacgcactattaatggaaagaactattcatttccaataatacattttatgttttttatgcatagaatgaaattgtccattattaatgagtctgaaagctcaggccagtaagcctctgcttattttcaggtcgttcctccaaagatgccgtgggtcagatatctgttcatgtggacatcactgccaccccaggaacgggagatcataaagtcactgtaaaaggtatacttctggtctagataaatcaaaacagccttctaaacttctgcagcagtactgatatcagcaatgtaacttttcttgcatttaaaaaaactgcacaattattttagggcatgcacaaaatttcctaatgaaacccaaacttttgattaaaaatagaaaaatatcaatggcactaatgtttagcatgcattattcaaaatatataaatacactgattaaatatccaaacttactttatcagatatttattttgtggttggtgccatgatattcattgaacacttgcactttaaatattaagtcagtatgttcttactattcacaaaacctactgctttttctatatgatttccaacaactggcttagagttctttacaatgagtggctcaatttgttggttttacattgtaaaaacagcctgaatgcaggggtaatttcaaagatgaaattaaaggattagcattttgttaacaatacgctcgttctatttttatattagtcacttcaatacccactttgagcaaaactagggctgcccaatatatttcagaattacattacatattgtatctttacatcataaaagtaaaatagctatattttagaatagattatatacagtagtatatactgtcaatttccttaaatatttttgaaaaatgttgccaacgtgtgaaagtttaatgaatattttgcagtagtgattttaattataagacacttcgcttgaggatgagcaaagatatttacacatgagaatcttcatttagtattttttttatgacgactgaaatttaaaaacagctataatatctaacaagtgactggctaaatataggatgaaatagccacagagcaaaatattattagcagttgacaaaatatataatgaattagaaaattagccatgatagacttaaaaaaataaagctatttataagattgcaacacattataatatcattttgtatataaagtaactaaatattgaaagcatacaatccaaaatattgtcattgactggtaaatttatagattttatctatttcctgatgagcatatcttcatgttcaatacgaacaacaccatgtttttaccaagaggaggagagtgctaacttttcattagtaacagatatcattttaattgcagctaactaacttttcaccaaagctacacagcttaaagctgaaagctccatcaggtgtgccttccagaaagaaaattgtattttattgtcttggagtacagtgtcttgtcagtggagttagggcactattattaagttttggcttcataaatcacttttaaaatttcactctaaatttccacacatctgtttgctaaaatgtgatatttccttttttttagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttgtaagtcataaacccaccttacttattctaccaggcaatagttactgtacagctgaccttactgagggatttggagtgtgaagggctaaggaaaatgaagaaggctctgtttttagttcccttccattcattcaatatctgttcagtgcctgccatgtatcagccaatgttatagtcattaggtgtatatatcataggaggtgtctgaatcaatcttttgcagtgcactcatataagttactttctacagatgaggagtgtatgataaagtcacaaatatttgtcatatggcattaaatacaatatgcagaactatgtggtaagtgctatgactagctgctttgcctgggaggtcagggaagcctctctgagcatgtgacttttaaactgaaacctgtccaaataaaaagccaggcatggaagagcagaacatttcagacaaagtgaaataaatagctagtacaaggactctaaggcgagagcaagtctgggatatttaagaagcagcacatcatagataaaggagtgagatccaagtgaggccaaggtacagatagtgtgtcacatagggcttttcaattctaagttcaataggtggtccactgaagggttttcaaatgaacagatgagatttacatctttattttgtttgctgtgtacagaaataattatacggtggcaagaccaaatatgtaaagatcagttagaaggctattgcaatagtccaggcaatagctattagtgactaaccggatcctagtagggagatagatggagaagattctgtatcatgtgtggaaagtagattcttgccataggctggaggtagaacatgaaagagtaattcccgaaaacactcagtttagagtaattcaaaatgagcttacttacaaaggaatttacaaagtggttaagagtagagaaatttgagtaatcatgggaactggggctaatagtaaccaggctattaccatacttatgcctgaaaagaggagagaaagagtcattactaaaattaggaaagtgaaaacttgatgtatgcttgaaatgtattattgaaatacactattaatggaaagaactattcatttcttttcagtttgatgtatacatttcaagtatacatcaagtttgaaatgtatacttgaatgtatacttacttgccttgaaagcagcagtgacattccatgaagggcaacagcctactggaggcagccccacaggcaaagagccagggaaataaagactctgacctcactctcctcactgccaacctcttgatggggttcccttttggccaaaatctaccggaagcaagaagaaaccctactgagatatagtcccaacagatgagttttctattgcaaacagcattctattgcaaacagcaaaaaggagggtggatccacagggggaaactgggcgatacctggcactgaataaaatcaaagatgatccctaagtttttggcatgaggagttgggaagatagcaatttaccaagatggaagaagaaatgataaaaatgttttaaatctattaatttggtgatgcctgtcagactctcaagagatgtcatttaattcaacaaatataaataatctaacctaggaatggatacatggagaggttaagaggcctaggacaaagccctaaggatttacacgccaatacactctcttacaggttttttgttcatgatttcctatagtcgtttcagcactctgctctgaatatttcaccctcttatcacgtattaaaactgaagtatcctactctatcaaaagggtcctaatagatcacattccctgccaataaaccagcttacaacatttcactatctacttcaacttactcaaaaacctggacccaactaaagtttcttgttagatataacacagtgagctacttaaaggcagcatttttaattcatgagatctgattcccatcatattttgctcttctactcttatcccctagacttccattttctttcacattatttcagattctccctaaagtacaaagtttagttaccagtgtttcctggaaatcaaaatgtttcatcagaaaaaaatcacctgtaaaaggaaggaatttggaagctggtactgctgagggctagatgtacattcattagaaaatcaagaatatgagaatgaacaaaaataaggggtggaggaagacagactgtatctaccatatcaccacttggccttctttattatgttgacactaacaagctgtcttaggtggttgttaggagaggccacacacttgacaggtctaactgttaccataggaaagaatcggcattgaatcaccaggctctgctggaattgatttactctggatggagatttgtatccaatttagcatattgtgaatagtgcttgatgggctgtgcagtgtattcccctgagaaaagactcctagatataatagcttattcaagatttggaggtaaagtgcgaggagtagtaactgatattgaaatggggaggtaaagtgcgagtagtaactgatattgaaatggcatataaattctaccaagaggtacccattaccctggcctagcccccatgacccctttccaactccaccgcacccgcaatcaggagattctgcctcgactgattaagtgtaacatagtatcttaattcccatttttttctgtcttttctatctagggaaaaagtcattttaacattcgctttctaagccaaatttaaagggttaaaatacactgatatcctatttgccaacataataatcagatccaatgtatacagttttcagcagtatttgagaaccataatgatgcctagtggaagtaaagtttttgctcaaaatttgtatttttaatccacacagcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagca

SEQ ID NO: 1404 - DNA, 35850 bp, Homo sapiens
ttaaaaatggtcaaatctcttcaatgcagcctacctcagttcccaaggcccaatcagatacagctctccaaacctgccagtgctggtgaacgcgctgctgggagcactggcaccccacagtgggggaggggaggggaggggaggggagggggccctctcacctctatggggatgtagagcatgaatcctggctctcctgtgtgcgtcatgctcatcacccggatcccatttgcatagcccacgctcatctcctgcagggacaaaggcagcagtcagcctgggcactcacattgcttgtcaagggagggacgcctggggaaacctttcattagtgctgcaccctctgtttactgttgagggagacagacgtcaaggcaagaatttcatcccaaaagtggttaacttccaggtcctgaggcaccgagaatggagcactgcctatgtgacatctctgcttgctactgttaccatctcaggagttttagccaagctgatggtagagagtggaggaaagtccttgacaagcacaaaatattcctctttgccaggtccttatgttagtcgagggtagcaggcacaatgaggacaaggcgagtgtcttctctgggggaatcggcagacaaaccctggccacctgccatacaaaagatgatgcccgatgcccacagacataattaatctgctatcctggggtcaaagatgggcttctgattctcagaacatgttacatagcagctcagttccctaacagcggccactgacgcaatcactgttcctataaaggaaagtggaaagtcctggacagcaccgaagtgaaccgcttccacaggaggctgacaggatgcagcactcgccaggtgttgagcgtatgggtcactcctccaagcagcagagcaaacgctgggaggggtccactgatggctaacagtggaaagttttctgttgctttcactttgcctcggagaagaaggaaaactgtgaaacaatttgtaggtggatcccactttgggtgaacttcaaagagtctccatcagtaaccgcctggaagttgctcgttacaggtggccaagatgtctgtccgtttggccctctctaatcagcagcttcctggggaggattccgttgtcattgctttcattcggttacagtttgtttcactcagctgtggttgccacttataggaaagaaaattatgtaggaagttcagagattcacctacgccatttcttccctgaagatgccacagacacagaagttactctgtgtacagaaaagaggccacactgcatggagagaagggacctaacttcgaaaggcatttttgtgtgtcataatcctgtaacttcaaattttaatccagtgctacagaaaccaaaaagcataaagactttacatttagagaagctaaatccacttcaaagatatcctaatgcttattaaataaagcaagcttggagtgtaaaaaataaacaaataaggccgggcgcagtggctcacacctgtaatcccagcactttgggaggctgaggtgggtggttcacctgaggtcaggagttcaagaccagcctggcaaacatggtgaaaccctgtctctactaaaaatacaaaaagttagctgggcatggtggcgggcgcttgtaatcccagctactcgggaggctgaaacaggagaatcgcctgaacccgggaagtggaggttgcagtgagccgagatcgcaccattgcacgccagcctgtgcaacaagagtgaaactctgtctcaaaataaataaataaataaataaataaataaatatacttagtcacttctttgctaatgaagggcagcacatttttttttttttttttttgagacagtcttgctctgttgccagcctggagtgcaatggcgcaatctcggctcactgcaacatctgcctcccaggttcaagtcattctcctgcctcagcctcccgagtagctgggaccacaggcatgcgccaccacacccggctaatttttgtatttttatatttatttataaatataagatgtaatcccaaagtgctgggattataggcgtgagccactgcacctggccagcacactcttttatttgagacagagtctcactctgtcacccaggtggagtgcagtggcgtgttctcggctcactgcgacctctgcctccagagttcaagcgattcctgtgcctcagcctcccaagtagctgggattataggtgcgtgagaccatacccagctaatttttgtatttttaacagagacagggtctcaccatgttggccaggctggtctcaaactcctgactttgggtgatccacctgcctcggcctcccaaagtgctaggattacaggcatgtgccacctcacccagccaagacactctttgtggatgttaacaccatagtaagaatatgtaactgccaccgctatgaaagacacattctctgcccatttaagaaacagaactttatcagcactcaccttgcaaaagaggcttgggaagtggtctggagtcataggggcataggacaactcagacagcacatccacagctcgagggccaatcagattgagggctaaatggaaaagaacaagagatgtccagctctccttctgaacagctgagccaatgggaaaggtctactgcagacttgctcagctatagccaggcctgggtgcagagaccaggaatatgtccctttgcttagacactccaaggatggatgctaagcaccccgattctggcgaatacacctctgccaacagggcctgctgaacgcagcagggctggccataaccaccccacacaattcccgttctcctccttttcccagcaaggctatgtgatggaagaagccccaaccccaaatcagtacccggtggagatctgcccaaccaaaaagtatacagactttaaattcagagaagctaaatccacttcaaacatatcctaatgcttactagataaggaaagcattattctggacaccagtgtttgtgacatcagcttgtgctaattacatgtcatccatcctaagagaagcgagaacatgacttttgttcagtaacattctgtagtatcccaatccaggagcaggacgtatatcatatttgctactacaaggaattgagaatgagagcctgggagagcaaacgctggtggggccaaggggcaagatcagttaggtgggaaggtgggaggggttaagccaagactgctgaggttgagaaaatcagggaaccaagtcatccttaaaaattaggtactcacgggggctgggcgtggtggctcatgcctgtaatcccagcactttgggaggccgaagcaggtggatcatgaggtcaagagttcaagaccagcctggccaacatggtgaaaccccatctctactaaaaatacagaaattagcccagcgtggtggcggccgcctgtaatcccagctacttggtaggctgaagcagaagaatcgcttgaacccgggaggtggaggtgcaatggcatgatcttggctcattgcaacctctgcctcccagattcaagcaattctcctgcttcagcctcatgagtagctgggactacaggcatgcaccaccatgtccagctaatttttttatttttagtagagatggggtttcaccatgttggccaggctggtctcgaactcctgacctcatgatccgcccgcctcagcctcccaaagtgctgggattacaggtgtaagccactgtgtccagccctcaattttctttgctttttttttttgagatggagtctcactcgcctaggctggagtgcagtggtgcgatctgggctcactgcaacctctgcctcccgggtccaagtgattctcctgccttagcctcccaagtagctgggattacaggcgtgtgccatcacgcccagctaatttttgtatttctagtagagacggggtttcaccatatagtccaggttggtctcgaactcctgacctagtagtgatcctcccacctcggcctccaaaagtgctgggattacaggcgtcagccaccgcatcccctagagatcaattttctatgaccagagagcctcttttatgctaactctaatgttcatttttgagagtcaaatgtaaagaaggcaaacgtggacacatctgcatctgctggccttttcgacgtggcagagcccgaacccccgtacctgtgtacttccaggtgacgtcctccaggagcaggttgctgtctttcggcatgtgtttcttaagccaggcccaacagtggacctgctggtcggttggagagatcatgaagaaactgaaaagtgagaccccaaaataatcaaaaccaggtagcagcaaaaggatcaggaagcaatcaaatcttatttggtttcaaagcaatgaggcaaatactaggaaatgatttcttagctttcacagaaggccagtagcaccattctaggatacaccacctaacaacaaaacaaaattctggcttcctgttaatgccaagaaattatacagatttactaacgttaagacatcggctgggcacagtggctcacgcctgtaatcccagcactttggaggccaaggtgggcagattgcttgagctcaggtgttcaagatcagcctgggcaatgtgacaaaaccctatctctacaaaatatacaaaaactggctgggtgtggtggcgtgtacctgtggtcccagctacctggaaagctgaggtgggaggatcacttgagcccaggaggtcgaggctgcagggatccatgattgcatcactgcactccagcctgggtaacaaagtgagaccctgtctcagaaaaaaaaaaaaaaaaaaaaaaaaagacaaggcatcttctcccagtagggtacataatctggtgggcttttttttcttttcctcctggtgatttcttttgtttaggactgctaataaactggctttgatttcatgtaatgattcttagtccctgggatttatggttcgtggagaagcgcctgagagcctctgctacagtacccctaaggaatcaacatgttggaggaagcagagcgggacggcagctcatctcacctgcgcttgttcagtcgtgctatgctgcagtcattttcataccctccaccctcgttgagcatgccagtatgcacaatgtggcccacaggcacatccaggtcattggagaagaggtactgtagaacttctaatgcctgatccccagtggtctgcagggttagggaatgaaacagagagagtgagagtgagagcacctggctgcgccacatggccccaccagcaatgaacctcattgagaaaattcaatcagccaattcccatgtgacaacacttgcagacctactccactgcaagaagctccagggaatgctagctattgattcttatgataaacaggcctctctagcaaattaaaaacccgaaacaaggagctaaaatttcagaaaaatgtcacaatacagatgaaacactaaaatataccagaattcttaagaaatcagtgttttgtttttgtttttgttttttttttgagatggagtctcactctgttgcccaggctgagtgcagtggcgcaatctcagctcactgcaacctccacctcatgagttcatgcgattctcctgcctcccgagtagctgggattacaagtgcccgccaccatgcctggttaattttttgtatttttggtagagatggtttcgccatgttggccaggctggtcttgaactcctgatctcaggtgatctacccgtctcggcctcccaaactgctgggattacaggcatgagccaccactcctggccttaatttttgtatttttagtagaaacggggttttaccatcttggccaggctggtctggaactcctgacttcaggtgatccacgccccccttggcctcccaaagtgctgggaatacaggcatgacccactgcacccagtcaggaatcagttttgaagatgaaaaacaaaaggcattcaataaatatgcaaagtttcctaatctattactttggttcccaaatacttactgttatctcaaactctgtgaaagaggacatgtcaatgacacacacagcttccttacagcacttgacttcagactccacgatgtcaaaccaatctggcttatagaaagtcttgctctgctccaatgccaggaggtctacggaatggaaaaatcacaaggccctgtagagtttagtgtagtccacgtggttctttttcttctgtgaacacattctagcctatgcatttgaaaatacgttttattaattcccaggacaaaaaaaaaaaggagcaaaaatgagaatgtgacttcttacccttgtcagggggaacaaagtactttggcctctcaaatccatgtttctccatccacctggctccctgtgcatccagccggtcgtagagaggagaggtgcgtaactgcctaccggtctggaagtcccagtggggaaccttcagatcatacatcaaagctagaaaagacacgagtagtctatcaaagcccaagacacagattctagacctgagtagccaatatccactagactctggagttgtttctattcaaaagagctttccaggctaacgtagtttgtttttttttttttttaagacggagttttgctcttgttgtccaggctggagtgcagtggcacaatcttggcttactgcaacctccgcctcctgggtttaagcgattctcctgcctcagcttcccgagtagctgggattacaggcacgtgccaccgtgccacactgatttttgtatttttagtagagacagggtttctccatgttggtcaggctggtctcaaactcctgacctcaggtgatctgcccgccccggcctcccgaagtgctgggattacaggcgtgagccactctgctcggcccaatttccaggctaatgtagtctaattttcaaaattacccagtgtatcaggcatgctccagaaggaaagacaatcctgccaagctgctatcgtccctccctggagctacgtgtcacggcatgactcggcctgtattcacattcagcattccacattagtaggtagaaatgatggcagaaaggtcagggtcctaaaccttactaagcttcatagcagagaacaaggttactaagtgggacacaggtggtaacaaaatgtgaaaaaatggcattcgattcttcattgtgcctgtgttaggatctcagacctgttacagacatttcctccctgataattaactcacttctgaagtgaaagggtacatattgtagcttgattaggtggctctgaaatctgagaagttacattgtattgtaccaatgacattattcacacaacaaagctagggtcagaattcatttctcttaggctgggtgtggtggctcacgtctgtaaacccagcactttgagaggtcaaggtgggcggatcacgaggtcaggagttcgagatcagcctgaccaatgtggtgaaaccctgtctctactaaaaatacataaattagccaggcatggtggcaggcacctgtaatcccagctacacgggaggctgaggcaggagaattgcttgaacccaggaggcagaggttgcagtgagccgaaatcacgccacggcactccagcctgggcaatagagcaagactatctcggaaaaaaaaaaaaatttcatttcccttaatgtctaatcttcaacagcaataagtaaaaaaagccagaagagtgggatctgtggtcccttgcaaagagaagacctgatctcacaccgtcccaaacaaaaggcacatcaaggcttggggaggttgggagacaggagaaggaagccaggtggggttctctgcatggtgacaatctctccatctcctggtactttaggttctatcttccccttccccattttcttttctattttttttttttattttttgttgagatggaatccctctctatcacccaggctagagcgcagtggtgcgatcttggctcactgcaacctccgtctcccgggttcaagtgattgtcctgcctcagcctgccaaggagctgggatcacaggcacataccaccacgtggctaaatttttgtatttttagtagagacagggtttcgccatgttggtcaggccagacctcctgacctcaagtgatccgcctgcctcagcctcccaacatgctgggattacaggcttgagccactgcgcctggcgccttccccattttctatgtgcctgccacttctatttcatgagaattggctaccaaaagtgtcatatcaccaagcagaagctcaagctcaattatgatttgtacaggttccaaagtaactatgggtggggaaatttaggcttataatagttcaactttaaaacaaaaaactttgatttttttattttatttttttgagacagggtctcagtcccactgcccaggctggagtacacagtggcaccatcatggctcactgcagcctcaacttccccagctcaggtgattcgcctacctcagcctcccaagtagctgggacttcaggtgtgtgccactaaggcatggctaattttttggttttggttttagtagagacagggtttcgctacgttgcctaggctggtctcaaactcctgacctcaagtgacctacctccctcagcgtcccaaagtgctgggattacagacatgagccagcacacccagccaagttcaacattttaaccaaaatatttgctaaaattaaagaaccttagcagttaaacatattgctgttaggtccttcatctccatggatgtacatcctcttcccaggccaaaagtgagcactcaggcattaaaggccatccagagtcctcaccaacaatgttgttcaactaccaaactaacagtttacttgtaaccaagaatggtggtcagagccaacacagaaacttagtcctgagcataagtatgcccaaaatatttagataccatttggcaaagtctgagaacagctcctcagtacaggaaaatgaaattacaacttgaacccacgtggtttggttcaattcctgatacaaaagctttctaagggcttcctagaaaataaatcagagatcaaggtagaataacaaattaagatgaagtggccagtccttcaaagttgaagcagggcgagaacacgggagtgagagcaggaatgtatgttttgtatttatatgggaagtggctcccaatcttgctgctgtagggtggattaatggtgaaagtcactcacggaagcctgaagctctgagaataacttggcaaattctctgacttggaaagaaaaaactaagtggggagtgagaaagcattttctcaaaaactaagtgggagtgagaaagcattcacttcgacacagggtctctcaaggcagactgcagaaagcacgcacttcgacatacggtctctcaaggcagaccgggaagaaggcattgcttagaatatttatgaagctgctatgtaccaactgtaactcctattctactttcttgttcccagaaggaaaaaaggtccgatgcactaaagaaaatgttacatatatatcatgaggagcataaagccccttaactcaggcctgaaacagtcaaatcaaatgtccaactcaaagcacttgttaaagaactgaggaaaactttgctccttctgaatgacaacacgggccaccgagaagatacctgcaactaggagcaactgcgataaagcttcacttacgcatgacttccatgacccggtggcgcagaaaggtgcggctgctctggagggctccaaaacgtttcaggtccaattcccaaacgttttctgagggataaccatgtaccatccattcggcaaggtacctatatagacagagggcacttgttggggctcaggtgtgagatttgagaaaattaatattctacaaatcgagaactaacagaatcaaaagatcctaaattgccatagaccagctgaatagttttgggcactttccttaacttttctggaagcaacgaacatgggtctgtgtactgctctcaaaagactactatgaggattttaccccagatgataagattccctaggaggcatttaacatagaagccagccagacacattggctgatgcctgtaatcccagaactttgggaggctgaggcaggggattgcttgaagtcaggagtttgagaccagcctggacaacaaagtaagaccccgtctctaccaaaaaaagaaaagtttcaaagtgagccaggtggctcacacctgtaatcccagcactttgggaggctgaggcatacggatcacctgaggtcaggagttcgaaacaagcctgaccaatgtggagaaaccctgtctctattaaaaatacaaaattagccagtgtggtggcacacgcctgtaatcccagctactacggaggctgaggaaggagaactgcttgaacctgggaggcagaggttgcagtaagcctagatcacgccattgcactccagccagggcaacaagagcgaaactccatctcaaaaaacaaaaacaaacaaacaacaacaaaaaaaaaaattagccggcgtggtggcacatgcctgtaatcccagctactcgggaggctgaggcaggagaatcacttgaacccgggaggcagaggttgcggtgagccgagattgtgccattgcactccagcctgggcaacaagagcaaaacttcgtttcaaaaaaaaaaaaaaaaaaagagctgggtatggtggcacatgcctgtagttagttctaactcttctggagtctgatgcgggatgatcccttgagcccaggaacttgcggctgcagtgagctatgatggtgccactgcactccagcctgggtgagagtaagatcttgtttcaaaaaaagttataagcctcatctatgaagaaataagactaaaacacatataaatatactctaaatatccaatgggtttttttctctcacctcaagattatacagttatgtgaccccatctcctttgctccaaacatttttgtaactcctcttctgtaattgtttttagagccattctacaaatcactcaagagaactggtctcataaatttaaaataagcttttcatcgtggctaccatcttacccatttgtaagtattcagttcagtggcagtgggtacattcacactgcggtgtaaccttcactaccatccatcctagaactcttttcctcttgcatttgtggaactctgtgctcattcaagaatagctcccctcccccgcctctggcaaacaccattgtactttctgtctctatgatctgacaactctagcaacttcatataagtggaaccacacagtatttgtccttttgtgactggcttatttaatgttcattagtgtcttattttattttattattattatttttattgagatagagtctcgctctgtcgcccaggctggagtgcagtggcgcaatctcggctcactgcaacctctgcctcccgggttcacgccattctcctgtctcaacctcccaagtagctgggaccacaggcgcccgccacaacggccggctaattttgttcttgtatttttagtagagacgcggtttcactgtgttagccagagtggtctcgatctcgtgaccttgtgatccgcccacctaggcctcccaaagtgctgggattacaagcgtgagccaccgcgcccggcctagtgtctaatttttaaacaaaaacttgtggccgggcacggtggctcatgcctgtaatcctagcactttgggaggccaaggtgggtggatcacttgaagtcaggagttcaagaccagcctggctaacatggtgaaaccctgtctctactaaaaatagaaaaattagccaggtgtgctggcacacgcctctaatcccagctactcgggaggctgaggtaggagaacagcctgaacccaggaggtggaggttacagtgagctgagatcatgtcactgcattccagcctgggtgacagagcaagactgtctaaaaaaacaaacaaaacgtgtattacctagttcaaatacctacctcaatcaacacacttggctaccaaactcaaatacacactcaaatgaccaatatttgttacaattgaaaaaatataaaagaatatcccacaggatctgtggctaactccaaaagatgagttgcaaaaacattttgcctgatgacatttctggaacatggggagcctctcatacttagaaggggacaactccaaaattacatgtatcttcttattagtcttaacatactagattaaatataccacacgccatgttaataacaagtaattctagaagggaagagacccagcaagttgacttatgttcacagctgactttgagtgagaaagacttactttccggctcctccaccaaatgaaaggccagcagagttcattcctgccaggacaaagtagccctacactgcaggagactcgcccatgatgcacctcatgtctgatgcgaaggtctctgggcagttcaccaacttcatgatctccagagtctctaattctggcatcctcctcagaagggaactcaacagaggctctgagcaatgacaacaaaaccaaatagagttctcacctttaaggaattaaaccactttcaacccctctacttttttacactctcccctttcagaaaacctcttgaattttttttttttttttttgagatggagtctcactctgttgccccggctggagtgcggtggcacgatctcaactctctgcaaactctgcctcccaggttcaagcgatcctctcgcctcagcctgccaattagctcagattacaggcgtgcaccaccacgccagctaattttttgtatttttagtagagatggggtttcaccatgatggccacactagtttcgaactcttgacctcaagtgatctgcctgccttggcctcccaaagtgctaggattataggtgtgaaccactgcgcccggctggaagagatttttttaaagacaagccaactgggccatttattacaaagcagaaaccttggtagaattacaggatatagctgcaaaatacttggtataaagactgaggaaaaaagatattggttagaaaggaaagcagcagagaacagcaagtaaaacgtatctacagataataatcttgaagggaccagtgtgagtggacaagctcttaaatggcggccacagagattttaataaaaggtgatgttctgagctgggcatggtggcttgcgtctgtaaccccagcactttgggaggccaaggtgggcggatcacctgaggtcaggagttcaagagcattatggccaaaatggtgaagcctcgcctctactaaaaatacaaaaattagccagtcatgatggtggaagcctgtaatcccagctactcgggaagctgaggcagaaaaatcacttgaatctgagaggtggaggttgaagtgagcagagatcgtgacactgcactccagcctgggcaatagagtgaaactccatctcaggaaaaaaaaaaaaaaggcaatgttctgcattggaatagctgcaaaagacagaccctgctttaaaggaaatctaccatcagggcataatccagtggacagcagaaaaagatgaaaccagaccagagctggataatgggtacatgggggctcatcacactactctcgccaggtttgtttagtagacacatagtctccagtctcgccatgttgcccaggctggtcttcacttcctgggctccagtgatcctcccatcttggcctcccaaaatgatggaattacaggtgtaagccactgtgcccagcttctatccagttttaaaagtttgaaattttccataagaatttattaaaaaacgaaagcccatcaagggtcagagggaaattcttcattagagactctttcacctttttaaacttggaactaggtaactacattattattattattattctttttgagatggagtctcgctctgtcacccaggctggagtgcagtggtgcgatctcagcccactgcagcctctgcctcccgggttccagcaattctcctgcctcagcctcccaggtagctggcattacaggtgcgcgccaccacatccagctaatttttatatttttagtagagacgggtttttgccatgttggccaggctggtcttgaactcctgaccacaggcgatccgcccgccttggcttcccaaagtgctgggattacaggccttaaaggccaggtgcagtggctcatgcctgtaatcccagcactttgggaggccgaggcaggtggatcgcttgaggtcaggagttcaagaccagcctggccaaatagtgaaaccccatctctactaaaaacacaaaaattggctctgcgttgtggtgggcgcctgtaattccagctacctgggaggctgaggcaggagaattgcttgaatccaggaggtggaggatgcagtgagctaagatcgcaccactgcactccagcctgggcaacagagcaagactccatctcaaaatgaatgaatggatacataaataaacaaataaaattattttaaaatttaataaaatactacactaacaaaacaattctgaaaaacaaaacaaaacaattctgttttctaaagaactcctcaattttatatgaagtcctactgaaagaagtctcctcctaaaacctaaaatctgagcaataattttaggtgaataaagaataagcaggggccgggcgtggtggctcatgtctgtaatcccagcactttaggaggccgaggcgggcagatctcctgaggtcaggagttcgagaccagcctgaccaacatggagaaaccctgtctctactaaaaatacaaaattagccaggcgtggtggcgcatgtctgtaatcccagctactcaggaggctgaggcaggagaatcacttgaacccaggaggcagaggttgcggtgagccgagatcgcaccattgcactcgagcctgggcaacaagagtgaaactccatctcagaaaaaaaaaaacacacaaaaaaagaagcagagctgggcacagtggctcacacctttactcccagcactttgggagaccaaggcaggcagatcacttgaggccaggatttcaagaccagcctggccaacgtggtaaaaccctgtctctactaaaaatacataaactagctggacatgttggtgcacgactgtaatcccagctactcaggaggctgaggcatgagaatcacttgaacctaggaggtggaggttggagtgagccgagattgtgccactgcactccagtctgggcgacagagcaagactcttatctcaaaaaaaaaaaaaaaaaaaggccagacgcagtggctcatgcttgtaatcccagcactttgggaggctgagggaggtggatcacctgaggtcaggagttcaagaccagcctgatcaacatggtgaaaccctgtctctactaaaaatacaaaaattagtcaggagtggtggcaggcgcttgtaatcccacctaccacctactctggaggctgaggcaggagaatcacttgaaccggggagtcagaggttgcagtgagccgagatcacaccactgcactccagcctgggcaacagagcgagacttcatctcaaaaaaaaaaaaaaaaaaaaagcagctgggtatcatggctcatgcccgtaatcacagcactttgggaagctgaggcaggaggactgactgagcccaagagttcgagaccagcctgggcaacacagtgagaccccatctcaacaaaaaatttaaacattagctaggcatggtggcaagcacctgtagtcccagctacttgggaggctgatgttgcaggatcacttgagctcacgaatttgaggctacagtgagctatgatcatgccactgcactccagcctaggtgacagggcaagacgccatcttacacacacacaaaatgatagagatgactaaacacacacacacaaagggctaggcaaagtggctcacgtctgtaatcttagcactttgggagtccaaggtggaagggatcacttgagcctcggagttcgagatcaacctgggcaacatagcgagaccatgtctctatcaaaaacaaaaaaaaaaagctatgagaccaggagttcggggctgcagtgagctataattgtgcaactgcactccagtctgagcacagagcaaggctccgtctcaagaaataaaagaaaaaagtaaaactaagaataaaattaaaaaagaataaggcaaatgtccattaactaagattttagtcccctgaatctgctacctagtaactccatcctcagaccaggcaaactcaccctctgtaaccactgttgtacctcatggcgatgttataaacattaaacaaggaactattcttcaaaagactttgaaaaatataacatcttaaacaaatataaggcactactgttataatgcagttcacataccaaagtgatcccagtcccctgtagattctgaatctccagctggttcttgccctcagtgaaaattggttttgggttcttctcaaagcccccagacaggatgccaccctgccagttccgaatataaattcttccatcagcatccacaatagctgaggtggagaaatgacatggagtggggagtggaagaaaaaacaagggtttagaggcaagtcagctttctaaatggacagaacaaccaaacaaaaacacccattaatggctttattaatgaaagaacattcaatgaacgcaggcattcattagctttaaaataccttttgaggtcacgggggaagatcctcccatttagcctttcagtggagactgtttctctgattatcccttacctagaagctttgactagtccccaccacgtaactcccactgtgccaagcgaaagtttaacggaaagggggattgcagagcccattctaggcatgaagaccgtcaaaaggatgtgagaaccctctcctatagtgcttggaaccacgaacccacctaagtctatcgtttacctatgacatttctactatccatagtattcaagttaaaaagtcaacaagacagtccaaatattctcaatgacctctgtttaagactaaaattagcttgcaaaacaaaaaacaaaaacaaaaaaatgtattaatggaaattttggccatcctttcataaagagttaataaagaaaagtcagaattgggtccacctccctgtaacatgctctagaaatgaaagactctttcagacacagtctgtccttagcagaaagttttccttttcagaggacaggacactggcaaagaaacaagattttttaaaaaagtgcaagtcctcacttggtgtgctgctctgcagaggggtctccaaggggcgagtcaggaggtagaagtgttcgcaggcatgtagcgggatactaaccggctcctcgttggacagacccagctcgtatgcccactacaaatggacaggttgatttgtgggtgggaaggggaacagaaataaaaatgagcaagttcagcctcttgagattaattccaagtggcttatgtgtgctcttgctacagtgtcaggtgtgggaagtcagcctgctttagttcaattatttggatggggagcaatactacattttttaagacataaaaattactttgagatcaaaggaagagatatttaccagctagtcaaaggagctcatgggaaccaaaggaggtccttttgataaaacgcctgggctcagctacaaaccccaaatagcaatcactaaatgaacttcacgtggcaaaagtatttcttagttcacttcgggatcatagcatggaaggcaagagccaatctgctttaaaagaagcagtgtcccggaaattagtgtccacattcctgacacaataaaatagcctaatatgttatttgctaggttgtagaatgaaatgtaacaccaagacccagcgccaaggattcacgtcaatgcctgaccatttgctggccttcctgaccaggatagcacccatcaacccagtgtggaggaaggacaaggtcacacaggcttctatttgcagactaagtgtaggtttctgatttagaataccctacaagaaacagcatagttactgatatctgtgtaatgaatcacaatactaaccttacttctctacaccaaaaaaatcttggagacatacgttaaataagaaaatcagtgttggtgctgacctacctggccagcacagttgacaaaatactggcattcaatctgtcctttatcggtctccactccagtaacttgaccttttttgcccattacttgaagaacagatgtccggtcatagatctgaacacctgttccaaggtaaagaaagagttggtgcttcatctgatgttccagaatgaaggcatgtgcagcaggttctccacccagaagaaacactgacaaagtcaagtcaatgctttaatttatttttttattttatttttgagacggagtcttgctttgtcgccaagggtggagggtagtggtgtgatcttggctcgctctctgcctcctgggttcaagcaattctcctgcctcagcctctcaagtagctgggattacaggcatgcaccaccatgtcctgctaatttttgtatttttaatagagatggggttttaccatgctggtcagcctggtcttgaactcctggcctcaggtgatccgcctgccttggcctcccaaagtgctgggattacaggcatgagacaccacgcccggctcaatgctttcatttaaaaaaaaacacaaaaccctagaatcacatcctgagactatgtaaatgggccttgttcgagattgaaaatagcaagtcagtttaaaaacagactttggaacacaataattaaattcctggaatcataaactatggagcaaagaggagaggatgtaaatagtgcgccttaagtgctaacctgctcataccatggatatgataccctggacactagttaagtcttcccctcattcaatgcaactgggcttatgatttcaggtgtggattaaacttccaaggtgtgttttcaccttgagcttctcaagtcctgtgggggaaaatattaccttaagtccaaagggcattaattggcagggcacagtggctcacgcctgtaatcccagcacttagggaggccgaggcaggtggatcatctgaggtcaggagttcaagaccagcctggccaatacggcgaaaccccgtctctactaaaaatacacaaaaaaattacctgggtgtagtggcgcacgcctgtagtcccacctactcgggaggctgaagcaggaggatcacatgaacccaggaggcgaacgttgcagtgagccaagattgtgccactgcactccagcctgggcgaaaagagtgaagctccgtctccaaaaaacgggcattaattagcactaaaagcagttctttagaactttaaaaatgtggccctgagggaaaacactcattaacagataaataaaattataagtgttcaaaatggaggctgagtaccccaaagaggataatctttccaaacttgagttggtgtcacttcctactgtgagacacttccttaggtaatgtcttccctgctaacctatcttaagaaaatgcaaaaacctgctcaccattttgggaggcagcacttgccagggcaagagccacgtcagcggaagacaccactgcatcctcaggaacatgcatggcccccaccaggtcgtgcacgttgaggagatggtgaagctcggccactttcttgggggagatgatctcagaagggatacctataacactgccacagaacacaagggacaatgacattcacaggctctttggcagaggccagtgtggtaaagtcaggacacgcttctagactcttacgtacttcagccctgcgttgatgcgcttcagggagatcagtcggtcctgagtttgggccagaaagattgagcctgtccttgtgtaacctgtaagaaaaatgagcccaaatgagacagatcagaccaaatgtaggacgggagagtggaaaatccactagattataagttagaaggcctgtgatgaatcctgggactgccactcaatatccttgggcaggtaaatcagcttctctgagcttctttgcaaaattttaagaacttcagatgcactaaggctccatgccctgaccaaacattctcagctcacagttttgtgaagttgtgaggatcaaatgagattctaggccaggtgtagtggctcatgcttgtaatcgcagcactttgggaggctgaggggggcggatcatctgaggtcagtagtttgagaccagcctggccagcatggtgaaaccctgtctctactaaaaatacaaaattagccaggcacggtggtgtgcacatgtaattccagctaccggggaggctgaggcaggagaattgcttgaacccaggaggtggaggttgcagtgggtcaaaattgcaccactgcactctagcctgggcaacagagtgagacttcgtctttaaaaaaaagaaaaaaaaagaaaaagacagttttgggcagggattcgaccatccctattcttcccaccttttaggcagtttcaccctttctcctcctagtcttgggggagtgtaatccttagcaaaggccactcacaataacatcagctaccaagggtcggattctcccttcttcttccccagtatagccaaacagtgggcatgcgacctaagcttatccaatcagaccctcctggaacagtcagtcttgagcacgtaggtgaatggctagaggtcaccatctcaagggcagcatcagccaggccaggctgctcctgttctggctgagggactgcctgcggtgcagtccccacatcctggcttccaggctgcctccagctggcagcctcctgccaactccacaggcccaagctcctcccaacaagctccaagttggccagagtcaattcctgttgtctgtaatcaacacacctgatatagaaccataattacacttgggccaatgacaattctcctaaaatacaatgactcttaattcttatgaagaaagagttgaagcaatttggtatcttattttcaaaagaagtacagtaaggataatttacatattttcttaatttcttagtagagacggggtttcaccatgttagccaggatggtctcgatctcctgacctcgtgatccgcctgcctcggcctcccaaagtgctgggattacaggcatgaaccaccatgtttaaaaccggccaacccaagttttaattaccaaagcagtaggcacacctggcagaggaccaaatacagaaatgaatataacaatctcagggacaggcaaagcaataaatggaagacacttgcttacctgttcggatccctgtttcttgctctaactgatggtagagtttgtttgagtagtctgccatcttctgctcaatggtcaagtgcctggcagtgctcaggatgccagcacagaacctggtagagccagcagccagcctgcaggatggatgcaaaatgctattaggtagattgacgtcatctgtgaatacgaggtcagggtttctcatttaatactgtttctaataccaaaagatggaaacaagctgggcacagtggctcacacttataatcccagcacttgaggaggccaaggtaggaggattgaggactgcttgaggacaggggtttatgaccagcctggtcaacacagggagaacccatctctaccaacaacaacaacaaaattagccaggcatggtagcacatgcctgcagacccagctacttgggaggctaaggccagaggagcccttgagttcaaaaggtagaggctgcagtgagctgtgatcacatctctgcactccagcttgggcaacagggtgagaaaaatgttcaatgacatgggatagatttaaaattttgtatagtttaggccaggcacagtggctcatgcctgtaatcccagcactttgacgggctgaggtaggaggttcacttgaggccaggagttcaagactggcctgggcaacatagccagaccatgtctctaccaaaaaaaaaataaataaaaataaataaataaataaaaataaaggctgagtgcggtggcttacgcctgtaatcccaccactttgggaggctgagatgggcggatcacaaggtcaggagatcaaaaccatcttggctaacacagtgaaaccccgtctctacaaaaaatacaaaaaattagtcgggcatcatggcgggcacctgtactcccagctactcgggaggctgaggaaggagaatggcgtgaacccgggaggcagagcttgcagtgagtcaacactgtgccactgcgttccggcctgggtgacagagcgagactccacctcaaaaaaaagtaaaaaaaataaagataaaagttagccaggctacttgggaagctgaggcaggaagatcccttgatcccaaaagtttgcggctgcagtgagctaccattgtgccactgcacttcagactaagcaatagagcaagaccccatctctaaaataaaataaaattttggaattcatctatacaatggaatattatgcagctataaaaaagaatgaaaaggtctttatgtaccaatatggaacaatcataatgaaaaagtaaggtgaagaacagtgtgtaaggtatgctcccacttatataaaaaagggaaaaaatataataaatgaatacccatacacatatacacaaacctaccaacacataattgcttatagaagtagagaatataactagaacttaacttccctccagagaggaaagctttttgttagaagtgaagattgagggctgggtgcagtggctcacatctataatcccagcactttgggaggctgaggcaggcagatcacttgaggtcaggcgttcgagaccagcctggccaacatggcgaaaccccatctctactaaaaacacaaaaatcagctgggcatggtggcaggcgtctgtaatcccagctattcagaaggctgaggcaggaggatcgcctgaacccaggaggcagaggttgcaggagttgaggctgcaccactgcacttcagcctcggtgacagaacaagactccatcttaaaaaaaaaaaaaaaaaaaagaaaaggaaagaacattgaggagtctttttcctgtatactcttttacatatatatatgtgtatgtgtgtgtgtgtgtgtgtgtgtgtgtgtgtgtgtggtgtgtgtatatatgtgtatgtgtatatatatacatgtgtgtatatatatatgtgtatatatatatatatgtttgtgtatatatatatgtgtgtgtgtatatatatatatatatatatttttttttttttttttagacgcagtttcactcgtcacccaggctggagtgcaatggcacaatctcggcttactgcaacctctgcctcctgggttcaagctattctcctgcctcagtctcccgagtagcagggattacaggtgtgtgccaccatgcccagctaatttttgtgtttttttttttgttttttgtttttttagagacggagttttgctcatcactcagattggagtgcaatggcacaatctcggctcaccgcaacctccacctcccaggttcaagcaattctcttgcctcaacctcccaagtagctaggattacaggtgtacaccaccatgcctggctaaatttgtatttttagcagagatggggttttgccatgttggccaggctggtttcgaattcctgaccttagatgatccacccgcctcagcctcccaaagtgctgggattacaggcataagccactgcacccagcttcttttacatattttcaattttgaatcatataaatacattgcctattcaaaagtacataaactttacattgaaaaaaatgttctctaatttgtggtagcaacagaatataaaggctacagtaatgctagggcccaaagacccagttttgcaagggacccatatgtgaagaaagcaggtgggggggttctaaggtcattttccccaaattatttatcactcagtaaataaactaacatctgtgtcagcatgcctgtcacttgagtttactgtatttactctaataattatattttccacataagattgtcagctccctaaagagatttttctatcatctttgtaactgtgtggagctccaccccaggtgggagttccattaactggctggtggtcagcacctatagctctggtgacgtctctgctgggatagcactccttgagcagctttgacagtggctctcgcccttggaggtacatcagagtcccccgggaagcttttaaaaatactgatgcctggcctcacccctagagattctcgtttgttctggggagagatctgggcactggtaattgttaaaagctccccagctgattctaatgtgcagacagatttaagacccattgatctatgagaacaatagtgaagatagagaagaggaataattatagataaagggcagtataaaaccatttcacaagccacggataaggcataagaataacttttattttttgagacagtctcactctgttgcccaggctggagggcagtggcacaaacttggctcactacaatctccgcctcccaggttcaagcaattctcctgcctcagcctcctgagtagctacaattacaggctcataccaccacacccagctaatttttgcatttttagtagagacggggtttcgccatgttgggcaggctggtcttgaactcctgacctcaggtgatccacccaccttggcctcccaaagtcgtgggataacaggcatgagccactgcacttggccgagccataattttttttttttttgagactgagtcttggtctgttgcccaggctggggtgcaatggcgcgatcttggctcactgcatcctccgcctcctggattcaagcgattttcctacctcagcctcccgagtagctgagattaacagatgcgcataaccactcccggttaatttctgtatttttagtagagacggcgtttcaccatgttggccaagctggtctcaaactcctgatctctggtgatccactcgccttggcctcccaaagtgctgggattacaggcgtgagcgatcgtgcctggctggcataattatttttaagtgtgaggtttaaatagtctgccttatatcaattctaaggtattatataatcttgaagcaacaaattaaaccacaaatgaacctccctaggttctcccacttagaaacatttacactgagattagtttatcactttttgtggaaatacctgataattaaatttaaaaggatttcaaaaaataggagaacgactttgacatcaaggaagcattatgaggccaagtgcagtggcccacacctgtaaccccagcactttgggaggttgaggtggtccgatcacttgagcccaggagtttgaggccagcctggacaacaaggtgaaatcacgtctctaccaaaaaaacaaaaaattagccaggcatggtagtgcatgcctgtagtcccagctactcaggaggctgtggtgggaggatcacttgagcccaggaggcagaggttgtagtgagctgagattgaaccactgcactccagcctgagtgacagcgtgagaccctgtctcaaaaacattaacaaaaacaaaacccacttttgctcttaaaagtatccactgcaggccaggcacggtggctcatgcctgtaatcccagcactttgggaggctgaggcgggtggatcagctgaggtcaggagttcaagacctgcctggccaacatggtgaaaccccatctatactaaaaatacaagaattagccaggtgtggtggcatgcaactattaatcccagctacttgggagcctggggcaggagaatcactggaatccgggaggcacaggttgcagtgagctgagatcacgtcaccgcactccagcctgggtgacaaagcaagactctgtctcaaaaaaaaaaaactatccactgcataaaatagaaatccatgagtctaaactggggtgtgtgtgtgtgtgtgtgtgtgtgtatacagatatataactgagtaaataaatgggggagaaggaaatctcttcctgacagtaatatgccaactataataaatgtagaagtataatcaaaaaatcaccatttgtcaaccatcatggtggtggctgactcaggcaacagttgtcaacggatgctaagcccggtaggtggaggtctgatatgaacaggatattggcataatctcagaatccatctctcctcaaagggcactggccagttacaaggggagaaaacagggtctctgtgctagagatgcttggaggacaccaatgtaactgggtgaccagggttatcaccaccagaagtgagacaggacagccatacacctcctgatgtggtgcactgctgagagtccagcctaatttctgtggtcttactgccaaaaatgtatgacctggttatgatgatggatgcacaactctgtacaaacagatttcagcacttaacaaggatgagtggcatggtatgcaaattgtatctcaatacagtgatggttataaaagtctctaacccaagtctgatcataagacaacagcctaggccaggtgtggtggctcatgcctgtaatcccagtactttgggaggccaaggtgggtggatcacctgaggtcaggagtccaagaccagcctggctaacacggtgaaatcctgtctctactaaaaaaacagaaattagctgggcatggtggtgggtgcctgtaatcccagctacttgggaggctgaggcaggagaattgcttgaacccaggaggcggaggttgcagtgagcggaaattgcaccactgcactccagcctgggtgacagagagagactccatttcaaaaaaaaaaaaaaaaaaagaaagaaaagaaaacatcctaggcaacacagggagatcccatctctacagaaaaatacaacaatcagccagatgtgatggtgcatgtcagtagtcccagctacttgggaggctatggcagaaggactgcttgaatccacgaggtcaaggctacagtcagctgtgatagtgtgactgcactccagcttgggtgacacagcaagaccccatcttaaaaaaaaaaaaaaagagaagaagaaaacattagctaaacacaggctgagaattatcagagtgaaaggcctgtattcttttttttttttttttttgagacagtcttgctgtgtcacccaggctagcgtgcagtggcatgatctccactcactgccacctccgcctcacagattcaagcgattctcctgcctcagcctgccgagtagctgggattacaggtgcacaccaccacgcccagctaatttttgtatgtttagcagagacaggttttcaccatgttggccaggctggtatcgaactcctgacctgaggtgatctgcccacctcagcctcccagagtgctgggattacaggtgtgagccaccatgcccggccaatattgttgtatgaatctaacattacttgtatagtggtataatattaattaatgatggattataagaatccattctgtaatctctgtaactattacaaattaatataaagggacttagcttacaagccaatagagcagaaaatacttgacctaaaagaaggtgagcacagagaaactaagcctatagagcatatttctcttggagaatgagaacaatattaagaacctagcaattaagcaaacacaagcagttgtctgctttgcttaaatgcagtccacattatttacaaacacaaatttttgtcaaagtctaaaatgttgctgggtacagtgggtcatgcctgtagtcccagcactttgggaggccaaggtgggaggactgcttgaggccaggaattcaagctcagcctgggtaagaaagcgagatcctgtctaccaaaacaccaccaccaaaaaaaaaaaaaaaaaaaaaaaaaaaaaaaggaaaacgacgaaatttgccaactctctaaaaaccagagaacatgagcattattagtcatccttaaacaaaattcaggagattccaccttgcttcttctcatgctacttagcaacatttagattagctactggtggggcagtatctctgaaaggagagggaatctgatacgattagtgcagcacagccatgagccaaatgcagtctgatccttacctgccctgctccaaaaggacaatatccttccaccccattttggattggtgatgggccacagaagtgcccgtgattccacctccacagacgaccacctgtgcctgggtgggcagggccatggaacgcgcctcggcagctgatgcgctgtttcttgcagaggaccagttctgccatcctgggctggctctttgtcttccaacaatcgacagcaaccagtagaacatcatgtctctcaccaactagatctcaggaactcaaactagacagagaaaccaaacatatttcatgccattcaactcagtgcatgggattaatgagaaagggatttgacaaagaacgatagccattcattcagcaaatatttgagggtggccgggcgcggtgcctcacacctgtaatcccagcactctgggaggccgaggcgggcggatcacgaggtcaggagatcgagaccatcctggctaacacagtgaaaccccgtctctactaaaaacacaaaaaattaggctgggcgcagtggctcacatctataatcccagcactttgggaggccgcggcgagtggataacgaggtcaggtgttcgagaccagcctgaccaacatggtgaaaccctgtctctactaaaaatacaaaaattagctgggcatggtggcgggtgcctgtaatcccagctactcaggaggctgaggcaggagaattgcttgaacccgggaggcggaggttgcagtgagcagagatcgcgccaccgcactccagcctgggcgacagagcgagactccgtctcaaaaaacaaaaacaaaaacaaaaaaagaaatatttgagggcattctgagtttcagatattctgctagcagtgaacaagaatggggaagtccctgtctttatgaaatttacatttgagagtttgcgtgtgtgaatgaggagagcaccaatcaatatacaagtaaacatacaaataaaacagtaaataaagctaatgtgatagagtaactaggggcatatttaaaacaggatggtcagaaacagcctccaaggaagtgacatttggaaacagacctgaaggataaggaacgagctatacatttggcagacactgagacgagcatgtgcaaaagccctgaggtaagacagaccaagaacaaaaaggaggccggcatgtacacgacacggggagtgtggggagatgatctaagacaatgctggagaggcaggcggaagccagttacacacagcccttgggtgccatcagcaggagttggaattttattcaaagtacaaaggaaaatcactcatgcgggagtatcactagcaggggaatgaaatgatctgggatgtttttcttttctttgttttttttggcggtgaggggtggggggatgttttccaaaggtcagtctggctccatggtggagagcggatggtagaattataaaaacagagtcgacttcctaggctcaagtgatcctcccaccttggtctcccaaagtgctgagattacaggcatgaaccactgcccttggacaaggcagggttttaacaaacttaatctatcagcaaaacagatgactgttcaagtttcaagaaactgaagaagaaagcacctactggctgtccatgcagtcatgtgtacaggaggatgaggactttgagacgagaggcggtagacaagggggcctcagggcagctcactgctagtcatctccttaccgcctccactgccagccacaggacccacagatgctccacagtcagcccaaattgtccaaggccaaggtatctatgtccatccatcagaattgcaaccaatgcaagcacagactatgtccagacagacatcccatccaactggagacaaattgtcttggccaccttgtggttgccaccatgcctctcatccctggtccctgttaagcaccatctcaaaacagaagcttctctacccggctagtctttacataatctcatctctacgtgaccaatttatttcccgtggcccaagctctctttgctttcctctccttcaagctcctctactgcaccctctagaatacctttcccaaaggtaaacacccacccctttgctgacatcctctctaccctctgtcccaatggcaacacagctctcctggggaactgctgctgccaaatggccagccccatcccattgacctcactgtcaacctcctggcttctgacccgtgaccactcggttatacttgaaaactgtcctgctccttggtggcttaggctagcacatgttaagccacaggtagacctctgtctgtattcaggttcagagcccagctattcctctctcaaccttcaacttcacctcctttcttccctcattctaagcagataacctggctcatctcattccctgaaacccttcctatagacccacttacatctgcaaccatctcttccttcttttatccactggaaagttaatctcccccaagggccctggatcccacttcctcctctcttctcttgaccctagctccatcaactgctgtctctctttcctgtacctgcaatgtttccctccgtttttgctccttttcctcagcaatttttttttttttgagacggagtctcgctctgtcgcccagttgggagtgcagcggtgtgatctcggctcactgcaacctctacattccaggttcaagcaattctcctgcctcggcctcctgaacagctggcactataagtacgcgccaccacgcccagctactttttgtatttttagtagagatagggtttcgccatgttaattaggctggttttgaactcctcacctcgggtgatccactggccttggcctcccaaagtgctgggattacaggtgtaagccaccacacccaccttaatgactttctgatgccctcaggaaaaaggcaaaactcttttcatatcaagtgcaagatccttcacagtctggttcttatctgtggtctcatttctcctttcctcacactctgaccaagccagactgaacaacctgtaattcgtcaaacatatcaggtgaggtgtgaatgttctattcggctccaggttctgtgcatgctgttccctcctggcaggttcctgccacccctcccgcaaatacaggtaatctcctcaggtcacagcctctttgacatcttatttatttattttttttgagatggagtctcgctctgtcgcccacgctggagtgcagtggtgcgatctcagctcactgcaagctctgcctcctggattgatgccattctcctgcctcagcctcctgagtagctgggactacaggcacccgccaccatgcctggctaatttttttttttaatttttaggagagacggggtttcaccatgttagccaggatggtctcaatctcccgacctcgtgatccgcctgccttggcctcccaaagtgctgggattacaggtatgagccaccgtgcccagccctgtctttgacatcttatctgacaatctccccctccttctccaacacttggttaggtggcttttctatgttctcctataacacactacacttctcccagcacagaacttaccacactgcacaatggtctgtttgccaatcagagaagcaacatgccagcatggcagggaatccaggctttgggggcggacagttctgggtttgaaaatatccccacctctcactagctgtatgactatcagcaagttactaaatctctaggctttgaactcctcatctgtaacacgggctagaaacacctacctcacatggttgctgcaaagactaaatcagacaaggcaggaagaacatggtacaagcacctaagaagcactcagtaagtggtagttattttttattattttttgagacgaggtctgtcatgcaggctggagtacagcggcatgatcatggctcactgcagtctcaaccacccagactcaagcgatcctcccacctcagcctccagagtagctgggaccacagatgtgtaccatcacactcagctaattttaaaattatgaatatttgtagaggtgaggtctcactacgttgcccaggatggtctcgagctcctgacctcaagtgatctgcccacattggcctcccaaagtgctggaattacaggctaagccaccacacccggcctattatttccctattataatggaactaagagcagaaaccttataaattgctcaattttcccagcgttcagcataggtacctaggaaatatatgttgatgcatgaatgagaacagagaacaaagaagatggggggaaaaaatcaaaggtaggacccccagatttgaggagatatctaaatacctgagagaattatttttatttttatttattgtgaaacagagtctcactctgtcgcccaggctgaagtgcagaggcgtgatctcagctcactgcaacctctgccttccaggttcaagtgtttctcccgcctcagcctcccgagtagctgggattacaggcgcacgccactgtgcccgactaattttttgtatttttagtagagatggagtttcaccatgttggccaggctggtctcgaactcctgacctcaggtgatccacccaccttggcctcccaaagtgctgggattacaggcatgagccactgtgaccggccaataatttttaaagctaatatttttataagtagttacaatgcaccagatactgcctatgtatataactaatttaatcctcacaaccttatgaggtagatactagcatttctattctacacttgaggaaacaggcacagataagtggaagtgactcacccaaggtcctaccaaactgttgagtagcagaaccctgccaatttggcattagtggccggctatttaatcatgactccacgctacctttcaaataaaagcagatggtaaggaaaggacagctgtgaggactgaaccattaagcacattcccctaacagagaaagggaattgcaaaggtggcagaacaaacacagtaacagatgagttttaaggaggaattaaaaaaaaactttaggccgggcgccatgtctcacgcctgtaatctcagcactttgggaggccgaggcgggtagatcatttgaggtcggaaattggagaccagcctggcaaacatggtgaaactccgtctctaccaaagatacaaaaaattagctgggtgtggtggcacgcacctgtggtcccaggtactcatggtgcggccaccattgcatcttgggcctcactaaccagttcccgtttgttggattcaatactgtctcaccacacaggccaatcttgtgttttattaattttttaaatttttttttttttttttgtagagatgggctcactatgttgcccaggctggtcctgaactcctgaggtaggaggatcgcttgagcctgggagacagaggttgcagtgagccgagattatgctactgcactcctgcctgggtgacacagtgagactctgtcttaaacaaaacaaaacaaaaaaaggccaggcgcaggggctcacacctgtaatcctagcactttgggaggccaaggtgggtggatcatttgaggtcaggagtttgagaccagcctgatcagcatggtgaaaccccgtctctactaaaaacagaaaaattagccaggtgtcgtggcttgcacctgtagtcccagctactcaggaggctgagacaggaaaattgcttcaaccagggagatggaggctgcagtgcgcagagtcgcgccactgcctgggtgacacagtgagactccatctcaaaaaagcccagggtgcttggcgccaaaaaagggatctctgaccttgtgttcattatgaccttcaaaagagtgaagtggtgagggcatgagggcagaggaaaagaagggcttaagacaacgaaggaaaagaaggcaccagagtctagtgcctttgccgccaaacctaagcctataaggttggcagcaaaaccaaagcacaaactgatagcaaaggaggtaaagccaggggagaagaaactgaagacgtcaaagacagaaatgaagcacatcatctggtttaaaacaaatgatagagtttttacagttctggaaaatgaccgtataatattctctgctaagaagaataacttctgctaaacaaccataagactgcagctggctctactcagatctgcttattccaacaagaccaaggtgctagttctaacttcgagtagtccctctgtatggctgcagcgttgcgcacagtggactgccggtcacaaggaagactggatgagcgtgggttcacacatttcccacacttgcctcagcaaaagaaccacctgggacacttgtttaaaaatgacagattcccacggtccacctcggcagattctgatcctgccacgccagggagctgtatttttcaacaagtacaccaggtgatcacgcaagtttaagaaattagcacaagttggccgggcgcagtggctcacgcctgtaatcccagcactttgggaggctgaggcgggcgaatcacgaggtcaggagttccagaccagcctggccaacatagtgaaaccccgtctctactaaaaacacaaaaattagccgggcgtggtggcgcacacctgtattcccagctacttgggaggctgaggcaggagaattgcttgaacccaggaggcagaggttgcagtgagccgagatcgcgccactgcactcccgcctgggcgacagagtgagactccgtctcggaaaaaagaaaaaaaaagaaaaaagaaaaaagaaattaacacaagtccctgccactggaaacgcatatccgttgggctggctcctcctccaccaccagcccccatcccggtacatcacgtttacatgcatgcggaaaatgggcttggagattcttgattcaaatccgaggtatcacacatcggcccccaaaggtcaaacattaagaaggaagcttactgccctgtcccagacttttctaggtgacttcttcctccggactctgcagcagtcttactagttctgaaagcacaagcggaccgcacgtctcaacgcgggaaaacagttccatctgcagggatggaggaccgggctagacaagctggagttggctctgcgccgcaggggtgtgcaagcccaagactggggagcccgaggtcaccccggccgccctggcatcggggctgaggtgcaggctcctggaggagcggtgcgcaggcccaggggtagccgaggacacaagccaaggcacgagcggacaaccttacggggacgagtactaccgcccggacgcgacttcgcgagaggccaggcggaacccactggaagcgtgagctagcggggaccacccccgggcgaaaccaaaggagaaagaggggaacccaggggtcccggggcgcttaggcccgcgcggacggggaggccagagttgccccgaagctatctccttacctcaccggcccccacgggctccgcgctcagctacagcccggcgggagcaatgcggcagccacaacagttgccggcggtcgccgcgggccggaaagcggggttcggggatgggaagggggcggggcgaagcgagcaaaaagttccggggaagccgagaccgcgaccttccgcgctttacggcccccgggcac

SEQ ID NO: 1405 - DNA, 62650 bp, Homo sapiens
ttcgtttgataaagaatatgaatgtttataaaccaatattcaaaatagctgcacacatctgttttcacttgaataaaaaaacacattgtgacaaattttataaccttaacttaaaatacatgaatattaacatttactaatatatttacacattttatttacatcatcaacaaatctgatgaaaaagagcatatgtgattattttaacacagcaggttatgaccagtctttgaatattgatccaggaatgtgcactgcatttaattagaaaacatacttttaactttttctgaactcctagggcatatctattcacacaaaatatcgcaaggcctcagtttaaaaaaaaaaggagcagttgtatttaatcttaagggactacaaaactgccttgtttaaaaatatgaaaattcttatgctatttttaagatacttttattacttttatttttcacatcaaaattacttaattgaacattaagcatctaataaaaagttataaatattctatcacatgtgatactatgcacttcatgatttgaaacagctacaaactcattctcatagaatatgaggtagggccagtagtaaccccattttacaaaggaagaaaatgagatgtgactatttactagtgaaaaggctaaagttaaatttcatttctcaaaaactacaccttcttattagcctaatttcttttacaagtgaagcggtctggccaggtgcggtggctcacacctgtaatcccagcactttgggaggccaaggtgggcagatcacctgaggccaggagttcaaaaccagtctgggcaacatggcaaacccccgtctttactaaaaatacaaaaatacaggtggcgcgtgcctgcagtcccagctactcaggaggttgaggcacgagaatcccttgaacccaggtggcagaagttgcagtgagccaagatcatcccactgcactccagcctgggcaacaggggaagactccacctcaggaaaaaaaaaaaaaaaacacaagtgaagaggtctgtttcaagtgggggtggggaagtgtgtgattgaggtatatctcagagagaaaaaagggaattactttctacattgataatttttttttaatgattagggtttacctgaatatgtctgcctaatcaatggaagttactgacagaggactgcaaaatccttcggcaagacaatattttctacactttaacttttcctcaggttcaaacactgcattttcttactcaaagatcttctcaaagtaagatatgaattataatcctgatgacaaaccaagagctctttaatccagtgggttttattgctctaccttcatttaatttgatacatatttcccccctctgagcattaggtaagttaataaagcattataaaaataaatttaaaacataaaactaaatgagatctctcaggttcttctttgaacaaagatgtttctgtaaacacttttacaccagtatcttaaaattccaaattattcaagtatctctttaaacatatggcttcatatattaataaaaattgaagcaaatatgtgaaatctttaaatcctcatctgtatttccacagaaatcatttacaaaagctacttgcctttttaaaagtcttctcaatactctttcttgagaactagaattccaacttgcattactattacttgcactgcaaatctttgagatttctacttgtgtttttaactcctattatttccttaattctcctttccctttacccttttttcctctcccatctttgcatctttgtcacattctgttacaagctcacagttaaaataaacactagggctacccacagactcatttttataagaaattaaaggcatggcagtcttcacttcaaaagctaaatacaaggccaaattccctttccaataatgagtttcttacatgtgttcccagtggaaaaaaaaaaagctcagctgctacaatagaaacatatcagcaaagtagatccaaagatgtgccaatcagaaacaagcaagcataattctcataaagttctaaactatactcatgttgaattgaattgttttagtgattccaagacaatactttactgttcccattcagtttagagttgttactaatatgcagattcatgttgggtatatgcagcaaacaactttttgttgttttaaattttgttttaaattccactaacactcatatttattatttcaattactgttctttcaatacagtgacagagctgtacatcaggatccatgcttccagtgtccctggatccatttttataagatgaatctttacagatttgagaccatccacttggtttctcctttatttgttgaagacctacaacataagggaaaaaaaacattaaggccaagaaatttggaaaggaatttggcctttttgtttgagatattaagataacccttgaaaataagttaccacttacgtgtaataattggatcaatgtctcttgtctgagtggcaacatcagaggcacaaacttgccctatttggatcagcaaagacataatatcctcatacaatggaggaaatgctcgacaaaaagagaccaaacttggcagagttggcataaaaaaagcataccgcttagcctgtgttaaaactgttggaaaaaaatgaaacaatattttagtttacaaatataaattcaacacagcttacacaacatactaaggggaactatgctctgtgctggagatatgaagttctctaaacacagccaacccgtcttcagaaagctcacaatctagtagtctcagtctttatccaagatacaaattattatgcacaagttttgcaataagtacattacatgcattatttcattgaattcctacaatcttatgaatgaccaaagtactattatgacactcattttatatatgagaaaactcttaaaaaaaggttagagaggttaagaaacttgttaaagatcacaagccagttagtggtggggctgagattgaattcaggcagtgtaaactcttaatcactacaaataattataacaggatataaatacgatgaaaagaaaaacaacagggtattatggaaatattataatgagaaagaatactaagttaactatgccattacattaagggttgcattatagttcatatattttaaagtagtttattttcagaccattttattctacaaaccagaaggtggttaaaatatcagaatatgttttagaacttatgaagacatctaatacatttatctttcatttatacatatgatgatatttttctggaactctgagcatttgtaataaatgaacatttgttatctactgatacaattacattctgaaagtgtatttgttttccatttataaaatacagaaagcttatatttacaaatctatatatactcattcacaaaatgaaaaatacaatttgcctacctattcattcccactacactataaatcacatttgtaaacagaagtttccaaaagaagaattcaaaagacggcataagttaaactagtatttaacacatattgtatcatactgtctcagagtgacagaaaaaacatattgcatcactaaatgcagaaaatataggaactataataatttatgtcagatgtttgttgatgttgattggctacatacctgttaacaaagttcccatgacattgacagctaaacgagccacactaagtgactttggtaatgcatattgtatacacaagtgagaaagcaactggatagcaaatatctgcaatacaaaatccagttattacatgtttctcaagaatatctttaggtattaaaaattataaaatgttttgtataactagtaagactggagagagagatcaattgtcctaaagctccaaaatgctcattacctgtttctcaagttctggctgtgcaataagctcaggtatgaaatctagacagatgtgcatagatggaatacctgcgaccgtcagaggcaaaagttcacatggataaccctatctcaacaagaaacgggaaaaaagtcagaaataaaataactataaaagtacagataaaaatacaaatgaaagatttcatttcctttctgtaaaaattgctcagaaggctatagtgccccatatgtaacctggcatttcacttttctgatgcactagaatagagattaaactatcgaacatttcattaggttaaaaaaaaaaacaactaaaaatctggatttttctccatattgcaaaagcccatggatcatttgtgttttctctggtttctaaatgatccctgttaatatagtattcaaagcccccaagaaaaataaagttcaaacacaaagcatcattctttggaaacagacctgaaagtgaacaagcttagcaatgttgggatctgcaatgtacatttggtgcaagagacaacagataaggcactgaacttctcgaaggttacagagcaaattgtcttctccttcctccattcccttatttggagcgctggtggtaataacactttgaacatttcttaacaagctatctggattgacaccatttgctttctcctcttcagtaggtaggcaaatctctaagagaatctggacagctgcactatcctataagcaaacaaaacatagaaaaagtaagaagtttctaagaagttaaaaaacaaatcagattttattttcacatgaacagatatgataaaataactaatttcttaaacacacatacacaaagaggtacttctaagagcagaactgagcaatctgtagagcagtggttctcacctttttaggattatgaaccccttaagaatctaaagaaaactatgtaccctctcccgataaaaattaacatacataaacaaacatcattacataatgatatcacatatctctaaaatagatccatggactccagtttaagaatatctactagaagagtatcatgaattcagttacatccaaaacaggccctaggcaaaaatgacttctaccagaatgtcctttccttcctcttaatctcctacttttcccagtatgctatcctgatttccctttttttcaacctgtttaaggctctggtttcacaaggaaagagtctaccttaccatccattccacctgcacaactcattgctcagtctacaggcttgagcatcattgcacagagcagtagcttgaggggtaatggcaatatatttgaggcccctatatataaaggagagctaaaatcactctcatctagcagaaagaagtaaaaaataaaaatgaatacatgacatccacctctgatagacagctactgcctaaggtagagaaaacaattacttgagctaagtgattaagaacttattataaagtgaggttagactactttataatcatggttcttggggaaaggagtttttggttattgttattgttattgttttgttttcttttgttgttgttgactcaggagccagagtgcctaggagtgaatcctggttctgacatttactaaatgtgtaaccatgagcaagtcacttaacttctctgggtcacattttcctactctgtaaaaatggagataatactctatacctcataggtaggttataaaaattaaatgagctaatatatttaaagaacttaggctagcacctaccatatggtaagcactacacagatgttagcttttatgatcttcaatcccttatctgaaactcctaggaacagatttattttattgatttattttattgatttttgttgttgttgttgagatggagtctcgctctgtcgcccaggctgtagtgcagaggcacgatctcagctcactgcaacctccgcctcccgggttcaagccattctcctgcctcagcctcccaagtagctgggactacaggtttgggccaccacgcccggctaatttttgtatttttagtagagatggggtttcaccatgttggccaggctggtctcaaaactcctgaactcaggtgatccacccacctcagccacccaaagtgctgggattataggcatgagcaaccatgcctggccaaaaaacttttctaaatataaagttgaactgcttatattgtcatggtatttatcactgcctgacattttattatacatgcagttgtttttctgttgtctgtctccataatttgacatttgatcttaagaaacaaataactaaggattttgtcttcttcaccactctatccccagttcctggaacaatacttggcacacagtaggtgtcccagtaaatattggttgaatgaggccgggtgccgtggctcatgcctgtaatcccagcactttgggaagctgaggtgggtggatcacctcaagttaggagttcaacacaagcctggcaaacacagcaaaaccctgtctctactaaaaatacaaaaattagccaggtgtggtggcatgtgcctgtagtcccagctactcaggaggctgaggcaggagaactgcttgaacccgggaggcggatgttgccatgagccaagattacacctctgcactccagcctgggtgacagggcgaaactctgtctcaaaaaacaaaaaaaacaaaaaaaatgtgccgaatgaataaacatgtaactctaaactcagaataggtaaacacttaaattttattaaaatataaatcttatttaaatggctatttcattcatatcatgaagattattcctgatttcagaaatacaacatatctgatactcagaagcaaaggtaacatcattgtaatagattctataataaaagaaatgcacaatatgtcaccaatgtacatggagcgcacaatgtgccatctattgaactgattatactagtagagaagcccttgctctttttgactaaattttactttagcaaaatttacctgagcggccagtaatgcatttttcaattcttccctggtaacttccggagcatcagtttgtccaactaaaccaattgtattattctgggaaggcctatcttgctctgtttccttcagatgagcactaaggtaggctttagatgcaagaagatatccattcaacatgtgtagggtaatatccatcagtggggggcatctaaacaaggaaagcagaaaagaaaaatatatcagaaagaatataaatttataaattagccagaacatgatcaatttagtttaaatgctgagaaaaacctgagtagtacatactaacttttcccactaaaatattcattctcaaaagtttaatatatgtttcttattctctgtatttcaagcccttatataaatagtattacttgtttcatcttatcagctaaagtcaaatatgtataatgtaaattctaaagaaaagatgaccgggtgcgggcaaaacaatattgcatgaagaaaaactgtaatacacgtacaaaaagctgatatcctttatagataaagagctctttaagtcaataaaaaatataggctaaaatataaagatgaaataaatggccagtaaatactgttaaatgtccagtctaataagaatataaattaaaatgggaatctattttcacctatcaaattggaaaacattatatcaaatagtgcaggaaagtatatactatcaaacactgctatggaatgtaaaccagttcagcctttctacatagtagaatgaaaatctgaattaaaagtcttgaaaatgagcacgacacttttgccccaataattccattttcccatgttctaatgaaatactcagcatggggaaatgcacataatcaccaaagcactattgataaaagcaaaaagtagaaataaaatatcctaggggattgggttaagcatagctctataaaatggaataccatatagccaattaagataagaatataaactaggcacagcagcacacaactgtaatcccagctactcaggaggctgaggcaagaggattgcttaagcccaggagttcaagaccagcctggacaacatagcaagacccccaactcaaaaaataaaaataaatttgaaataagaacattaacatgaaaaaaggttcacaagttgttaagtgaaaaatccgagctacaaaaacattagatacaatttgataacagaatttaacaacttccttaaaaactgaatcacctaaggtgattcaggtgtaagctcacctatttcagtggatttttaacaatgataaatcattttttcaagaaacagctcttttctagaagtgttatttattgtggtttccttttattagatacttaacatcatttacatacacagtttgttctgattcctatttcctatgagatcttaatcttaccaaaccatatttagctaattttgtagattttgtcacttcgagaatgtcatcccttggttgatgacagacaagtttaaatatcaagtgtgtcctatttagtcttccttactagtttctctctcctctaatccacctagcacaaagcatcttttcctaagttataaccccaaccacattagcctaatattcaaggccctcgatagcctgaccccaatttaactttccaactgtaaaatgttctcttttcaaaaataaccctcttcacggcttcctcattcttgcttctaaacttctgctcatactactctttttctcaaagtaccttccttgactccctgacccccatctttatactattagatgaacaaatattcacctaaaccctatgtccactcttctttttttaagtttaaataaagcagtgggagtgaagagggaacaaagaaatctgtacctgattatgatcaatcagttgtaaataccactgcactcgaaccagccctaactccactctttgaaacattacccatgtcccatctcctctgcatctttcctgaacttttaagaacattcatttaccacaccattcatctacatgagcatattacgtaacttatcatgtatctatcttatgtcccatgcaaatgataatcactttaaaggaaagcccctcaacttatatgtttttgatagtacttatcataacaagtgtgactcaaagattaatgataggaattaactaaattctaccttttgagatgaagccacttgaaagcaatgctgaagtttagcaattggtaaggatttagagccaaatgtggaatcaatgaagctaacatcactattgtgcatgccaaaaagatcacagttttaacgcaggtaacggttcacaagaaaccagttttttaaaaacctttttaatgtgagaacagaaatagttattctttactggtctaaattgtgagagagaaaaaccactatttgtggcaccaaaaccaagaatggcatttctctaaagctaggttttattaatcacatactaaatattaaaatgaatatacatttcatgaataaacacaactaaaaaaataagacaaaaaaccgcacaggtcacactgcctacttatctgcaagaaaaattaaaatataagtttaaactgaatttcatcaatttcttttgactctccaaagtacagctctataataaaaatgaaactcaaatgacatgtacctgtgaaccctctgatcacaccttaggacaatgagaggatctatcatcaggtcattctgagtatacttttgttgtcgtacaaactttattgaaggctgaagtgcattaaccgtcattacccatagcctgataagaaaataatcacatgttcaaaacagttttttatatattaaaatctgtagccatccagtcctttctatcttagaaagttatattcagtaaataattagaaaatacatatgaatgaactttgaaaaaatttaagctacagacatctaacctattaaaatatctctttaaaaaacacagagataaaacagtaaacacaaagtagtttcagaaacgttcacagttgtaatggaataatcatggcatataaaattaaaacctgagttaaaaccttagttataccatacttgctatatgactctgtgtaagtcactgaggctctctaaactgtttcctcgtctgtaaaatagaaatgacataatacctgtaaatgaaataagacttgccaaaacattctgtatctagttccataaatataagtcactattctggatttatcatcataaagtctccaagtgagatgccactttgagattagacattaatagattataagtggttactaaaatgactgcacatcataattactaagggttatgcaaatacagaaggtacttgatcttacagtgaagcccaggaatccaccagagaacttccccctcttaaatatgactgtataaacaaggatcatcagacacttaaagaaagcttttactttgaaaaagattaaaatatacaaacagaaaaaaaggaactccaaacagaaaatgtagggataaggagaaaaaaaattttcgaactattaatatcctaaaagaataaagtattttatacatgaaacaagaacaagaggcatttaagaatattcagataacaaagagctcttagaattaagaagaacagggcctgacacagtggctcacacctgtgaaatcccagcactttgggaggctgaggcagaaggttcgcttgagcccaggagttcaagactagcctgggcagcatagtgagacaccatctctacaaaaactaaaaaaaattaggcaggcacgggggtatgcacctgtagtccagctatttgggaggctgaggcagaaggatcgtttgagcccatgagttgaggttacagtgaactatgattgtgccactgcagtccagcctgggtgacaaagcaagaccctgtatctaaaaagtaaaaataaaaaataattttttaaaaaatgaactagaattccacacttaggctaaatatcagtcacatatgagaataattcagcatctcaaaaaagttaagtttaccacactctctttctcaggaagcgagatgagtgtgtgttccattcactaaaacgaggatataaaccaagaaagagaaaaatatggaatccaacaaagaagagtgacaatagcaatttgtcccagatgggaacatgaagacagaaagctctgaaaggaatgtctccaagaaaaaaaaaatagtgtttcttttgtttttttttgagacagggtttcagtggcacgatctcacctcactgaagcctccatctcctgggctcaagcgatcgtcctgcctcagcccaccaagtagctgggaatacaggcatgcatgcaccaccatgccctgctaatttttgtattttttgtagagacggggtttcaccatgttgcccaagctggtcttgaactcctgagctcaggtgatccgtccacctcggcctcccaaagtgctaagattacaggtgtgggccagtgcacccagccaaaaaaatgttaatgatacattatctgatgtgttatgattaagtgtgaagtaaatttcccctcaataatgaagcttggggatgaattagttattggttattgataccaatttaaaaaactgagcaaatagaaaaaaggtattaactaacccaacatatatgttgagtaagggggagggcacttgcataagaatgaaattgtaattaaaggattatcacatagctcaattatgaaaccacttctgtagtcataataatatgcatttgaaatattgctttaacaaaaattttaatatacctgtgttgtgagaaacaggaaaaggggcaatgtgtattagaagaagtgggactcacaggagtggaagcaagtaagagagctaactaaccttcaccttgtagagtagaaagtcaacagataatttctaaattggaaaatcaggaaattacagtcattataagagatatatggggaggatataaataccagaataaaaagataaaagagatgaaaatagtagtctctggggagctaaagtctaaaatacaaaggtgtgaggcagaccttatatactacttaacttgtatactatttatagcccagtattctgttttctagacctgtccaggtgttaaggatccaatctatgaaccagcagagacccaatgactaaagacaaactttgctgcacactgaaatcacctggggaatcttttaaaaagtactgacgcctgactcccacccacaaacagtctgatttaattggcatgggttccaacctggggatcagtagtggtaaaaactctccaggtgattttaatgtgcagcaaaacttggaacaactgcaaagatccaagatataacagtgatctaaatcataattagccacaaataactatacatgataacccaattttcaagaacttcctaaagttagaaatactgtaaggtttctatttcaataaagtttgctttacttaaagatataacaactatttagtagtcttaagaaaggagatatattgtcatatagtcaacaaatactgctatgagtggtgaaaaattttttaaacaattaaatttaggttattgtatattatccctgctatataattatctattacatgtaacaatacactgaatttaccttctaggcatcacagtattaagaaccatccatagtttattgactgtttgcagaattctccgtggaacccctgaattcaatagctggctcatattggatgttaacacttccgcatatggtataagttcactggcagagagtagagtcaagtgttctataatctgcatcacttgtgtgttatttactgggacagctgaaaatgctaaaaagaaaatttagcaatcataacctaaattctgtacagtttatcaagcaggaagtagtagtgttctctcagactatagaccaaacaaatcaagaaaacaatgtggctaaaaagtaactatagttacttgctattgtttcctacagaaacctaggtacaatttcaactaaacttattaaaataagggccagatggatgcggtggctcacacctgtaatcccagcactttgggaggccaaggcgggtggatcacttgaggtcaggagttcgagatcagcctggccaacatggtgaaacccctctctctactaaaaatacaaaaatgagccaggcgtggtggcaggcacctgtaatcccagctacttaggagactgagacaggagaatcacttgaacccggaaggcggagattgcagggagctgagattgcaccagcgcactccagcctgggtgacacagcaagactccatctcaaaaaaataaaaaaataagggccctaagaaaaattcatgcaagtgtagttgttctttcataaagaacaaaaatattttttaaaaatcacattaatgggataggcatggtggctcacacctgtaatctcagcactttgggaggctgaggtaggaggattgcatgagtccagaagttcaagaccagtctgggcaacatggcaagaccacatctctacaaaaagtaaaataattagctggatgtggtggtgtacctgtaataccaggtactcgagaggaagatcccttatgcccaggagacagagtttgcagtgagctgtgttcctgccactgcactccaaccttgagactgggcaacagaccctgtctccaaaaaaaaaaaaaaaaaaaaaaacactttactgacccgaagactaatcttattttcttggtgattcagactgatcttattttttaatttattttttttcattttagagatgggagtcttgctatgttgcccaggctggtctttttttttttttttttttttttttttttccctcttgcctttaccaatcaagagcccaggatggttttgaattcccggcctcaagtgatcctcctgctttggccttccaaggtgctgagataacaggcgtgagtcactgtccagcccagactgattttaaaaacaggactgaaagaggaaaatatgctgaagtattgcttttgatagctaacatttatttgaaaggctcaaacttgaaactttcctccaggtggtccccttataggatgtaagcacccagaagattgctgttactaaaaaatatctagaactatgctctccaataacaactaaccacatctggctattgagcatctgaaataactagtccaaattgaggtgtgttataagtgtaaaatacacaacagattgcaaagactaagtgcaggagtcttagtggggggtaaaatatctcattaaaattttaatattgattacatggtgaaataatattggcaggccaggcacggtggttcatgcttgtaattccagcactttgggaggccaaggcaggcagactgcttgagcccacgagtttgagaccagcctgggcaacatggcaaccctttctctacaaaaaatacaaaaagtagctgggtgtggtggcatgtacctgtagtctcaggtactggggaagctgaggcaggaggattgctagagcatgagaggcaatgagccaagattgcaccactgcagtccagagtaggcaacagaacaaggctctgtctcaaaaaaaataaagaaaagaaaaaatattggccatatttggtcaaataaaatgattatttaaattagtgttgcctgtttctttttcctggaaagtttataggtgttacagctcacattatatataggtgttatagctcacattatatttctatttaacagtgctgatctagaagaacattctccattacatagtcctattccactgcacatatttctttttttgacatggagtctcgctttgtcacccaggctggagtgcagtggtgcaaccttggctcactgcaacctaggcctcccgggttcacaccattctcctgcctcagcctcccgagcagctgggactacaggcgcccacgaccacgcccggctaatttttttttgtatttttagtagagacggggtttcactgtgttaggcaggatggtctcaatctcctgacctcatgatccgcctgcctcggccttccaaagtgctgggattacaggcgtgagccaccacgcccggcctacactgcacttatttctaaccagtttagaacctttctaaaaccacaccacctttttagtgatataatataggacctatgagagaaaagatacaagcacatcagaaagaaatggtaaaaattcctggccaggcacagtggctcacaccttaatcctagcactctgggaggctgaggcaggaggatcactcaaacttacaagttcgagaccagcctgggcaacatggtgaaaccccatctctacaaaaactaaaaaaatcagccaggcctggtggctcacacctgtagtcccagctacttgtgggactcaggtaggaggactgcttgagcccagcaggtggaggctgcagtgagctgagatcacgccactgcactccagcctgggtgacagagagaaagacacacaaacacaaaaggaaaggaaagggaaaagggggaaagggggaaaggagtaaaaggggaaagggggaaaggaggaaaggggggaggggaagggagcataaaattccttaaacgcaaagagtattttatatacttaaaatacattcaccaaaacattgttatatccatgggaaaattctgtatgattataagatttcaattagcctagcatctccttgtactacaaaaggggttaaaggagtatcaataatttactataccttcttggagttgtttgggagaatgatttttagcattattagtcaggagcattcgccgtagcagggcatcagtccctgtgatttcttcttcacaaatccagtcatccacaatacataaatgtgggtagttagtagcaaggagacgtagtaaagctgaatgcaacccttgaaaatttacagaaaatcaattggattcttcatgctcaaacaccagaagcttccccacccctctcatttttatcaagccatcagcccacaaggaaagagggttatgctctaagtcagtgtttctcaaaaaatgattagatggccgggcgcggtggctcatgcctgtaatcccagcactttgggaagccgaggcgggtggatcacctgaggtcaggagttcaagaccagcctggccaacatggcaaaaccccgtatctactaaaaatacaaatattagccgggcgtgttgttgggtgcctgtaatcccagctactcaggaggctaaggcaggagaatcacttgaacctgggaggtagaagttgcagtgagccaggatcgcaacattgcactccagctcaggcaacgagcaaaactcccgttcaaaaataaaaaaagaatgattagagcaccaccagcaccataagcttgggaagcttgtttcatgtgcagaataatgaataccatcccaggtactagatcagaagctctagaatggaggcctaggaatgtgcacttcttgtgcatgcaaactacagtttaagaacttcctgacagtcatttgatcaagggaaactgcttaaatgaagatcctgaagtaatgtgataaacagtgaggtgggaactactacttataaagaaagctttcaactttcttccaccccacccaacataacagtctcctaaagttgtttgacatagcaatggttcaagagttcagggtagaggaaagaaaaggaggagaaaagaatgtccatttggggactatcatatatggtttggaaaaggtcctattcagaaatactgataggcttctgtagagaacatgccctttcctccaaccctgttgagaatcatcactatagatatggtaaaattaaagttgcccactttgaatacctgaaaggtctcaggtactttatgtacgttttctcatctctccctaacattcatacaaagtaagcaatgcctccattctactgtaaggaacaaacaatgctgaaagacatttattaacattaacaaccctaaagtcacacagtcacatatgtcagccaagagaagcagtactgatgatacccacaatggggggcattttttcttggttcaagaagtattaaagaagaccaaaagaaatgggaaaacttgttaccaaatcaaagccttatttataacattttacctataccacagtttgactattcatgactattatgtataatgttaataatgagaggctgtgtgcggtggctcatgcctgtaatcccagcaccttgggagactgagggagatggatcacttgaggccaggagttggagaccagcctggccaacatggggaaatcctgtctctactaaaaatacaaaaattagccaggcgtggtggcacacgcctgtaatcctggctacttgggaggctgaggcacaagaattgcttgaacctgggacgtggaggttgcagtgagccaagatcatgccattgcactccagcctgggtgacagagcaagatgctgtctcaaaaaaaattatgacaccataaaaatgcctatttagttaatgaattaacgaagtactactatgctaagtgcttcacacataagtacctaataaatattgttgctaccatactattatcatcataacagtaagactacgcagtagtagtaggaatcaaagtactttagatctaattatccttttattatgcaaatcaaatgataccactgctttatcccagtagaaacaatacgcaattccgttctcatagaaacagcttaaaattgatgtttctgtgtttgaaaagacatcgtaacaatcaaaaatggcattactttaacatttaaacttctaaatgcatacaggagtatatatacagttaaaactatacccaaccatcacaaaaaagactgcttacaaaagtgtaaactaatcaacatttcatactcttttcaataaagtatatcaattgccaaatgctgttaaaaataacattattttctggaaacagattatacaaagaagccaggcacggtggctcacgcctgtaatactaacactttgggaggctgagtagggctcttcacttgaggtcaggagttcgagactagcctaaccaacatgatgaaaccacatctctacttaaaaaaaaaaaaagattatacaaagacataagtaaatacatgctgcagacatccggttaacgatgagcaatgaaggctcatgtttctccttgaaaccaaccataataaagaaaaaattccggccaggcacagtggctcacgcctgtaatcctagcactttgggaggctgacgtgggtggatcacctgaggtcagttcaagaccagcctggccaacatggcgaaatgaggtctccactaaaaatacaaaaatttagctgggcatggtagcaggagcctgtagtcccagctactcgggaggctgaggcaggagaatcacttgaatctgggagaagaaagttgaagtgagccaagatcgcaccacagtactccagcctgtgagacaagagcgaaactccgtctcaaaaaaaaaaaaaagaaaagaaaaagaaaattccaacttaacagaaagaaaaacacccacactcaaacattaaagaggtatttaattaagaaaaaatctctagaaaattagctgggcgtggtggcataggcctgtagtccccgctactagagagactgaggtaggaggatgtttgagcccaggagtttgaggctgcagttacccactgcactccagcttggataacgtagtgagaccctttccctaaagaaaaaaaaaaagaaagaaagaaaaatatctaatttcaaaaaacactacaatatttctacttaacaggatttatagtaaaaatattacaatatatccatactatggatcataaaacaatcagaaacagtaaggcagatctacctgtactgatatgtaaagatgttcaagactccaagaaaaaaaacaagccttagatgaggcaggggaggccgggcatggtggctcactcctgtaattccagcactttgggaggccgaggtgggcagatcacttgagaccaggagttcaagaccagcctgggcaacatagtgaaaccctgtctctactaaaaatacataaattagacaggcatggtggcgcacatgcctgtaatcccagctatttgagtggctgaggcatgagaatcacttgaacccaggaggtgggggttacagtgagccaagatcatgccactgcactccagcctggatgacagagtgagccactgtctcaaaaacaaaaacaaacaaacaaacaaaagaggtagtgtacaatactattcagagttaaaaaaatttttttttttttacctctgttaagtgtctgttaggttcaaccacaagaacctgctgtttctgtagctctaaattagctgaatatctgcaatttcatacagttcaacctacaggagaaaaaagcctgaaaatacatatcaactgaaaatagctagggttgcgttttagggggcaggctggtttgcaataactgaaataatagatttagtgagggaggcaaagaggaatttcactcttgaactgtttgaatttttaacattaagcacctattacacttcataacattataaacagaaaggttttttaacaataaactttagcagtaaaaagcaaaataaaacatacctcccaactcctgctgcagcccttgagcctgtcgaataaggaatttgataggaatctgatccattaaagaagaagaatatgatttgggctttctttgcatggcagctatcaaagataaaaagtgtaaaataaataaaatgtccagaaacaacagaaatcttaaccttcaacccaaatggaaacaaaaacaaagtcaaattacttttaatgcaattaacctgcgaatatagcatataaaagatgaagaatcattacgaaaacaagtggctacacaggaagaacaagaacatacctggagcaagatctggaaaatgtcctgaaatttaaaactagacagaagaaaattcataacaggttgagagaagccatgtgcaaaagtgccctacactaaaagaaccaacaagtgagtcaagattttccaaaacctaatgacaagatcaaatgtgatcatgaacatatggcctagagcttcatgattccaatgcatcttataaaaagaaactgtaattttatctttttttttttttttttgagacggagtctcactctttttgcccaggctagagtgcagtggcacgatctcagctcactgcaacctccgcttcccgggttcaagcgattctcccgcctcagcctctcaagtagattggctgggataacaggcatccaccaccatgcctggctaatttttgtatttttagtagagacagcattttgcaatgttggccaggctggtctctaattcctgaactcagggggatctagcctgcctcggcctcccaaattgctgggattacaggcgtgagtcactgggcccggccaattttttttttttttttttttttttgagacagagtctcgctctgtcaccaggctggagtgcagtggcgcgatcttggctcactgcaaactctgcctcccaggttcaagtgattctcctgcctcagcctcctgagtagctgggattacaagcgcccaccaccacgcccatctaattttttgtattattagtaaagatggggtttcactgtgttagccaggatggtctcgatctcctgacctcatgatccacccgccttggcctcccaaactgctgggattacaggcatgagccacagtgaattttatcatattatatacaatagtggtgactaaatctttttttttccctgagatgagtcactctgtcacccaggctggtatgcagtggttcaatcttggctcactgcaacctctgcctcctggattcaaacaattcttgtgcctcagcctcccaagtagctgagactacaggtgcccgccaccacgcctagctaatgtttgcatttttagtagagacggggtttcgccatattggccaggctggtctcaaactcctgacctcaggtgatccaccagccccagcattccaaagtacaggcgtgagccatcatatctggcctctttttaaattaagtcaggcaatacgaatttgacttccttctctcacaactcctaccctcaaccagccatgtccaacctttttttcttctaagtccattttaatttctgtacttttgctgctatcctaattcagtgcctactcaccttttgtttaaatatcttctatggcccactttccctgcctccaatttaatccatccttcaacctgcggccatagtcatcttatttaaatagagatttggccaccttcagtgaatcctcagatcacacagagtaaaggtccttgccagtcaatagtatctttctctgtctcatctctactgcattctatatgcctggcacccaaagctcattccaaggtactttcctttacaccacaggaatatatgagaatctcaatcagggtgtttgtaatttcacaaaggatgtacaatgtgtttattctcttacaaactacaaacagtaaagctcaaccatttttcttttattaaggacaagaagtatgtaagtgcaagtgttagaataaaggttgagaatcactgtctatatagaccacatatataccatatactctcatttagatataatctcccttttaagttaataaattagcatagttttccataccaatcttttatgaattaagaaaaaatcagaaggcagttaaaacaatagttataggttccagaaagagataaatcctggttccaatacttattacaatacttaatactaacttagggaagttacttaacttccttgtgcctcagtgttctcccctgtaaaataaacgtaaccacacctatctcagaattgttatgagggtttacatgagttaactataagactaaagtaaggccaggcaaagtggctcacacctgtaatcccagcactttgggaggccaaggtgggtggatgacttgaggtcagaaggtcgagaccagcctcaccaacatggtaaaacccattctctactaaaaatacaaaattcagtggggcgtgttagtgggcacctgtaatcccagctactcaggagtccgaggcaggagaatcactggaacccgggaggtggaggttgcagtgagctgagatcgtgccactgcactctagcctgggcaacacaacaagactctgtctcaaaaaaaaaaaaaaaaaaagactatatgtgcacgattaaaaagcaaaaaattatttcaggttcctagataggaagacttagtactgcaaagacgtaaattctctccaaattaatctataagtttaacataattcttatcaaaatcccaacataattttcatttgtgaaatttaacaaaattattataaagttcatggaaaagattaaatatgtgagaatatacagaaattccaaacaagaactgtatcaaagacacagaaaatgtcaaaacataaaaaagaaaatccaggccgggtgtgatggctcacacctgtaatcccagcactttgagaggctgaggtgtgtggatcacttgaggtcaggagttcgagaccagcctggccagtatgatgaaactccatctctactacaaatacaaaaattagccaggaatgtggtacgcacctgtaatcccagctattcaggaggctgaagcagaagaatcgtttgaacctgagaggcggaggttgcagtgagccaagatcgcaccactgcattccagcctgggtgacagagtgagattttgtctcaaaaaaaaaagaaaaacaaattaaaaactacacacaaaggtcaggaggatcactcacacctgtaatcccagcactttgggaggccaagccaggaggactgctcgagcccaggagtttgagatcagcctggcaacatggcaaatcccatctctacaaaaaataaaaaaaatcagccaggcatggtggtgtccacctgtggtcccagctacactggaggctgaggcagggatcccttgagcccaagagatcaaggctacactgagccatgttcatgccactgcactccagcctgggtgacagagtgagaccctgtctcaaaaaataaatagatgaaatgaactatacacatgtaggaagtataaacacaggtaaaccttctttttcaaatacaggaaaagataccactttataatgatatcatgcatgctaaatctgaccttctgatattatgtgaagtaactaagtttcaaagcccatttcagtgacattctctgtgtgcgtgtgtgtgcgtgcgtgtgtgtgtgtgtgtgtgtgtgtgtggagatgggcatcttgctgttttccaggctggtgtcaaactctgagcacaagtgaccatcccatctcagcctcccaaagtaccaaagtactgagattacagggaatgagctaccatacccagcccaatgttaacggcaaaacgaaactcttcggccaggcgcagtggctcacgcctgtaatcccagcactttgggaggccgaggcaggcggatcacgaggttaggagatgaagaccatcctggctaacatggtgaaaccccatctttactaaaaatacaaaaaaattagccgggcgtcgtagcaggcgcctgtagtcccagctacgccggaggctgaggcaggagaatggcatgaactcaggaagtggagcttgcagtgagccaagatcatgccactgcactctaggctgggcaacagagcaagactgtcaaaaacaaaaaacaaaaaacaaaaaacaaaaaacaaaccaaaacaaaacaaaaaaaaagaaactcttctacttttttttttttttgagacacagtctcactctgtccaccaggctggagtgcagtggcgcaatctcagctcactgcaacttccgcctctgggttcaagggattctcctgcctcaacctcctgagtagctgggattacaggcatgagccaccacacctggctaatttttgtatttttagtagagacggggtttcgccatgttgaccaggctggtctcgaactcctgacctcaggtgatccgcccacctcggcctcccgaagtgctaggattacaggcgtaagccacctcgactggccttttctattgtttttgattaggttgttactctttacactaatggaaggaagaccggtcaaagactcaactcaaatcaagagaaaaaaattcagttacagctccatcaggtgttaaatttatatttagtgaacaagacctatacaattgttaaaatacaggcaattctgttatctattaatttagcctctgataaggaggactgggccataaatcgtggttacataccccaacatacatgatttatgtatcaagtatacaatgcccacattgcaaagattataaaatgatactagagtttattaaaatattgcccttatcaaagaacagtttggaaagtaacaaaatacaagctaataaaataaactaccactagaaccactcctctacgtacaacttacctaaagtcttcgtgtttgctagaagagcctcttcataagacagtatatagtagagcaccaaaagctgtgctgtgatactgaaacgctgattaaggcggatgttgtcaccctggaggtaatattacaaatactctgaaatactctgaatttcacgagtgcttttttttttcttgatagtaaaagaatcaaaatagactattcagcattgctgctcctaactcaggtaaaacaggagaaatgttgctgtgtgtgtattaaactcaaaaaaacaacatgaaatctgagatggcatgagagatgaaaggcaacatgcttaagtggtctttaagataagacaaagaaaagacttcagctactactcaatagcaaacccatcaggctgcttctgaaagacaggagtcccaagtattatatgaaattaccatgaaaaaagtaactcctaaataagacattgtatacttaaatatatttgtgaaaaatgcaactgtttttcccttctaacaaactggggaaaaaatactttcatcaaattttccctgaatgagccaggagcagtggctcatacctgtaatcccagcactttgggaggctgaggcaggcagatcacctgaggtcacgagttggagaccagctggccaacatagtaaaaccctgtctctactaaaaatataaaaattagccaggcgtggtggcaggtgcctgtaatccctgctactcgagaggctgaggcatgagaatcacttgaacccaggaggcagagtttgcagtaagctgagatcgtgtcactgcactccggtcggggcaacagagtgagactctgtctcaaaaaaaaaaaaaaaaatccccctaaatgaatgtaggtgtatcttagattcccaggatgctaaacaaacctatgctgaatatcttgatatcccacacagtacttgatcaaatacacaatctccagggaacccattagactttaaagtgaagcttaaaaaaaaaaaaattactggccaggcgcagtggctcacacctgtaatcccagcactttgggaggccaaggcaggaggatcacttgaggtcaggagtttgagaccagcctactcaggaggctgaagcaggagaatcgcttgaacccaggaagcggaggttgtagtgagccgagactgcccattgcactccagcctgggtgtcacagcaagactccagtctcaaaaaaaaaaaaaaaaaaaaaaaaaaaaggccaggcacagtgactcacacctgtaatcccagcactttgggaggctgaggcaggtagatcacctgaggtcaggagttcgagatcagcctggccaacatggtgaaaccctgtctctactaaaaatacaaaacattagccaggcgttgtggcaggcgcctgcaatcctagctactcgagagactgaggcaggagaatcacttgaacccggcagacagaggttgcagggaggaggaggttgcagtgagctgagatcgcgccactgcactccagcctaggcaacaagagtaaaactccatctcaaaaaaaaaagtgcctgtttagcaaactacttggaactaataccattcttttaatttttagaggtgatctaaggaaatttaatctaattttaaattcagaactacctagaagtcctctgataggaaaataaaaatatgggttaagtaagaagaactaaaagaaaaataagttaatagatataaaagaaccactattttaccccaatgactccttggaaaatattgagtatctcctgttctgtgactggctgatttgtggcttctggattagatttcgacgcaggagtaagtatagaatttatgtacacatcaatcaaaggaagtaattgaggatgaagtggagtagaggtttcacacagctgtctataaatccaatcctaagaaagaatgttatagacactgaattaattgtggcaaaaagaaaaaccaagcaaaattataaaagtacatacagttttacatgaattatgaatcagtaaaactcactattaacttttggcagttccaaatatattatctagtatcataactgcctttgattttaaaatatgaactaccattatatctgtatcatcttaggtgcaccctccactagaagcttgcctttcggtttaatctattagtttttaagtagtgggaaaaacattttaagtccctaccatatctgtatttagagcaccatgtgtgtcgtcatgggagagctcacgttagataggaatttggagagagagagataggtccttcacagcaaaccctcagatagactaagaaaatgtctctgaaaagcacttacaggagacttatcacttaactatcattggatggaggacatgtaaaatgttgggggtgcatgtgaactcttaattcttagctattttacttgctaaaaatataaagcagatgatgcaatctggctggaaaataatctcactaaatcacaaaaaacaagcaacaattaaaaagtgatatatcatgcatatattattcactgttctttgtaaatatctgaaaaagtttcagtctactttacctcctgggtcttaataccttctctttagagggccttttaacttgttagatatagccaactaagacaaatcaaaacatgtcaaaattctaagttaggtgtgaggtgtccttatgacaaatcaacaaatactagtcatggcagcttccccaatttgtaaaacaaaaccaggcccactgcagtggctcatgcctgtaatcccaacacttcgggaggccgaagtaggagaattgcttgagaccaggagttcaagaccagaccagcctgggcaaaatagcgagaccctgtctctacaaaaaaacactttttaaagccaggtatgaggccaggcacggtggttcatgcctgtaatcccagcactttgggaggccgaggtgggtggatcacgtgaggtcaggagtttgagaccagcctggccaacatggtgaaaccctgtctctactaaaaattaaaaaaaaaaaaaaattagccaggcatggtggcaggagcctgtaataccagctactcaggaggcggaagcaggggaatcacttgaacccaggaggcggaggttgcagtgagctgagatagcaccactgcactccagcttgggcaacaaagtgagactccatctcaaaaaaaaaaaaaaaaaaaaaaagccaggagtggtggctcgcacctgtagttccagctacttaggaggctgtggcaggaggactgcttgagcccaggagtttgaggttacagtgagctatgacagcctgggcgacagagtgagaccctgtctttaaaattaaaaaaaaaaattagaaaatggcagtttctaagttttaataaaatagccatgtgccactattgagaatttaaatggagtattatgcattttgaaaatcttacattgttttaaaaatctgaaattactgtataattatataattataattactatccctaattactatacttatataaatgactagtaacttagcttaataccacacatttcctacacaaaacccacaataaatgcctacaaactgaaatacaactggggagaaagcattaatttaggttgttctttgaaatataaatgtaggccaggcacagtggctcacgcctgtaatcccagcactttggtcggttgagacaggcatatcacttgaggtcaggagttcgacaccagccagccaacacggtgaaaccctgtctctactaaaaatacaaaaattagccgggcatggtggcacacacctgtagtcccagctacctgggaggttgaggcaggagaatcactttaacccaggaggcagaggttacagtgagccaagactgcaccactgcactccaacctgggtgactgagcaagactccatctcaaaagaaaaaaaatatatatataaaaatgtaggggcatgcttttattttgttttatttgtaggggcatacttttattgacactttgtgcttggtaaaggaacggctcctgagaagctggtaaatacaatgaataggcaaaaatccagtaatgttggcactcaggttgctggtgacagggacccgaactgcatgagctgtgacaacctaaaagggaaaaatagcattagtaatataatagaactaaatataaaattattttgaaagagagattagtaagtagactgtcaacacctaatacaagtgtggtccctagaaatgaatgatgaaaataaattattacatgttttaattgtctttgaatgctgaggaaatgtacatttagggatttatataattccctaattttttgtttataaacatagatacatacacagtggtgtgataaggtaaaaaaataaaataaaattttgaagcatacaatctgggctcaatgactttgaagaagtcatttatcttctgaatctttttcacatctacaaaacaggacactgccatacctgcctcaaagcattgttatggggggaaaatattctttttggaaaaacatcatatgaactataaagcaccacataaatataaacagaaatatttattctcaatatgtcatgcataggctctaatcgtcttttaaagaccctcttcaaagttgtcttccaattggttcaaatttaaagacaaaaaataacttatgattctcccacatgctgtgtgactacttgtaattcaggagtatatgtgcatatgcgtgttgagggtgggagggatagtaaaatatagaaataaagatattaatagccacaaaaaagcaacaactggccgggtgcagtggctcatgcctgtaaccccagcactctgggaggctgaggtgggtggatcacctgaggtcaggagttcaagaccagcctggtcaacgtggtaaaaccccatctctactaaaaatacaaaaattaggcgtggtggtgtgcacctctaatcctagctacttgggaggctgaggcaggagaattgctccaacccaggaggcagaggttgcagtaagctatgaccataccactgtatactagcctgggtgacaaagtgagataaaaaaaaaaaagaaatgaaaaaaatccttatgcttatccatggacaaaagtgctaaggctaaagaagaacatgttaagtataagaaatttagactctagcctgtaatctagttagaaatgaattttacagcctaaaggtttaaataggacttcattttatctttctccagacacattaaaacaattaccccttgagatgccctaccagcaacatctaagagtattctcctaagtatctactcaaagtctccaaaaatacataaattcaaaagatgccttggtatgttatgactagttttaaaagtgtattttaaatggattattctttaagaaagtttcaaagatgaaataaatcatcatgagtttaaaaagaaaaaagaccatattattttcttaaggtaagacacacaagttttctcccaaagaatattgtaaaagaaagttaaataagtacctaagaataaaaagaaatacctgctcagtaaaaatttcctgtgtgaagattgtcttcatcctgctcaaggagcttggcttaattacaatctaaaattaccaaaagaattccaacagcatgtaaaaatatatgaaacacaatttattctagggaacttatctaaaatggctatgatacacataaatgttcaaatgttcaagtactctactctgttttagaagtgctttcccaaacccaacattaaagtgttaatactcaaaaacagaaccaatataaaaagcacttaataaatactattattggcattttcagtcggttgggggaaacagattatttactacatggagctaggatagctgcccctctgtgaggccaagagaaatatgtgtgtgtgtgtatgtgtgtgtctgtgtctgtatatacgcacatatacacacacaaatatatgtatatatgtatatgtacagatagacacacatacactttttgcacatatcacaccatacaccaaaagaaactccaagtagattaaaatgttcaaatgtaaaacatgaaaccaccaaaaaaaactagaagaaaatataagtgaccacttatataaacccaagaaaggaaaacatttctaagcataagagcaaaatagaaaacacaaaaagaacatttacagccaggtgcagtggttcacgcctgtaatcccagcactttgggaggccgaggagggcagatcacaaggtcaggagatcgacaccatcctggctaacacagtgaaaccccatctctactaaaaatacaaaaattagccgggcgtggcggtatgtgcctgtagtcccagctgctggggaggctgaggcaggagaatggcatgaacctgggagacggagcttgcagtgagccgagatcgcaccactgcactctagcctgggcgacagagcaagactccatctcaaaaaaaaaaaacaaaaaaaaaacatttaatatactacataaaaataataatgataataatttccacatggcgaagttaaatggcaaaaaatactggaaaaagtcaattataacatattgaactctccacttttaaagatactataagatatgtcactgatttaatattacagtagcttttcaagaaaaaagtaggagttggaacactaccactttcatattacatgtcaactgtaaaatgaatcccaatttcaatactgggtaaaatatacgtcttgaaatatatgaagtaagatgtataaggcataatgacatatctttccttttgaatcagtgaaagaaaaaaataaatcaaagtccctacaggaaaattaggatactgatcagcttttcacaaaagaaataaacaagccaaaacacataaattttaaatactaagtttcactagtaatcaaagaaattcaaactaagtgataccactgttcatcaaccaaatttgcaaagattaaaaaaaaatagtaatgctcagtcatgttgaaagtttagaaaaacagtagttcttactaacggtaagagttaaactgatacaatctttcgaaaagataatctgacagtactcatgaaacaccttaacatagtcatacacttttccttagcaattaccttctagaaatttatcctaagaaaataatccaacaggtgtatgaagagatacatgtgggtgcctatgtgtgtatttacataaacaaggacattcctctaagcattatacagaaactagaaaatctacatgggaaataataagggacctattaagaagatcaaacaatggactataagacaatgcagtcattaaaaattatactgtattataatatttattgatatgagtaaatgctcatcatatattaatttttttaaatcatcaaatatgtacgtcactttaaagaaagaacagacatcagaatattaatagtagtatactaggtatctctgaatcatggaattataagatatctttcccttttctgtgctttccaaggtttttgcatgagtatctattattttagtaaatacaggtttcaaaatgcatttttctaagcgctcttgataaaacttctattaaacaattaaaattacttaaatgaaaacaatctatttacactacaacaaaatgtccagcttagaaacacctttttttttttagaaagaagttaaaagaaaattaccttcatccccaaagtggaacagaccaagtcaatgatagcactaagctggttgctgtgaaagtacatagccaccaataataacatctccccaaaagaagcagagacgcctgaagtactgtcaaaacaaaataggaaatatgaattttccaaagagagaagaagaaaagctttctcaactaactaaatcaaattatcttacctctcaaaatacgcttcttcttttatcatccaacttagccacaccaccatcagctgctcctgttcaggtgtactatataaaatataccagaatgtcactggtttaaattagatatactagcatatgaataaaaagcattctgaagttatttttggtagaaattatttttcctgccctattttcaagtatcaagtcaaattaaaggcttgctgaattgggccattaattgtcattgaggtatgaagtaattctagagctcaagaatgaggacctttgctttttttcatggatcccctctcaaagtcttagttactgccttcacaggttggaaagagtaagattcttcacattccttagaaaacaaaggccccttgggattaacttgttaaaacaactacacaacagctgatatttatttcatatagaaaaaaatctagtgttaacacttaagcatcaaaatatcacaaactgagtgccaaacagtaatgagcagtccatcttctggaaaaatgaaatttaatttatagaaaccttatgagtagatctcaaagttacagagaaataaatgatcactaatcatgggaaaaaaggcagtcacaggcttaccagatatgaaaaatggctataaaaatacgacttttctttgagacaatgtcttgctctgtcgcccaggctggagtgcagtggcgcaatcatagctcactatagcctcgaccacccaagctcaagtgatcctcccacctcagcctcccaagtagttgggactacaggcatgcgctactgcatccagctaatattttttatttttagtagaggggaggtctcactatgttgcccagtctggtcttgaactctcgagctcaagtgatacgcctgcctaagcctcccaaagtgctggaattacagaggtgagccaccatgcctagcctaacaatgactttttaaagggaattcctaaattctgagatggagtttcactctcgttgctcaggctggagtgcagcagcgcaatctcagctcactgcaacctccgcctcccgggttcaagcgattctcctacctcagcctcccgaatagctgggattacaggtgtctgccaccacacctggctaatttttctatttttagtagagatggggtttcaccctgttggccaggttggtcttgaactcctgatttcaggtgactgacccgcctcagcctcccaaagtgctgggaatacaggcctgagccaccacacccggtctaaattttaattgaaaagtacaagctgacgttgacttgtgaaaattttttcaccaatctctttccacttcagtgcagtaaaaatagatgcaacaaaaagcaaatgaaaagtataattcttctattaccaaaagctaagaaaataaaaaaggtcattctcaactatacctaaaccatataacaaataataaagtgttatgtagtagaaagattacagcctttacagcctaccacatctgagtgagaatcccatctctgctaattactggtagtgtgatcttgaagaagaaacacaaataatctttcttttcctttttcactgtagctctcaaatgttaagaactttttttttgtttttgagaagtttcgctcttgttgcccaggctggagtgcaatgacacaatcttggctcactgcaacctccacctcccggattcaagagattctcctgcctcagcctcccgagcagctgggattacaggtgcccaccaacacacccagctaattttttatatttttagtagagacggggtttcaccatgttggccaggctggtctcgaactcctgacctttaggtgatccacccaccttggcctcccaaagtgctgggattacaggcatgagccactgtgcctggcctatcttaaggacttttaagtatctttctaaacattagtttttctatctataagatatagacaaaaataccttataaggctgggcacagtggctcttgcctgtaatcccagcaatttgggaggacaagacaggaggatagcttgagcccagcagttcaagaccagcctgagcaacaaagtgagatcccatctctacaaaaaaatttaaaaattagacaggcatggtggcgcatgtttgtagtcccagctacacgggaggctaagatgggaggatctcttgagcccaagaggccaaggctgcagcgagccctgatcgtgccactggactccagcctgcgaaacaaagcaagatcctatctaaaaaaaaaaaaaaaataccttataagagtaatgaggatttgagataatgtttagaaagtacttcaagtaaaaagaaaagaaagaattcatgtacctaattttacaccatcctgaaactccattaaagctacattaaagggattttcttaaaaggcataaacgcataagatattgaggagggacaacaccacaaaatactggaagctagagaatatatagataaatggaaacggactcagcagacctgaggaagcaaaatgctaaactggtagaagagaaaacccatccattttataccacggaattcccaaagggctcaggctactccaggcagttccaggactgagagtgaagacagactaaaattaagaggttgacattctatataagtagtagacctccaaatcacctcctgcattctgcacaactagaagaatacccttccctcagcagagagaagactggagatttattgtctggaggtggtaaaatcatgcatctgaattaagggacaaccaggtatatctggagcaccattctgaaagtaggagaattaagtaaacgattatactgcaggctgatatctaccagcccttaaccctcactctttaactttgtttatgggtttctgtataggtcttccctctccaggccagacaataatctttagaactctgatcagcccaagagtttcccaaagacccacttatgcattagaggttctaatatgctttttcatttcctagtcttaaatatgaacaatcggccagacgtggtggctcacacctgtaatcccagcactttgggaggccaaggcaggcagatcacctgaggtcaggagttcgagaccagcctgaccaacatggagaaaccccatctccactaaaaatacaaaacttagctgagggtggtggcacatgcctataatcccagctactcgggaggctaacacaggacaatcacttgaacccgggaggcagaggttgcggtgagccgagatcacaccattgcaccatgggcaacaagagcaaaactctgtctcaaaaattatatttatatatgtatatgaacaattaatattggctgggtgtggtggctcacacctgtagttacagcactctgggaggcaaaggcaggaggatcaccttaggccaggagttcaaaatcagcctgggcaacaaaagtgagaccccatccctacaaaaaacttttaaaaataagccaggtgtggtggcccacactggccacttgggaggctgaggtggaaggatctgttgaccccagaagttcaaagctgcaatgagttatgactgtaccactgagtttgccccgagcaacagagagagcccccatctctaaataaataaataaatagaaatttaaaaataataataaatattaagtatctgagaaaagcttctaactttaaaaatagagacccaaaaaaggcagggaaaaaaagcagcttagagaaaagaagcaatacaaataataaaatctcttcaaaatcagtatgactaatatcaaagaaattatgctataatgaaccaatagacactacaaagaagaaacattcagagagccaaaaaagcactcttagaaattaaagactgaataggaattgaagataaagttaaagacaaatcctaaaaggcagaatgatttcttttttttttttttttttttttttttttttttttttttctgagatgcagtcccgctctgtagcccaggctggagtgcagtggcgcaatctcggctcactgcaagctctgcctcccaggttcacgccattctcctgcctcagcctacaggactgcaggcgcccgccaccatgaccggctaatatttttttgtattttttttagtagagacggggtttcaccgtgttagccaggatggtctcgatctcctgacctcaggtgatccacctgcctcagcctcccaaagtgctgggattacaggcgtgagccagtgtgcctggccattttgctccttcagaatgggtatgtgtgaagtaaattctttttgagactgggtatttctgaaaatatctttgtcctactttgacatctgattgatagtttgatggggtatggaattctaagttggaaataatttcctttcaggactttgaaggtgttgcttcattgtcttctaacttccagtgttgtcaggaagtctgacattctgattcctggtcctttgtgtggcctatttgtttttaatatagaaactcgtaggattagttttttatccctagggttttgaaatttctggatgatatgccttagcctgagtctctttttgactattgtcctaggcattcagtaagccctttgaacctggaaactcatgtctctcagttctaggaaattttcctgaataaatttgttggtaatgttttcttcttgggtgttctgtctaaaacctccttttatttggaattggactttttgaaatgattgtcgtattttcttatcctttcctcttttccttcccctcaatcttgttctactttttagaaaacagctttattgagatgtaatatacataccataagatttacccaaagtgtacaattgagtggtttttagtgtatatacagagttatgcaaccaccaacacaacagaattttagaacctgttcagcactctaaaaataacttgctcattctaagaccaggtacagtggctcacccctgtaaacccagtggtttgagagactgaggtgggaggactgtttcaggccatgagtttcagactagcctgggcaacacagcgaaacactgtctcttaaaaaaaaaaaattctccaggggtagtggaacgtgccttagtcccagctatttgggaggttcaaggagaaggatcacttcaacccaggagttcaagattacagtgagctatgattgtgccatagcactacagcctgggtgaaagagcttaaaaaaaaaaaaaaaaaaaaaacagaggctgggcacggtggctcacgcctgtaatcccagcactttgggaggccgaggcgggtggatcgcgaggtcaggagatcgagaccatcgtggctaacatggtgaaaccccgtctctactaaaaatacaaaaattagccgggcgtggtggcaggctcctgtagtcccagctactcgggaggctgaggcaggagaatggcgtgaacctgggaggtggagcttgcagtgagccaagatatcgcaccactgcactccagcctgggcgacaaagctagactccgtctcaaaaaaggaaaaaaaaaaaaaaaaaaagaaagaaaggataggttttctttttaatttttttttttttaaacaaagacaggagtcgcactatgttgccccagctggcctcgaactcatagcctcaagcaaccctcccgcctcagcctcctgagtagctgggactacaggtgtgagccaccacgcctgggtaatatgatgatatgagatataagaaacagaagatccaacaaaggagagatgaagcaagtctccaaaatgatggtgaaggtcaatcccaggatgagagctttatactaccaggtatacctggtaaccattccagaccaaaatgctcctgaagaaatctcctcaagaagatgaaactcacagactgtctaatgagtcaaaacatctggagagaagatttaggctggcagagagtttgaggttacatgaatggtacatataacaccaagaaagttaaaagcaaaaaacaaaaacacaggataaatattaatccaaaaaaaaaaaaacaagttttacaaggaagtaaaaaataatcatatactgcatggttgagttctcagtagtgcttacataatcataacaactatatattgatctaatctaaattataaccatactaggagaatgagaggataggaaggacatgtatggatgtgtttaggacagggagaaaaaagacagagaactaatttctcatctttcatactgggaactcaataaaaaatacctaaaagcaaaaatcaagaggtatcaaatacaaacatattattacagatgtagcagtaaaacacaaaataaacagctaaaagaattgaaagacactgcttctaagaaagataaaataggaaggagagaaggaaggactgctatttgccttaacaaatcctgaagaactatttcgacttatttaaacaatgtacatatataagataaataaaatgaatcagatgctactgatatccttattttaaaaaaatacaaataagctgggccagtggcatacacctgcagtcccagctacttgggaggctgagtcaggaggattatttgaggccaggagttcaaggctgcactgtgctatgatcatacccatgaacagccactgtactccagcctgggcaacaaagctagaccccttctcttaaaaattggaaaaaacaaaacaaaactacgactgtccatacctagaccagcttttgtagaaaactcttatctaatgctatacaattttattgagtaaataaaagtaaaccttgagaaaatggagcaacttatatagttaggtacctgacaagtgtagaaaaggccagtagcatacaaaaggaaagtgaaacaaagcgaaccccagctggcgtagcaggaggacggctcgtcatcaactgcagtaattgctcagcttcttcttcagttggtctaaaaaggaatacatcattaggctttacatttttagttgggatgaagaagaaaaagtgaatttttaaccttttagttacaaattttaaactttataatggtatcttgctatttataaaatctttaacatctcaagttgccaaatgcaaaactgttgagaaattacaactacagtgttttactgtggacacaaatacaggcaggtcctccctttgccctgtagtgtgagaccataaaaatgaccatgcaagctgaaatcatgcaacacaatcttaataatcaatggtgaaaagtatggttgtactgtagcctttaaaatttttgtcaaaacattaaaaactctgttgattataatgcataattttttttttttttttttgagacaaggtcttgctccatcgcccaggctggagtgtagtggcaggatcagagctcacttcagctttgaccttccaggctcaggtaatcctcccacgtcagtcctcatgtagctaggaccacaggtatgcgccaccatgcccagcttattttttttagtagagacagggttttgccacgttccccaggctggtctcagactcctgggctcaaaaaatccacctcccttggtctcctaaaatgctgggattacaggtgtaagtcactgtacccagccaggaatttttttttttaaatggtaaaactaatatttttatagtactctaattgaaaatattagaaacattgggaattaaactgttttctttgtttcttttttttgagacagagtctcaccctgtcgcccaggcgggagcgcagtggcacaatctcggctcactgcaaactctacctcctaagttcaagcaattctcctgcctcagactcctgagtagctgggactacaggcacacgccatcattcccagctaatttttgtatttttagtagagagagggtttcaccatcttgaataggttgtcctcgaactcctgacctcactgatccacaagccttggcctcccagagcgctcggattatgggcgtgagccactgtgcccggtcttaaagtttttttatttcttcgtaaagactttatcaagagtagtttaaacagcctttgcctccttttttttatgttttttgtttttgtagagatggagtttcactcttattgcccaggccggactgcaatggtgcaatcttagctcaccgcaacctccacctcctgggttccagtgattctcctgcctcagcctcccaagtagctgggattacaggcatgtgccaccacacccagctaattttgtatttttagtagagacagggtttctccatgttggtcaggctggtctcgaactcccaacctcaggtgatctgtccaccttggccccccaaagtgctgggattacaggcgtgagccaccgcgcctggcctatgctttcatctttattggccaactgtctcttccaattatctgtttttggaatataatgttccaaaaactgtttccatgttttggaacatgagttcattatggagagaaaggaagcaatacaggttgagtaaccccaatccaaaaaacctaaaatctgaaatgcccccaaactccaaaacattctgagtgccaatatgaggtaatgagctcaaaggaaatgctcattggagcattaaggattttgaatttctgttagggatgctaaatcggtaaatataaacattccaaaatccgaaaagttctaaaatcccaaacgcttctggtctcaagcatttcagataagggatattcaacctttacaactacctcctctgctatatgtacatgaatcaaataacaggtgtgcagtaaccagctaccgacagactttgaaagaagtgaggccattggtcactaaccatgatgtacatctgttatttacttagtgatctgtgtcctgaggagctcacaaactctatacaattaactggttaatgtatcatggcaactgaaatggcaactgtgttgagagaccagcattatttaaataaactggcgtaactgaaactcatgcatattggagacatgcaaatgaggactgtatgtacaattattaagaacactattcaaaaggattttgtatggtgactaagaaacattgtactggccaggcacagtggctcatgcctgtaatcccagcactttgggaggctgaggcaggcagaacacctgaggtaaggagttcaagacaagcctggccaacatggtgaaaccccgtctctactaaaaatacaaaaaaaaaaaaaaaaaaattagccgggtgtggtgaggcaggagaatcgcttgaatccgggaggcagaggttacagtgagccgagatcacaccactgcactccagcctgggcgacagacggagattccatctcaaaaaaaaaaaaaaaaaaaaacattgtacttattaatcacatcatattaattttaaacaattatgatatcagctgtaaaaggaaacaaaggagagatttacttcaactagtcaatggtaaaagatcactcacagatcattcactatagttttgtcaagctgtgttgaaatcacaggtttctttaaactgtgattggaaattgataaactgctctggctcctcccatatttatatagttctgtttacaatcagaacaaaatagatgaatacatctctgctagaaattcttggccttaggatttcattcttcttacaggccagcccactacctgagtccaacagaaaactttaatcctctgaataaaaggcctttggctcactttcttgagaatagaaacaagaaggtaaaatgacaaaaaggtaaaatatcaaactattgaatacttgagtccagcgatccccatcaaagcacagtacagacgtaagagtgcactggctttcacaacatgctcttctttcagccccgaatacacagacacattgggctccatatccacatcagcttcttccacaattcgggtgcttcttactgtgggaagaatgcccatcaactccagaagaagctgccttctcatctgccaaaggacagaactgctggtctctctttttctctgaaagaaatatggatcacaaaaggaagaaagcatgaagcatttactaaactaaaagggagctaaaacatagcaccccacttaaacactttcaaattggcctatttgaagagattgtcgtgactacagaatctcattttaaccaatcaagcaaactcaaaatccactagtttgtctgaagaatgaatattcaccataatttggattggttgcagaggaaagactaaattagtgacaatttgaattgtggaatattatttcaatggtactttcaaatacataaagactaacaaagtgatatgtggtataggagaaaatgctcagattttgaagacgtaagttcttggggtttaaatgccagctctactattagacgattatatacctttaggcacattggttagcctctctgaaccccaatttccttaatgacaaggaaatattttatcaacaatatttaccttatagaactcctataattaagagtttacaattcttggcctgatgcagtggttcacgcctgtaatcccagcactttgggaggccaaggcggacggatcacttgaggtcaggagttcgagaccagcctggccaacatggtgaaaccccatctctactaaaaatataaaaattagctgggtgtggtggtgcatgcctgtaatcccagctacttgggaggctgaagcacaagaatcgcttgaacccaggaggcggaggttacaatgagtcaagatggcgccactgcactccagcctgggcaacagagtgatactctcgtctcaaaaaaaacaaaagagtttacaattctataaccactacagttcttcaggcagggacaatgccttagtcttctctcactctgcacagtcgaacattgtgcctaacatacagcaagcactcaaagtctgttaagtagatgaatgaacagagataatacatgtatgaaagcagttctaaactatacagggctagacaaatgttaattattatcttttgagtgtctctaagtaaaatatgatagacctgctttaataataacagtaagttcaaagaataaaggtttattgaatacaaaagacaactacaaacaagatgagcatgccaagtgcttaaggcagtacctgacatatatgaagcatccaataaataaatgttaactttgttttaaaaagcagagcttaaaatcagttttcaaatgggctataaaatagaacttgaatattttaaaaaactatgattcagtagcttaaaaatagactacaggatctaagcagtatacatgttgtctagctaagtgacctcaacgagttaaatcgcaatctgcattagctccttcataggaactctattcacatagttaatataaattagtttttgaaaaattaaaacattttgcaagttaaaaactgttgcaaaatacatatgcataagcaggtgaacgtataaaataaaatgtggtatatacacacaatggaatattatttttctttttttttgagaccgagtcctgctctgtcaccaggctggagtgcagtggcgtgatctcggctcactgcaacctctgcctcccatgttcaagcgattctcctgcctcagcctcccgagtagctgggactacaggcacgcacatcacgctcagctaatttttgtatttttagtagagacagggtttcaccatgttggccaggatggtctccctctcttgaccttgtgatccgcccgcctcagcctcccaaagtgctgggattacaggcgtaagccaccccacccagcccttacttcttatttttatagatttagggggtacaagtgcagttttgttacatgaatctattgcatagaagtctgggctgttggtgtagtcatcaccctgatagtataccctgtacccaatataggtaacttctcaaccctcacccccttcccaccctcccaacatttggagtctatgatgtgtattatcccactcgcttatgtccatgtgtacacatgattagcacccactcataattgagaatatgcaatatttgactttgtttatgcgttatttcacttaatataatggcctccagttccatccatgttactgtcagacatgattttattcttttttatggttgagttgtattccatggtgtgtgtgtttgtgtgtgtgtatacatatatacgtgtgtgtgtacatgtgtgtatgtgtgtgtgtgtgtgtgtgtgtgtgtgtgtgtgtgtgcatatatcacattttctttaagcaaccatccgttgatagatgcttaggttgattccataacattgctactgtgaatagtgctgaaataaacatacaagtgtaggtacattttttatataatgatttctctacccagcagtaggattgctggacagaatggcagttctactctaagttcacaatggaatattattcagcctttaaaaaggaaatcctgacacatgttacaacatagatgaaccttgaaaacattatgctaagtgaaataagcaacatacaaaaggagaaatattgtataattccatttacttcaggtagccagaaagggtaaattcatacagacagaaagttgaatagaggttaccagaggatgggatgatagggggaatggggagttatttaatggatacagagtttctgtttgggatgatgaaaaagttctggaaatgggccaggcccagtggtggctcacgcctgtaatcccagtactctgggaggcccaggtgggtggatcacctgatgtcaagagttctagaccagcctgaccaacatggcgaaacccagcctctactcaaaataaaagtagccaagtgtggtggtgggcacctgtaatcccaactactcaggaggctgaggcaggagaatcctcgaacccaggaggtagagcttgcagtgagccgagattgcgccattgtactccagcctgggtgacagagtgagacgccgtctcaaaaaaaaaaaaaaaaaatagttctggaaacgaagagtgataatggttgcacactgtaaatatacttaatgccactgaattatatacttaaaaatgattaaatggcaaaattttatgttatgtatattttaccataataaaaacatatatacacatatgtattaaaatttaaaaatataataacttatttcagtgatctaatgcaccagttctcatgagtctggcccagaaccctggagatatatgctttcagggggtctggaaaggtgttaataatactcaagacattatctgtctttttctttctcattcactcacaagggtacggtgcagtttccaaaggcttctaccaagccagacattgaagatatttgaaaaaaatacaataaaataaaactatcattcttctcattaaattttgtttgggaaaacacagttagttttcatttaaaatatgttatgttcacatttaatagggttattgttgtttggttttggtttttttttaagagatgaggtctcgctatgttgcccaggctaaagtacagtcgctattcacaggcacaattatcacacactataccctagaaccccctggcttaagcaatcttcctgcttcagcctcctaagtagctaggactataggcacataccaacacaccagctgttcctatttttaaaagaactaaataaatatttcaaatatttaagtgttaatttctaatatggtaaatatcaacagaaaaaaagccacataaacaaaagctctttggtatccttagtgattttttaaaatataaggaggtccctgaaactagaaagtgtgagaaccacttgtctaatgacatcattcaaaaaatgtttctttctcttttagcagctgctaaagtattctgatccttagcctatacagatatttaaccctcacctgctgtccatttcggataaaagttccaaaccaagtccggactttcgcatttgttccaagaagcaaaccacttacaaaacaaaccaagtcactcactccatcctcacaagcttcatttttagtatgatccaatgtcaaagccacaccaaggcctggcaagtgacattcttccacctagcacagaaaagaaaacaaactgaattcagtatcataagcaaaaaggccagtgatgcttccaaatctaaagtatctaaagtttagaggaagaactcctacaaaacataaaaacccagagaggaaggtaacatatccagtatataaataaaattccccacctctacaggactctaaaaccatcttgagaagagttcttggacctaatataaaggcctttgtctaataaaacacaggatcacttaccaccatgcctcggaccttgagggcctgagaaggattcattttacacaagaagcgtaaggcatctgtcctgcgccttcctccaagactttcttcatcttgtcgttctccattttttatcaggcccctacaaactaacatgatagaaaccatcttcttcagccttcagaattaattgttcatgaagatttcacatgacagaagaaaaggatcagggtatttgaaagcacaacaacagaaattggccaaaatgaagcaaaaaatgaaaagagacttaaaaaagaatagtaaactctgggacaatattacacattcaaacacacttgcaattacggtcccagagagacaaagaaagtacgagacaaaaatacatttgagggccacggacagtggctcacacctgtaatcccagaactctgggaggccaaggtgggggcggggggggggggggtgcggggcatggatcacctgaggtcaggagttcgagactagcctggccaacatggtgaaaccccatctctactaaaaatacaaaaattagctgggcgtggtggcaggcacctgtaatccgagctactcaggacgctgaggcaggagaatcgcttgaactgggaggtggaggttgcagtgagccaagatcgcatcattacactccagcctggggcgacaaaagcgaaactccttctcaaataaattaattaattaattaatttgaagaaattttcccaagttgaatgaaaactctaaacccagttcaatgagccctaagtggaacaaatgcaaagaaaatcataccaagaaacatcatacgtcaactttctgaaaccagtaataaaaagaaaatcttaaaagtaaccagggccgggtgcagtggctcacacctgcaatcccagcactttgggaggccgaggtgagtggatcactaggttaagagctcgagaccagcctggccaatatggtgaaaccctgtctctactaaaaatacaaaaattagctgggtgtggtaatgcgcacctatagtcccagctgctcaggaggctgaggcagcagaatcacttgaacccgggaggtggaagttgcagtgagccgagatcacaccactgcacttcagcctgggtgacacagcaagactccatctccaaaaaagagaaaaagtaactagagcagaggataggcgcatcacctgaggccaggagttcaagatcagcctagccaacatagtgaaaccccatctctattaaaaatacaaaaattagccaggcatgggggcacatgactatagtcccagctacccgggaggctgaggcaggagaactgctttaaccccaggggaggcggaggttgccgtgagccgagctcatgccactgcactccagcctgggtgacagagcaagactccgtctcccaaaaaaaaaacaaaaaaaaaggagccagaagaaattaaagaaaaaaaaaaaaagtagccagagggaaaaagaaactttacagaggaacaaagataaaatttactgcagaaaagagaatgacatctttgttctttgttttcttttttcctagagatgggatcttgctttcttgctttgccaccatactagtctcaaactcctggcttcaaacaatcctcccgttttggcctcccaaagtgctgggattacaggtgtgagccacatacccagccagaatgacatctttaaatagctaaaagatgacgtcaacctaaaattttataccctttgaaaatatatttttccagaccaaaaaagccagtaaaatttgttgccaacaaacccaccctacaaaaaataaggaaaattcttcaagttaaggggaaattatgccagatggaaatatggaactacagaaaggaattaagagcaccaaaaatggtaaatgtgtggataaatagtattttcctctatatttttagtctttaaaatataattaactgtttaaaacaaaagtaataacaatttgctctaaggtttataattcatgtaaaagtaaaatccatgacaacaatggcacaaagtacaagaggaaaaagaaaataaatagaaaacaaataacaagaagattcaaacctaaccactataataatcacatttaaatggtctatgtatacagtctaaacactccaattaaaagacagagactgccactagattaaaaaaaatgaagaccgaactatacctgtccacaagaaatcgaccttaagatatggacagattaaagagatgaagaaatatatacaccatggaaaaactaattataagaaagatgacatggctgtattattcagacaaagtagacttgaaaagaaggaatattatcagcaataaagaagtctattttgtcacgcctgtaaatcccagcactttgggagattgaggcaagcggaccactttagcccaggagtctgagacagcacgggtaacatggtgaaaccccatatccacaaaaatacaaaaaattagctgggcgcgccaggtgcagtggctcacgcctataatcccagcactttgggaggccacagagggcgcatcacgaggtcaggagatccagaccatcctggctaacacggtgaaaccgtgttactactaaaaatacaaaaaaattagccgggcgtggtggtggcgggcgcctgtagtcccagctactcgggaggctgaggcgggagaatggcgtgaacacaggaggcggagcttgcagtgagccgagattgcgccactgcattccagcctgggcgacagagtgagactccgtctcaaaaaaaaaaaaaaaaaaaaaattatctgggcccagtggtatcggctggtagcctcactcactcaagaggctgaggcagaaggatcactcgagcctgggagatcaatgctgcagtgaatcatgaccacaccactgcactccagcatgcgtgacagagcgagacactatctcaaaaaaaaaaaaaaagcgtattttggaggttaaaaatctctacaaagaggccaaggacagtggctcatgtctgtaatcccagcactttggaaggccgaggaggacagatcacttgaggtcaggagttcaagaccagcctggccaacatggtgaaactccgtctctactaaaaatacaaaaattagccgggcgcggtggctcacgcctataatcccagcactttgggaggccaaggcaggcgattcacaaggtcaggagatcaagaccatcctggttaacacagtgaaaccccgtctctactaaaaacacaaaaaattagccgggcatggtggcaggcgcctgtagtcccagctactcgggaggctgagacaggagaatcgcttgaactggggaggcagaggttgcagtgagccgagatcactccactgcactccagcctgggtgacagagcaagactccgtctcaaaaaaataaataaataaataaataaataaataaataaataagccaggtgtggtggcccatgcctgtaatcccatgaacttgggaggctgatgcaggagaatcgcttaaacccaggaggtagaggttgcagtgcgccgagattgcgccactgcactccagcctgtgaaacagagtgaaactctgtttcaaaaaaaaaaagtccgggcgcggtggctcacgcctgcaatcccagcactttgggaggccgagaagggtggataactaggtcaggagatcaagaccatcctggctaacacggtgaaaccctgtctctaattaaaaaaaaaaaaaaaaatacaaaaaattagccgggcgtggtggcgggtgcctgtagtcccagctactcgggaggctgaggcaggagaatggctgaacccaggaggcagagcttgcagtgagccgagattgtgccactgggcgacagagcaagactctgtctaaaaaaaaaaaaaaaaaaaaaaaatcatataagacacaaacaaatggaaaaacattccaagctcatggattggaagaatcattatctttaaaatggccatattgcccaaagcaatctacagattcaacactcttcatatcaaactaccaacatgattttccacaaaattagaaactttaggatactaaagttcacacagcaaaaaagagcctgaatagccaaagcaatcctaacaaaaagaacaaagccagaagcatcacattatctaacttcaaactatactacatggctacagtaaccaaaataacatggcactggtataaaaacagacacacaggccaggcacggtggctcacacctgtaatcccagcactttggtaggctgaggcgggcagaccacgaggtcaggagatcgagaccatcctggctaacacagtgaaaccccatctctactaaaaatacaaaaaattagccaggcatggtagtgggtgcctgtagtcccagctactcaggaggctgaggcaggagaatggcgtgaacccagcaggcagagctgcagtgagccaaggtcgcacccctggactccagtctgggtaacagagtaacaaaaaattaataaataaaaataaacagacacacggaccaatgcaacagaatagaaaacccagaaataaagccacacacctacaatcatctgatcttcaacaaagttgacaaaaataaatgacagggaaaggactccctatttaacaaatggtgttgggatagctggctagccatatgcagaagaatgaaactagaccctatcttttatcatatacaaaaattaactcaagttagattaaagatttagatgtaaaacctcaaactataaaaatcctagaagaaacactaggaaatactattctggacactggccttggcaaagaatttatagccaagtcctcaaaagcaattgcaatgaaaacaaaaattgacaagtgtgacctatttaaattaaagatattctgcacacaaaagaaactatcaacagagcaaacaatctacagaatgggagaaaatattgacaaaaatgtatctgacaaaggcctaatgtgcagaatctataaggacataaacaattcaacaagcaaaaaaccaccccattaaaagtgaggaaagaacacgaacagatacttctcaaaagaagacatataagcaaccaaaaaacatgaaaaaaaatgctccatatcactaatcatcagagaaacacaaatcaaaacaatcatgaaatgccatctcacaccagtgagaatggctattaaaaagtcaaaaaataataggtgctagcgaggctgtggagaaaagagaacacttacacattgttggtgggaatgtaaattagttcagccactgtggaaagcagtttggagatttctcaaagaacttaaaacagaactaccattcgacccagcagtctcactgctggatatatactcaaaggacaacaaattgttctaccaaagacacatgcgcttgtatgttcatcccaatactattcacaatagcaaagacatggaatcaaccttggtgcccatcaacagtggattaaataaaatgtacatatataccatgaaatactatgcagccattaaaaagaatgaaatcatgtcctttgccgcaacaaggataaagctggaagccatcccatcctaggcaaattaacacagaaacagaaaaccaaataccacatgttctcactataagtgggagttaaacattgggtacacatggacataaagatgggaacaatggacactgggactaccagtggggaggaagaaaggggacaagggctgagaaactacctattgggtactatgctcataacctgggtgacgggatcattcaaactccaaacctcagtgtcatacaatatacccatgtaacaaacctgcacatgtacccccctgaatctaaaataaaacttcgaatttttttaaaaagaaaaattaaaacaaaggtgacaacaaattgaataatatgtaaataatgtttagaaagggggatataactataaatgtgaaaactaagaataaagaaatcaaatttgacttggggaaaaaagtatattttataatgaaaaaaaggctcaattcatcataaagatataatcatcctaaatgcatataaacccaacaaaagagctttgaaatacatgaagcaaaaactgacagaacaaaaagaagaaataggcaaatccacaattatgtctggagacatcaaaactcctctctcagtaattgacagaacaagttgacaaaaaatcggcaaggacacagtttacaaagagtttttacatatcatctgatattcaataaatctcttaaaaaagtcagggaactattacactatcaatatctccattttacagatgagaagtattttggtttgtttgtttgtttaagacagagtctcactctgttgcccaggctggagtgcagtggcacatatcggctcgctgcaacctccacctcacagattgaagcaattctcctgtctcagcctcctgagtagctgagattacaggcatccaccaccaagcccagctaatttttgtatttttagtagagacggggtttcactatgttggccaggctggtctcaaactcctggcctgaaatgatgcacccacctcggcctccccaagtgctgggattacaggcatgagccaccgtgcccagccagatgagaagtattttgatagagctcacacaataagtgaatgacaaaatcaggaattataactccagtactttttcctcccaggctcctaattcacaaactaccttgctcaacaaaatgtttttatttttatatcactcatacccaaacaacaaccttcaatcactgtaagttttaaatagaggtgaaaaaatgtagtcgatttttctcaatttctactttatacttctctgtaaactgacagcagtagggctaaaaaacaaaggtctgattcctagcatttctcattatacatatcccgtattgctctcttgatatttcactgatacatgtatcttctttgatccctgattatagatattacatcttctagttccttggggtttttttttttttttttttgagacggagtctcgccctgtcgcccaggccggagtgcagtggtgcgatctcgactcactgcaacctccacctcccaggttcaagcgattcttctgcctcagcctccccagtagctgggactacaggcacccaccaccacatccagctaatttttgtatttttagtagagatggggtttcaccatagtggccaggctggtctcaaacttctgaccttgtgatctgcccgcctcggcctcccaaagtgctgggattacaggtgtgagccactgcgcccagcctgatctttaaactcaatacaatttgtgaactcaatatttctttatacatactaacaaactttcaaaagataaaatctcaaataaaatcccattaatgtttcttcttaggtcaaaaagataggtcctgtacatgtccaagcaagtcttttcaatataccatattagaatcatatttaccttcattaaaactatcaggaacattggccaccaagagacacaagaaccaggcaccatttctaacatgtagcaaagcttcagctacatcaactatagggagcaaggaagggagctctacaagaaaacaaagtcagtgttagtctttgttaacaggtgcactccaccacacccagctaattttttttattttctgtggagactgaatctcactgtgttgcccaggtgggtctcaaactttggcctcaagtgatcctccagcctcagcctcccaaagtgctaagattacaggcataagccaccatgcctggacccagtgttaaagagtgatatttctttttttcttctttaagacagggtcttgctttgttgcccaggctacagtgcagtggtgtgattatagctcactgcagcctcaacctcctgggctcaagcaatcctcctgcctcagcctcctaaactcctagaattacaggcatgagccaccatgcccaaccaaaaatgacatttcattgtattattaaatatcttttgacatttcacaaatgtcatctaaaataaagtactttcttttcatagtctagaaccaagctgtccagtaggatacccactagcaacataaggatacttatattaaaaacagttcagttcctcaatcacactagccacatttcaagtaatccacagccacaaagaacactggacagcatagcatagaacagtacaggaaattttattttatagaactggtctaaagagttattttcacgaaaatcttatttgcttttttttttttttttttgcgacgaagtctcgcttttgtcccccaggctggaatgcaatggcgcaatctcagctcaccgcaacctccgcctccagagttcaagcgattctcctgcctcagccgcccgaatacctgggattacagaagcctgccaccacaccaggctaatttttgtatttttagtagagacagggtttcaccatgttgacctggctggtctccaactcctgacctcaggtgatccacccacctcggcctcccaaaatgctgggattacaggcgtgagccaccgtgcctggcctatactttttttttttttttttttttttaagaaaaggtctgcagccaggcacagtggcttatgcctataatcccagcattttgggaagctgaggcaggcagatcacaaggttaagaattcgagaccagcctggccaacatggtgaaacctcgtcgccactaaaaatacaaaattagctgggcatggtgccgcatgcctgtaatcccagctactcaggaggctaaggaaggagaatcacttgaaccccggaggcggaggttgcagtgagccgagatcacaccactgcactccagcctgggtgacagagtgagactccatctcaaaaaaaaaagacaaggtctcactctggacagagtgcaatggcacaatcatggctcactacagcctcaatctcccaggctcaagccatcctcctgcctcagcttcccatgcagctgggactacaggtatacaccaccacactaggctaatttttttcattttggtagagacaaggtctcactatgttgcccagactggtcttgaactcttgagctcaagtgatcctcctgcctcggcctcccaaagtgctgggattacaggcatgagcgacagccttctttacatttttctgtcctcttttatttctatcattcacacctattatatacaatctggaaaatacaaaaaggtacgaagaagaaaattaaaatctgccctaatcccagaattcaaagttaataaaaaatgttttcacaggcctgtagtcccagctactcagaaggctgaagtgggaggatcccttgagtccaggaattcaagccagtgggctatgatcctgccactgtactccagcctgagcaacagagcaagactctgtctctaaaaaaaaataagtattttattttaattcatcaagggtattgttcttgaacttttaacaaaactgggattatagtctacttaacactttgccctttgcttttttcacttaacatattgtaaacattttccaaaatcattaacgagcattaaagtcattaaatcaaagataccatgttaatgtctgcataatatgtcacactatgaaaataatataatttacttaatcattgtccaactattagtcacttttgacttaaaatcacataacatgtttgttatatgatccctaaaataacacagcataccaggctaagaagttacacagtatcatttaacaagaaactatatatgaaatccatcttagcactcagtacagtacctgcttgtaaaatacaaagtacatctgcagcttcctccaaatatactggactctcaaaaagttcagaagacttgaaaaaaaattctccgttggactcagacaccttaaaaaagaaaaaaaaaagatataaactctattaatttcagataattaaatccctatttttataattatttcttgagctcacagattatgtctcttaatgtatcactaatataccacagcagaatatgcagtattcaatcaatttcaaccaatttaaccacacacagcagtcatgttaattattattcagatatagcagtatcaatctcaagaactgatttctatctaaatatttggagacaactggaattaaaggataaggcaagccaaagaaatgaactacaaatgcagcctacataaactgctttaaaaaagccaagaacagtcaacctaaagcagtttaacaaatataaattcatggccaggtgcagtggctgacgcctgtaatcccagcactttggaaggccaagatgggtggatcaactgaggtcaggagttcgagaccagcctggccaacatggtgaaaccctgtctctactaaaaatataaaaattagccaagcatggtggccatctgtaatcttagctactcaggaggctgaggcaggagaatcgcttgaacccgggaggtggaggctgcagtgagccgagatagcaccactgcactccacactgggagacagaatgagactccgtctcaaaaaaaaaaaaaaaaagaaaaagaaaaaagaaaacaaacaaacatatatatatatatatatatatatatatatatatacgtgttcaattctgaataaactgttggaaaaacaaagaattaaagtttagataacaaaatctactaagctttttggaaattctgcacaatagtttcataaccatatttcctatataatgaagagtgccaaactaaaaaattggaaatctcccagaggagaaaggtcacttatttattagagtcaccaagtgaggtattacggaaaagatgaaggaaaactcttggctgaaatttaaaagtatcaaaataggctgggcatggtggctcatgcctgtaatctcagaactttgggaggccgaggtgggaggatcacctgaggtcaggagttcgagaccagcctggctaacatggtgaaaccccgtctctactaaaaatacaaaaattagcaggcatggtggcgggtgcctgtaattctagctactcaggaggctgaggcaggagaatcgctttaacccaggaggcaaaggttgcagtgagcaagatcacaccattgcactccaacctgggcaacaagagcgaaactctgtctcaaaaaaacaaacaaaaataaataaaagtatcaaaatagtaaaaaagagaaggaaattataattggtgatggaaattttagaaaaattttttaacataccttaaaaactgtctaaaactcggccgggcgcagtggctcgtgcctgtaatcccagcactttgggaggccaaggagggcggatcacgagatcaggagatcgagaccatcctggctaacacggtgaaaccccgtctctactaaaaatacaaaagattagccaggcatggtggcgggcacctgtagtcccagctactcgggaggctgagacaggagaatggtgtgaacccgggaggcggagcttgcagtgagccgagattgtgccactgcactccagcctgggcgacagagtgagactctgtctccaaaaaaaaaaaaaaaaaaaaaaaaactatctaaaactcaccaaaatcctctctaccagtattttctatgaaaacagaatttagtcctttctctttttgtccacaatttataaaactaaactttatttactataaattaactgactccccaaaattataacagtaaataaacataaagatctaatttagtgggtttttgtggtggtggtggttgttgtttttgaggcagttttactcttgttgcctaggctggagtgcaatggcacaatctcggctcaccacaacctccacctcccaggttcaagcaattcttttacaggcatgcaccaccactcctggctaattttgtattttttagtagaaacggggtttctccatgttggtcaggctggtcttgaactcccaacctcaggtgatccgcccacctcggcctcccaaagtgctgggattacaggcgtgcaccaccacgcccagctaatttagttatttatatgatagaactttgacattcaaaaattttaaattcagagtttcaattaactatattacccaaaggtctatgacctaagtaatctataattttacaaagaagataacttgaatagctttcattagtgtaaagaagcactttggtcatttagtgattgagactagccaatcatcctacattcaattcagcattgatactcccctctgctgtcatatatgaggctgttactgctcatccagtgtctaaatgaatcacatacatttttcagttattcacattcagttattgaaaatgttacttcattacactttatgggagaaattgtatcccataaaggtattatctgctaataaatttgataatctgtacaagccttgagataaatccctttctaaatgtcaagaagccactgtgtatggattccatacggaaaaaaatccctctcatagaaaatgcagaacaagtataaatgagagaaaatgataattaagagaaggactttaaggcagacttataatatcctttcaggctttgaaaggaaaacaaatatatagaaataaaagtagagaaggccgggcacggtgacccatgcctgtaatcccaacactttgggaggctgaggcgggtggatcacctgagttcaggagttcgagaccagcctggccagcctggtcaacatggtgaaaccccatttctactaaaaatacaaaaaattagctgggcgtggtggcgggcacctgtaatcccagctactcatgaagctgaggcaggagaaccgtttgaatctgggagacagagattacagtgagctgagatcacaccactgcattccagcttgggcaataagaatgaaactccgtctccaaaaaaaaagaacaaaataagagtagaggagaattcaacctgcctgacttcttgtctctttttctgtctacctccctatacatagacatcaaatcatgcatactttgagctgtggttaaaagaaatgcaccttgttcataattgccaacagttcactaagcacaagacgcaatcgacgaggtgaatcactgtgttcaaactctaacgtcagtccatgctgaagctgtgataccaggatgctctctccactgcctcctccaagtttatgcctaatgaagtacaaaacatgtaacaattatgaaaacactgatatggaaataattgcataaaaattatcttttattgaaataagctataaaaggatgtataaagtgttctaaaatgttctgttacttctgaaatgctatttagtttgcctgtgtatttcagggattcacatcctacgtataataaatactccaccacataggccaggcacagtggctcacgccggtaatcccagtactttgggaggctgaggcaggtggatcacaaggttgggagttcgagaccagcctggccaatatggtgaaacctcgtctctactaataatacaaaaaagccgggcatggtggcgcgtgcctgtagtcccatctactcgggagactgaggcagaagaatcacttgaacccaggaggtggaggttgcagtgagccgagatcacgccaccgcactccagcctgggcaacagggcaagactcggtctaaaaaaaaataaaaataaaaataaataaataaatactctaccacaactgacaattaacactcacttccactgatggtggcttgctactagattcacaatgggcagggaaggacatagcacctgcccagaatctttgggaatatctaagctttaaaagcctcccaagaggctgggcccagtggctcacacttgtaatcccagcactttgggaggccaaggcaggtggatcacctgaggccaggagttggagaccagcctggccaacatgatgaaaccccatctctactaaaaatacaaaaaattagccgggcatggtggcaggtgcctgtaatcccagctactcgggaggctgaggcaggaggatcgcttgaacctgggaggctgaggttgcagtgagccaagatcacgccattgcactccagcctgggcaacaagagcgaaactctgtctcaaaaaagaaaaaaaaaagcctcccaagtgattccaataaatccctctaatctaggggaagttaccctacctacttcccactgaaagtaattggcctaatgagtttagcccacatacaacagcacattgccatatttctctagataacattttataacatggaagtcaaaagattctggaactgtaactatatacagaaaagacctaagtaaaatgctctccagaatttagattctcattctctcttttctggagagctctaaaaaatatctgattccctgttctttgtcaaatccaaatccacatataatataacataacattacctaagctgctgttctttgctggcatcttgttctaaagcatgaaagtccacggacaacaatgcaacaatggagttgacagcttccactccagaaagaaggcgaaggatgagtttcttatcctgagcccagctttggctctggtcagcaggtgcacaaagtgccatccgtaccaaacagggcagaagaagtcttaattctggatcacttaaagatgccaggcaaacaacatccaccttctgcattgcctcaaaagcaaaagggctgacaaactgaagacttgtacattcagtcattattactgtttgttgatcctaatggtaaaaatacaaatgaaagtaggagtttaactttcacatgtatgaacacccaactttctaaaaaccctgaaaaatgtggtgtatctttaataggtccctatgttggcaatgttcctggcacaatcaagacaaggcttctctgtctccctaggtttatactgtcacctgggaaatgggaaagaaaacagagtatattaatgtctcttccagcctcaggaatcttctgctctaatactcatattttacaaagaaggaatatgaagcccagagagatgaagtaacacgcccaaaatagtattactagttagaggcacaatccaaggctgaatcctcatctactaaaatcccagtccaagactttctccactatatcagtcacatgagctccacaaaatgtaaacaaaagtgaatggtcatagttaagtgctttctttcataccccgatagtttcacatgcctaccccgatatacatcaagaactattgggcttctctttctcaccctccatgagtcggtggaaaaactagcaaatcactgggcagaaccaatgccagattcaaggctctggaggccacaacactatcctatgtcccctgtgttaccgggtaaaaagcagatgtgtgggtgctatgtgagaaagacgcgtctcattagcgcacttctctgtctccaggaatcatccaaggcacaaaaagtaaacaaaaaggcagtgagctggcagccaaagcagtcccctctcaaggccgaccgactagcagcagcgtgggtaaaagtcgtgggtaaaaactgctttgctttcagggaggggctgctcttttaacagaggggcgggctgactggagcagaggagccaagacctgcgtgctcctccgtctcgccccgggcgcaactagaaccaataagtccctcaggctgagcaaagtctggccaggctccgacacggacctaggaacgcgctgaggccagagaagcggacgcttcataccttaagatctaccctccagcctcacggaaccgcacacggactccgcgtcctagaggcgggacgcggcagaaatcgagagcgcggtccgatgttgggcctaggcgatatccggaaccccaaaccctagttgtgcctcgagtcgactcggacaccaagaactcagacgccgggaccaaccgggttgtcgatacaaagtgggaaggatgggggcaccacacaaaggcagaaccgggactgtaggaacggaaaagcgggagactttttcaacctgcacccagcaccttcattcatccccagcgtctgactcccgtcggccaccgtactggtctgagaggaagggtggctgcgagaggaaaggcagag

SEQ ID NO: 1406 - DNA, 62650 bp, Homo sapiens; identical to SEQ ID NO: 1405

SEQ ID NO: 1407 - DNA, 6910 bp, Homo sapiens
tgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagat

SEQ ID NO: 1408 - DNA, 55661 bp, Homo sapiens
tagtttatagaaggtgcctttaatgaagtgacattgagcagagacttgaaggagggagagcgggagccatgcagctgtgttggggaagaagcagagaagtgatatgatttgacttttccaaagaatcactgtggctgaaaaatgaaagccagaggagtggtccccaaagagatgatgctggctgggacagggaggggtggtggaggtgagaggtgtggagaatagggatttaactctgaggtttccagcagcaggcttggactgggccctgaaaaccaattgttaaatttcaggaatcttgcaatctggttgtttaactgttggcagtgtgaaattggtcaggttgggagttattacactagagaaattggcaagcactgcaaaacagcttttggtttttccctttcagaaagtccattgttaaacatttaccatctcatgtaagtggacacatgcattttggaggcagaactgaatatgagttgtaaagggcagtcatcgagggctcctcaatgttgggctgtggcagcatttctaccacaagcagcaggactgggaaggctgcaggatactagaagaaatactgtctccatcacagagagagaagggagagcttctttctttttgggtttgagggataggatgcttggacaaagaggaaagagaatcatttttttcttaaaattggtataggggttcatgtgtattcaggaggcagtagagaacctcaacaaggctgggggagttggggtaggcaggaatccagaagacaggataactcttgagagcctggagagagtctgtggtttatggccagtcccaaggcgacggatgggagaagtcctggtgtgtttagatttggagtgtttctcaccttctagggaggtgccatgagtcagtgcccagagcccaatcccatggcccctgctcaggaccgtgaatagagacactgctttggggcatcatggtcttgtgaaggtggaacaggagcgtgtgggcaggcagatgacctgggagaggaggcgtttggagctgagtgtggggaaggttctcgccagctccttctctcaggctgagcttctcaagaaaggaggaggcagcagagactgagggtcctacatggcagggaaggaaggaaggagctgttggaaaacacatccacattcattcatctgctcatcatttaagaaatgtttcctgagagcctgatatgtccctagtgctggtctcctcttgggatgcctgttatgggtggacaggcagacctgagataggactctgccagctcagcacttcttccaagtcctgatgctccctcttccccgctttccactcaagcacacagaaggtcagagcaggaacagccctcagagcagcctatctgggaattctcaacactacggtggggattactttgaacccatggagtcccagcagtggcctccaagggaccacccactcagttggccctcacttagacccctctgtccaccttttccatgggactcctaggccactggggacaactttgaacccccttgaagcatcccacctcctgtaatacccttgaccatcccaactcctgcacactccctgggggttgggagccccatacagggttccctgagactcctgagtatcctgagggagccctgtcaccttctgtaaactccactgaccctgaagctgcatggcatgtgagctgggccctcctgctggccttgcctttctggaggagcccttggtcagtcctccctctcctaaacttacagtcaggccttctgtttccagcagatgtagatggcagagacaccaaccaccagtagcagcttggggcccaggaggagagctacgaggagtggagcagtaggagccagcgctgcttctggaaatcagggaagaggaggagccatgagaggggccacctgggagctcatcccaggggcctccacttaccccatctgaggctacctgggcccatcaatcctctgaagcttttgaacttgcatcctgctctggctttcctgactccagccgaaagcaaaggccagggaaagtggctcctcattctcactcaccctgtcccaggctgccagtttatcctcctggagggaaaaggtggagagagtgtgtgctcaggtattcatatatgtggcaactgggttcctcacttgatcctcacacgcccatggggcagggattattattccattctgatggggaaactgaggccagagagtttagggagtgtcaggagattagtaggatccaaacctagggaagcccatcattatgtccccaagggtgactcctgagtccaagacaagtccaacactccaggatcatgagaatgattagtaaagggtgggcaggtggtgtgaggatggattcagagtgagagagttgcatgctgcccttcttagccccaggggcagggagaggaccccatattctcatgatctcagggagccctccagggacaagacccaattaaacctgctggctggaaaattccctggtgagtcagggaatgtgcctcgggcttggaagggcctcagacatcatctctcctacctcaaccccagtgcagatgtcatctgaaatctttctgttggacacagagagtcagatctacggaagctcatgttgggactgtttgcattttttaaataaggggttttggatgttaaaagtaacaaaggtattaaaaaaaattttttttaaaataaaatggtgctggtgggtccttaaggaaggaatggagacctcagcatctatagccgctggagtgttggagtgttgcaggccggcagttctcagatgggtggctctctggggctttctctcctttgaggagagctgcactgcccaagtttattccttctaaggggcagcccacatgagagatagactgcattgggaatatgaagggccagcccttcccctcaatttgaaaaaaatctacaggaccctccggccttttgcctctctgcaagagcagctgcatctttgtactgcctgcactgtggctcagcacctccctcctcctacactcctgcctcctcattcctgaggcatgttgaccctgacagcactctaggatgcctcctgcattgctttatgcatcctcaggtggcctcccagagaaactgtccttgggaagtggtctggaaagaagactctaaaatataagttgggaatctgattactcatcagctagcaatgaggaccccagggctggtggtgaatgggactggagaagccgtgacttgctgttgtgttgcgattgataacactttcactggcactaaactgggatagtgttaccacaggaaggaaattccttgccattagccttttgaaaacagattgggaaatggtcgttataagaactaaggtgttagctgttgctgggcatgaactcttgggaggaaggcaatgagaaactaagagtgattcatcatgagttaaagttcagctggaagccagaggacttcttggcagcactgcagattcttatttcttggagccacagggcagaaggaatagagaattgggtcctgggcatcatagaagagtagcagaatcacagcggagcatgaatctcagtttcaatggctgctatgctgggatagggccctgatggggaagttgtgggaccctgaaatgtggaaggagacatttgggtcaaaccactcaaagattgtcagttgacttcagagttactggggacaattgcagtggcatcgctacttgtcgctataaatatcctccccaagccaaaagaagaaacagaaaaggaaaagtaaattctacacaatccaggccctaaatattgcttgaagagagaatgccaaactgcaaaatggctgagtcaaaagggaacactcacctaaccctagggcacagtctctcactaggctcccatgccactgatgcagcacgtcacagaaggcatcctgcagtttgcctgccagcctagacaacctaaaatgcatttccagacttagcatatgtgccaggatgccatgtcagacacactgaaagaacccaaaaatggcagccctctctcagccccagtgggtggttggaagtctaagaaaagactcaaccttgtccagatggtacagactcatctcatcctgtgcctccttgagaagtacaactatgaacccaagaaatatcatgaggagcaggcataggagaacttccaaggtggaagagcgaggtaagaacctgaggactgaggaacagcccagcagccaaacagcagggactctatgcccaaataccagcccccagccacagaaagtgatgaagggaggacatagaaaagaggaggtctcaagtcaataaatataaatcccgcacttaaagaaactacaaaaagtagggcaaagtaaacccaaagaaagcaggagataggaattaatttaaaaaaaaaaagagagaagagagcagataattaatgaaactgaaaacacaaaaacaatacaaaaacccattgaaacaaagagtcaatcttttgaaaacaccaataaaatgggaaaaaactctagcatgactgatgaaaaagaaaagagaaatgacacatttttagtatcaggatgaaacgtgggataccattgcagaccctgcagacaccaaaagggttatgagaggatattatgaacaactctacacacataaatatgacaacttagatgaaatggaccaaaagttatgcaaaacacaacttaccagggctcactcaataggaaacgaaaaatgtgaataaccctaaactattaacgacattgaatctatgattataaaatatccaaaaatatccctggggcccagatctttcaaaggaaaacacaagcatttaaagataaattaaaaccaaatttaacacacaggaaaatggttctaaaaaatttggtaaaatgtgaatgtatgctccattttagatgatatgaggaaattattttaataactttatgaaatttagtgatttgaacacttaaaatttaagtggacaatgacactggttttgtgaaaaatgtccttgatcacatgatccctcaatgtgcaactgcaggtgcatgcgtgagcaagttttcagtggacgtgactatgcaccttccacacatctctgatgattggggacattgtttgtcttctatttcgtgtctttcctcttctggcaggcagggacatgaacaaatccgtgactcagcactgacccaggagatgacgcaaacatcatagggtgttttggaaggaacctgagtccttattcttatttcctggagcctcagggcagaaagaatagaagattgggccccagccatcattagaagagtagcagaatcacaaaggatgttgaatgtcagctttaatggcttctatgctggggttgggccctgatggggaagttgtgggaccctgagatgtgggaggatgtattcgggtcaaagcactcaaagattgtctttcgactggagtagagggacccctcctggtattaaaagagagggaaataagacatattttggttatagagagggggaacactggccaaatttgggtccttgggacaaagcgcagcagaaagggaaagtttctctaattagcacaaattcccattatagcctggtagtgagcctgtcctcagggactagatttaccttcattactttggaccaataacctggtctaatgacaagaagtcttcaacaacatccctcattacttcctaagtcctggtttcccctttggtaaaactccaagctcactgggtgtttgaagcaggaaaggagatcagagatgaacagaaatttgcatatagtaaatgtgcagagtggttgtgattattgttggtcaaatatcaccatcagaacacaaaagaagcctgtgctgtgaccaggtcacctgggggtctgtccaggcttaaacttcacttgtctttctgaaatttatagagcagatgctggagactggtggctgaggtcacagatgcggatggaaaagtttaggatagaatagggacaaggtagaggttagaaagtgtaaaaggcaaggtgctgtgctggcgagaaatgcagaagaaggcgagacacaggacttcataaacaaacggatcacctccctctctcttttttcctttaatgtatatttatgtcaaaatatctatcaagttgtgcatcagacttgacgcacagtttctcctggtagatggggcttaagggtgtctacaaatggccaattgttaccttgaaccttctaagtagtggtgacccatggagtgtaggattttaatgtagacgttaaaattctactttatatttatagacttctagcttattttatgacaagcatgaatattgcttttaacattaaagaaaaagacaaaatttaaaaatgggaagtaaccgcaccatgggtgatatctgagccgtgctccttctggtgcgctgagatctccagggcatagcttttgctgactgcttgctgcccatcatgctccacctgacaggtgagcaccacatcgtccctgtgggcacaggtgttcaccaggagccagctcatccagttgtaggtgccatccttgttctctatgagggtcgaagctgtttctgtccgggacacatttccattctccaaccaggtcagctgtagtccccgggggtagaaattgctcacctggcaggtgacgtttgcctggttctctgccctcatgggctgttgagtaacctccaaggtgggtggaactgaaacagcacagggcagaagctctgatcttgtggcacagacagatcacagggagggctaaataacgtagctcccaccaacacagtgagggcatcaccaggacagtgctaggcaggcagcaggtgctcagacattgagggcactcgttgcatatgagtgaaattactaagcacagtgcctggcgcacagtaggtgcccaaggactgttagctgctgctaggctaaggatgagtgaaatctacaagcacaacccctggcatgcagttggaatgtaagaactgtagcaaaatcagtgaaatcgccgagcacatagtgatttggctcctagtaggtgctcactaattgtagttgctcttggtgaaataaatgaaactctgtagcccagagcttggcacatggttgctggtcccctgacagctgccattaaaatgatagtaagtgaccggctcacctaggtgcatgggaggtggacaacacagttaggaattagattccaggcctttcaagctctggagcctggggagaggggagtgggcttggcagccaggtgtgggcttgggctgggtgtgagggtcttctacctcggatggcctcagacaagttggcagtcccacgaagagggtccccctgcaaggtgatgtgggctatctcgcagatgacttgagagtgaacgtccccacgggtcagcaccaccctggctgtgctgtggatgctgtaggacacactgtctcctgcggggtccacgttggtctggaagtctgagagctcattcccatttttgaaccatttcagggtgatgtctctgggagagaagccatgggactcgcaggtgaagctcactgtgtgctcaggtgtggccctcaccgcagggcccgataccacgggggcagagggtttggctacaaaaggaccatcgataatcaggagacatgactcagatgaccatcactgatgataagcgtttgacatgttaagaaccttctgagacgttagtttttaatctttctaataatgtcgtgaaggcagtgtccttattctcattttacagatcaggacacaacagctcttagaggtgagaaccaggccatggtcagacagtgagtaggggcagggcccagagggaagtccaggcctgagttcaaagtcctctccacacagggagacttccaccaatctgggcataggaacaaaattactgattggtctccctccatgttattaactggtcctagctgtcctcccccggaaggctcactaacctcagagagggcatttatagaagccaatacagggatcaatggcaaagtggcaccaccgtgagagctgcaaccaggctgctcagcccaggacaggggtgggctgacaaccccagctcctcatccgcaaaacaggaggacggaggacggcgtttctacttcctgggatgtcgccaggattcaatggggcaatggaagcagttttgctctggatcaaacacagaagatgcttcccccaaaaaacacagatctatctttaacccagactttacagatacacagaggtctctctttaggtattataaaaatatgaaacattccgtatttttcttttcacaaatatttcgttctgtcaaataaaaggcattaattaaggataaagctttaacgtagagccaagagtttgtaagagcattggaatcacacctgctaaaggtcaagccacaggatgttgcagtagatagacctggataacaactgaagccagggtccgtgggattttgatctctttcacctggagtactttaatgaaataaccaatgagagtgggtttgcagttgaggattttcaaccagctaatgaactgtttccaaaaacaaccttttgtgaaaatcccctataaaaaacctgtcctgtattgccatacgggacactattcagggtttcactgactcagtgtacccaaattgcacctctttatctttcagataaatgctatttcctttggccttcctaacaatcattttgctgttgttgttagttgttctaatctgctggaagtcctaaatttgaaaagaggaaatttttgggaatctgaatcttcagttaggacaggtttgggtgaaaaacaaggatcactgagtactaagaaagccaaaggtggttagctttttcatcgttaattaattacaagagacaaagacccaggccacaccaacagacagaaacctattctgggccttgaaagcaaacacattggagaatcagaacaacgagtgcagtttctccatgtagatgaattttaagggtgtctgcaaattgctaattgttaccttgaaccttctgccgtcctcttagaaagcacatattatacgtttgactttgccaatattaacttgctccctgatatgcgtgaaataatgtgagagcacagtaaggagggtgtcacttgaagatgtcaagtctttgagacaccagcagcatgggtgtccctagaaggctgagaggctgtcttcagttccgattttttgagggcttcttggcagcctgatgctggctgctctctctgtacctctcagcacttcaatcctccttctatttgtcagagggggtcctcatgtgagcccttgtgtagggcgagactctgagaggatccttggtggccaagggccaaaagtagatagaaaccccaccctgggaagatgagtgagggtaagtgcaagggcatagcctggcatgtagtaggtgcttaataaataacccctgtgactgtaatcatgaggtttggtcattactgcttctggagctgcatagctattctttaggcaacagaacaaagaggcacacaaacaccaaggaaaggctcaaaccctactcaccgcagctgccagaaaaaacccaaatgataaaaggagcagcaaccaccatgtttggcgaactggctttcaagtaagatcacaggggaagctggaagcattttggaagaaggagggaaaagatacctcagtgacatctgggagtgctgagggagggaggcttctggggctgaggagtgaggatttgctgggactccagcacgtgtttagatacaaatgttttcaagacagaaggttccccagccctgaggctgcatctgagccaggctttgtcccagtctcctatcttgggccctgaggccagtagcatgggaggggtcctgttcaggcttctggggcctcccagaatgtttccagaatggctgttttgaagcacccatgacccaaaaagctgttctcaaagccccaaaacctggggcaccgcttttgctagggggctgtgtatgagaatcttctggagccattaagaactttagatatccaggcccaaattagatgcaattaaattggcattttaggggggttcctgggtccagctttgcaaactttttttttgatagttttcccaatgattctaatgagcagccaaggttgaaagccactggactccaacccaaaccccatttatacttggggcctagagatgccctgacctgtctgaggtcacacagcttcaccctaacacaactcacctttattgagcatttactgtgtgcttgttgatgccctaagcattttacacaatatcactccttcagactcggcccagtctgtgaggtcagtgttaccatcaaagggtgaggacatcgaggcctatggtggtgaagcaccttgtcccaggtcacagagccaggaagtggcagagccgggaagaggcccaggcagctgggatactgcctgtgttctcctaacgacagttctgcagaagctcagtaataacctgaatgacaccaccattaggggctctgtgcacatcctctccaatcctcacagaacccagaataggccatgataatcagcatctcaccgatggggaaaccgaggactcaagggaaggcaagactggcccaagatcacacgatcttgaaataacacctcactttgggggtgcctacagtgtgctaggtgatttacagagagaaccttacgcttacgactttcctaaaggagtccatgattgtctctattctacagatgaagatgccgtggctgaacaaaatgaaggcactgtctcccgattctccatgtgtcccagtgggcatttcctgtgtcccaccaagcacttatgtccattaacagagcaagtgttctaacttcttgagctccaacactgactgccacctcaattgtccctttgagattctagacttcatgcaatgttagggagaagcctccctcctgggtgcccaggcctggttaccctgcagccataagcaaaagacagtgggctcctgacagccggaggggagaatctcaactcttgctcacatgggccccaaacactctctaggaaatgcctcatctcctcatccttagtcctcagcaccatgaacgggcagatacgtgctctgctgggctgcaggaggctcgactctgctcattggacgctgctgagtgaagaggaaacaacacaacatgggggaagagtcctaaatgcctcatgtgtgttgagacctgtcctttaggaaccggcttggcatatcatgagacatgcgcagggcctttctgatgggagtgtgaagacaggccctcctacccctacagggttcttgttttgtttttaatgctttttgctgtagaactgaacaatgcaagagtttagaaagagaaggttggagcatttctccactcttgaaaaaccacagttgagtgtcacaaagacaaaggctgtgagtcaggctgcggggttccagccttggctccctgacctgctcccaagtcaggtctcctctctgagcttcagtgtcctcatctttaaaggaggtagcaaatggcttctccctcatagcactggttataaggagactctggcacagttgctgctctctggcccccttccccacctccctcctttctcatgtagctcatcatttaggccgagagcatggcaaagaggagtgagtacttcactaggagtgagcagatctgagtcacacctgagccaccactggctgtggctgcctgggctggggaggcaccacctgggcatttcagtgtctttgccaatattatctgcacaatcaggataaagccaccttccttgtctaagttcaagggttgtggggagctgatttcagtcattactgagcaatgtacattttcatgtacatacatgtacatgaaagcatcatgttttaggctttacatatacacatttttttaaaaagctgttagtaaagctatgtgtcttctggaggttctgtttttttgcctttccaaattccagaggctgcccacattcctttctcacagttacatcttcccatcactctaacctcttgcttatatcctcacaagtccttctctgagaattaatctccttcctctgtcttgtaaggacctttcttatgtattgtgtccaccctgatgctagagccagatgttaaaaccactgtcttaaaaatgtttgaagtggggccaggcatggtggctcacgcctgtaatcccagcagtttgggaggctgaggcgggtggatcacctgagtttgggagttcgagaccagcctgaacaacatggagaaaccctgtctctacaaaatacaaaattagccaggcatggtagctcaagtctgtaatctctgattgctacatcatctagaagggaaattaggcaatattctcaaatatgaaaacacactatcctctgacctagaaacaccacttccagtgggaatctcccacctgagtagggtgacacatgtacaaggtcatccactgcatgattgttgtagtagctcaatgttgggaataacttacatatccatcaacagaagactgtaaaataaattttggtatttccataaattggagtatttttcagctgtaaaaaaactggagcagttctctatgtcctgatgtggaatctcgatatgaaatgacagggcttacatttgggagaagttttctagtcaccaatgagctttagtatctgaatgtgaggtgcattcttaacatttgggaaactgatgaaaagagaaatgctggctctctgacacctggctctgtttggggaacttttatctagcacctatgatgcaccaggctcttctatggagacagcgtctaatgctggggaaggaaggagactgccacgattcagatatggactctggctccaattctgtcactaactggccctgtgaccatggacaaggcccctgtcatgtcttggcttcagtctcccatctgtaaagggggttgggctggatggtctgaaggtccttcctgtgctgacatgccagaattcagcagttaagacgaggcttttggggctctggcaggaaaccccacataagcattgttgctaccttatatggggaacccctaagtcacccacttgtgggacctctttcctgaggtgagggacattctgagatgatgcagctctgctcggagcccatggtaactctgtgactcagtccccaaatcacagaagggtttcccaaatagacccacagcaaatgccaaacatattggcatctcctcccaccaagccatcagattcaaccgtgaatgtgcctccgagaaatcttccccgtggggtgtttctgaagattaaattaaaaaaaaaaacaaccacgatttaccctctccatgccctggacggatttctcctcattagaagggaagagaatgtaagcttggtgggggagcgctttaggctgtttcattcactgctgtttgcgcagcatccagggcagagcctggcacacagtggggtctcagtgactgcctgttgcataaagaagggacttggccaccctgagggggaagcattctctggaggcagaaggcaaggtccagccctgtgcctggacaagtcactcaaattgtgagttccctcatctgtggaaccaaagggctgggtcagctttggaaacacaagagctgtagagccgcagactggggatgccttctgtcccatcatttacaagccgtggagcctcgagcgactgccatgacatctccaagcctcaactcatgtgatctggagaaagggtgacatcagttcatgaaagggtggctgctcagccaccaccacacctggctgttgctccaagaatggataatgtaattattgagttattgtcacacaccaggggacaaaggaggcccacgctgtactcaccgcgcacagacagctcagtgcctgctccagacttaaactccacgtcgtcagggctccctttccggaacttcacacagtagtaggtgccggcgtctgctggggtgatgttactgatgctgatggaaaagtccaggttgtttctctttgtgagttctgaaacagttgttacccgtgggaagtggccttctttctgattgtagattaattcccggcctgctccagctcctctaaaccacatgatgggccccacagggatcagggacgtcatagcacagcgcagagtggccgactctccagctgcaactgatacggacttttcaggctgaatcacctgtagctcgtcctcacctgccactcctggaaaggagcacaaagcagtcatttcttcatccttacctgattctctgtgtttcctcaagtgtttatcaatggctttcattgactgggtgcacaccaggaaaaggccttgagctcagcccactacatgtattatctcatttaaccctcacaactggcctgtgacgtaagactgtaatacaagcgagaacactgaggcacagagaggttcaatttccttttccttactttcttctgttctttctgtttgctttcttttcttttcttttttgagacggggtcttgctctgtctgctgcccaggctggagtgcagtggtgcaatcacagctcactgtagcctcaatcttccaggctcaagagatcctttctccttggcctgccaagtagctgggaccacaggtgcattccaccatacctggccaatttttgtattttttctagagacacagtttcaccatgttgcccacagtggtctctaactcttgggctcaagcaaaccatctgccttggcctttcaaattgctgggattataggtgtcagccaccgcgcctggccaagaggttcaatttcaatgtagagctttgggttgaggacctgagtagaactattgagccctcctcggaagtgccatgttttgccaattatggcctccactctgtggtacatggagtgtggcactttttgtatcactggattgggtggggccctgtgacttctttagacccttgagttatgagcagaatgatgggtataatttgtgggctgtgcatttaactgcaagagcctctgtggatcaatttctcccttccggagaccacgaggctctgatagggcctgctccatcgcctggatgcgtgaatgaccgttgcatgcagaactgccaatccacactgaatatgtagcttccagtagaaatataaccttgttttaagcccctggtaatttttcacccatagcataatcacattacctaagtttcctaatgctgatgtgacaaattaccaaaacttagtgtgttaaaagaaatgtaacattttatagttctggaggttagaagtccaaaatagtgttactggggtacaatgaagaagaaatgatgaacgtcaaatacacaaagatagagaataaaacagtggtgactaggggtgaacttgggggagttgatggggaggtcaaaagacacaaaattgtgataagtctgaggaagaagtccagagaatgaatgtgcaatctgaggattttagttaataatgttgtattgaattcagtatttttgcttaagaagcacattttaggtgctgttgacatacaacacatgcagcataactatgggagatgatggatgtgtccatttgcttaactttaataaccatttcactacgtatatgtacatgtatacatatatgaaagcaccatgttttacaccttccatgtctacattttttaaggcgctttcagcagagctgtgtgtcttctggaggctctgttttttgcctttccaaattctagaggtttctcccatccctttctcacagttacatcttcccaccactctaacctcttgcatcttcacctgcaaacatcctggaatacaaggatgtttcaatgtccttctccaagaattaatcttcctccttcttataagcacccttgtgatgtattagctccaccctgatactagacccagatattaaaatcactgccttaaaaatgctgagaggtaaaggaaataacggaccaagaactaaaggaatataaatgtcttaacaaaatgagaatgtaaagaaagagaaattataggaagaaatcaaacagaaacttaggaattgaaagtacaataactaaaagttcactagaggggtccccccaatgggtataagccggtggaagaataatcagaaaactggaagatggaataattgaaattattgagactgaggtgtgggtggaaaatagaataaagtatagagcacagaatctaagggaattgtgagacattatcaaatgtatcaacatacaccttactagagttccagggggaaaaaagagaaagagagaaaggaatagaagattatatgaaaacagagtggacaaaaatcttcacaaacttgttaaaatacaggaatctacaaattgaagacacagaagaaacgcaagttgaacccacaaataaactcagagacccacactaagacacattataatccaaatgttgacacctaaagtccaggtgagactccttaaagcagcaagacagaagcgatttcttccatacaagagaccctcaataagattttcagctcagctcttatgcaatgcaccgaaggccagaagatagggggatggtaagttcaaaatgttgaaagaggaaaaacatgtcaatcatgaattctatacctggcaaagtgtccttcaaatacaagggagaaattatgatattctcagataaacaaaagctaacagagttcatgaccattaaaccttgcctacaagaaatgctaaagggagtgcttcaggtggaaatgaaaggatgctatatggcaactcaaagttgtatgaagaaataaagatatccagttatgtgtacattttttaaaaatcatgcttcaatatcccacaaacaagctgtgagcaccctgcccaggtgaccaggtaaccagtattttaaagctggtccctgccacaattcctcttcttgtcttcccctactgtgacctagtgacattgaaacactctagtaaaagtgtttttgcttgtgtcctccaccttgactcccagtaaaggcacttgcccagggatcccatctctcttgcctacccatctgcttgattgagcctgctccttgggagctccttccacatggcttcctgcatggcctgccctacttctgtctctaggaactgtgagtatgcctcttcatatgaacttttcatggccatgttagagtgatcctctaagattcaaccagcaggagtcactctaacattttctatagtaatggcaatgaggatgggatcattctaaactcaggtggaaagttcctagggaatgcctttgactcatgacttactgatttgctactctgattggctccacaatttgagaaggctttttaccctgatgactttcttgtgctatgctatgtacagctttgtgttgccttttggagtgctgccatggctctccatcctgaagcgaggatcctgttccaatatcaataatgacatccacctttctccaagagcacaagatgatataacattggtaacacctcttcaaagaagattcatgtgatatgcatattaatgtcacataatccagcacctgtaagttttttttgggatgcctgtggcaacatattcttcatttacaaattttacttacaaattaaaatcaacagacactcctgttagtgtcattaaatgaattaaacaaaaatatctctcctctgtaaagactttggctgtgtctttcatgcctcttggagtctctagaccactcatgatggctatatatttcctcagggccttgatgcaaaaataatgctctttatggcctacgctgtactccattaaaacaactgactggttacccactagaatctcctgatttggattccagatttgaagataataccctcctgtttcaatcattaaccataaattgccccacaggccaggctctgctcatctgaaatgacacccatcggaatttaaacttccactgcaacacaaaattaaaattgctgccaggtacagctgcacacctttctgttgacagttggcattattactacttggtttgttgatgcaacaatcctcaaccaaatactagcaaactgaattgaacagcatattagaagaattatacaacacgagcaagtgatatttatttctggaatacaaggatgtttccatgcacaaatgacaaacaatgtaatatatcatatttatagaagaaagacaagaaacacatgattagctcatttgatacagaagacgatttgacaaatttggggatctttttatgacaaaaaccatcaataaaaggaatatatgaaaacttctataaaataataaaagtcgtaaacacacacttgattttcacttatcgctgtctaatatactattttatttgcctatttatcatgtgtattgattactgtcattctccccagtggagataagcaacaaaagggcaactactttttgtcttttattcaacaatgttctttgttaggtcctggcacatagcaggtattcatcaaatatgtgtataatgtgtgaattgcttagtggaacactttctcaggagactaaatattgtattttaagtgaattgctttcatgaaatttgccagaaaatgtgtttcccatgtgaattggtgaaaaaaaatcgacttgtatacatgcagaaatcagaagagtcaaggagaagaaaaccacaaatcctcttctccccaccacatcacctccctgccctcatgagcagcatctgcggaaatttcatggaataagatcaagggcaaaagtgtttgagaagagtaatggtgaaacctgtgatctctagagtcaaagtgcctgagttcaaatcgtagctctaccagttaccaatgagtaacctaggagcactttgtgcttctgtttccttatttgtgagggagggtgaacttggatataatggttacctgatgtcagaaatgtaagtgatttcctacagtatctggcacacggtgggtattcaaaaattgtaaagtgattacttggcagatttcctgaggattggaggcttcaatggatattagatgatgatatggttatggatatggatatgaatataactatagatatagataatataggcagggttctctgttacttttatctccttctttcttcctcaaccctaccattaatggaagagagaactcaaagagaggaatgcgcaaaagttctgttttgaggaaaagtgcattttactaagaagtctgcttacctgttgctttgcttaacagattgggggattttcaggggtaaatgactgaagtagaaaggagggagaatgactgggcaacagagaaaatcaaacatctctttaatgtgtttttcctgtagactaaaaaatgagttgaagactgtagtaagggaagtcttactactactactactactactactactactactactactactactgctgctgctgctgctgtgtgtttccacatggtcaagtaagatttatcccaggaattcaaggatggtacaacattcataaatctctaaatgtggtacagtgtttcaacagaaagagggacaaaaaccatatgaccttacaacacaggcaaagaaagcatttgacaatatttaacattttttaatcataaaagctctcaagaaattagataccaaataaatgttcctcaacacaataagggccatacaggacatatccatagctaacatcatacccaatggtgaaaagttgtcaccttttactctaagatcaggaacaagacaatgatgcccactctcaagttttctattcaacatatagtatcagaagttctatccagaataattgcacaaaagaagtaaataaaaggcattcaaatcacaaaggaagaagataaattttccctgtttgcatatgacactatcttatatggagaaaatcttaaaaatctctaaaaacttttagaatcaacaaacaaataggccacagatataagatataaaattaattggtaaaaatcagtagtttcatacacttatagcaaattagtgggaaaagaaatcagtaaaacaattttacttacaattgctaccaaaaaaggtaaagcagctaggaataaacttaatcaaggagctgaaatacctacacactgaaaactataaaacttggatgaaaaaaatagaaaacaaataacagaaagatacctatgtttgtggattggagaattactattgtaaaatgtacatactacccaaagagatctacagattcaattcaatgtcagtaaaatttcaatgaaattccacagaaatggacaaaacaatccttaagttcatattagccatagaaaaccatgaatagctaaggcaagctttagcaaaaagaacaaagctggaggtatcacactgcttgatttaaaaatcttctacagtgccacagtaatcaaaacagcatggcactggcacaaaaagagacacatagaccaatggatcagaccagagagcccagcaataaactcacacatttgcactcaattgacctttgacaaaagggtcaagaagacacaatggggaaatgtcagtctcttgaaaaaggggtgttgggaaacctgaatatccatgtgtagagaaatgaaattagacctctgtctcataccacatacaaaaatcaactccaaatgtattaaagacttaaatgtaagatctgaaactgtaaaagtactagaagaaaagttccatgacattggtccgggcaatgaatttttggatatgagccccaaagcacaggcaacaaaagcagaaataaataaatggcactacaacaaactaaaaagtttctacacagccaaggaaacaatcaacagagtgaagagacagcctacaaaatgggagaagatattttcaaaccatacatctgatgaagagttaatatgcaaaatatataaggaagtcaaacaactcactcataagaaaacaacccaagtaaaatatgagccaaatagccatttctcaaaagaagacatcaaaatggccagtcaacatataaataatatccaacctcatcattcttaagataaatgcaaattaaaaccacagtgagctatcatctcacgcttgttagaataactattatcaaaaagatgataatgactatcatcaaaaagatgttggagagtatgtggagaacaggaaaccctgttcccacacagttggtgggaatgtaaattaggccatccattagcgaaaacagtatggagtgtcctcaaaattcaaaaatagaattatcatatgatccagcaatctcactactgagcgtatatccaaaggaaatgacatcagcgtgtcacagagatatccgcacccccatgtccattgcagcattatttacaatagccaagatatggaatcaacctaggtgcgtatcaacagataaatggataaagaaaatgtggtgtatacatacacaatggaattctaatcagttgtacaaaagaaggaaatcctgtcatttgcaacaatatgaattaaccaagatggtattatgctaagtgaaacaagccaggcacagaaagacaaacaccgcatgatctctctcatatgtggaatctaaaaaagttgaactcaaagaactagagtagaatgacggtttccagggctagacaaggggtgcagttcggtaagtattagtcaaaggacacaaaatttttgtttagatgggagaaattagctccagatatctattgtacaatatggagtctatagttaataagatgatttatatccttcaaaattgcgaagtgcatagattttaggagttctcgccatacaaaattgtcaatatgtaagattatgcatatgttaattagctgaagttagtcattcagaaatgtacacatatgtcataatatgttgtacatgagaagtatactgttctcaaattagaagtattttcttaagctttaattgaaattaaagttggagaaactgataaaaaatgaaatctcatgtgtgtgcgtgtacacacttacactcacttatatgcacacatgcagggatctctaatccccaggttgtggttgggtacaggtccgtggcctgttatgaactgggccgcacagccggaggtgagcagccagtgagtgagcgttatcgcctgagttctgcctcctgtcagatcagtggcagcattagattctcataggagtgccaaccctattgtgaactgtgcatgcgagggatctaggttgtgtgctccttatgagaatctaactaatgcctgatgatctgaggtggaacagtttcatcctgaaaccaacctccccacccacccactctgggtccttggaaaaattatcttccatgaaaccagtcccaggtgccaaaaagattggggaccactgcacacgtgtgtgtgcgtgtgtgtgtacacattcacaaatatatataaaactgtgacctataatatttgtcacatagaaatcatccaacagattaacaaaactttcggaatacaaacatataccagggttttaactctgttgctgactggtgtaatgggtgatgattaatcctgtgtctgctttcctgcattttctagtatttctgcaggtagcataagaaggctaaaagtaggaactctgaagctggtcgacctggacttgaatcccatctgctccactgattgaggtagggaacgatagacaagttcctctctcagcctgcctccccatttgcaaatagggaatatgagttgtagctttcacacagggatgttgtgaggattagtggagttaaaacacacagaatgctaagaacagtttttgcgttataggaagatctcaattgctgaactattactgctgtcatttgaatacagtgtatggtaagaaaaatgatttggaaagtgaaatttctgccctctaggacttgtgaggtggcatcacagcagggcccagtggggagctgagaggctgctgtgcccagcgctgtgaccctggtgtcagctccatggcctgagtaaggagtgaggacaggaagcctatctgggagctgggagcaaagactttccaacctgcccctcctgaggaagggaaaataaattctccatggcaaagtcaagagacccaagggagattatggtacctgttatgggctgaatgtgtcccctaaaaggcatgtgttgaagctccaaccctagcaacacagaatgtgactgtatttggagacagagtttttaagaagcaattcagttaaatgagttcattggggtgggccttaatccaatacgattgatggtctcataagaagaggagatgaggacacagacacacacacagagggaagaccatgggttgagacacagggtggagactgtcttctacaagccaaggataaagacctcagtagaaattaaccctgctgacactttgatcttggacttcggcttccataactgcaaggaagtaaatgtctagtttcagccacccagtctgtggttctttactatggaagccctaggaaatgaatataggccccaataagcagcaaatgcagaacttgttaaagaggaagaggtgaccaaaaaaatgggtgttaagactcaagtcacaggggagggaggatcatgggggaacacaggacaaaataaggagcacccttagggaggacggtggctgaacatccctgggaaacactgcacccctgtccaactcaagcaggcaccatttcagacttcacttcctctgggtattgaatacagaaggctgggcctggagccacacagccctctcaggctgtctctgagctcactctgtccttgggtaggttgtttagccccagagtctcaagactggtaaggatttaaatagtgattgttctgtgttagtcaaatgaaatagatcaaaatgtaagtaattgtggtggtgagtcaatcatcctgtgacttgatgcctctggtagccagctgctgatccacagagaaagtgctcagctccatgatgtcctgctcttaggccccatctctggccttccttggcagcacttgtggttgtctggaatccccaaaggtccagggacaggatatagccctgccagcggagagaaagggttctagcccaaggcaatgcttacctgtgagtcccagcaatagagtcagcagcaggaaaggacaaggagggtggggccaggaggctgggacaggcatcctggagacctcaggagcctgctctgttcaaacgtctgtggtggggagatgtcaggctctgctctgaggagagaagacaagccctgcctccctcagttcaagaggaagtggctatgatggattgcgacagcaacttgcttctagattgtaacttagaaatcaggcacagcaggcagctacaaagcacagagttactcatactccattttcaggagaatcagacaggctgagcaaaaataatgcttcctcttcaactgaggcctgtgttctgtccacgtggcccccttccccatcttcaggtcttcttgatgatttgccagttgagggtcttgggccaagaaggtctgtggttgtgagttgtgtcctaaactcttcatctcaggaccctaggatgtggttggcttgttgcttcgttctgcaccagcctcaaccaagtgctactcagcagggggcaacaggagggatcgcaggagcctcttgatgttggagaggaaacaggtatgctcttgaaatgattccttattcaaaccttttaatgatataactggcaaaacgtagctcaaattcagtctgatctgaactttggtactttcatgggcctgaatccagcagaagaaatcatttcccaacttcttccaggagagggagtagttttagtttagtaaggatctgttttgtcgggtgaagtgaggatcatgggttatggaaaagggatagggttatgattcgggcagaatgtggcggacaggttcctgaggtcatcacatcaactttaatatcctttgttctgcacagaggacctacttcattcaccactgtgttcagatgggaaatgaggagagaggaagtatatatgccctgaccaacaaggtgtgctaaggagttggggaaatcattgcagccatctacgctcaattttgttctctaaactgggggttataagtatttcattgcagtgttttagtggagattaaaggagataatgattgtaccatgcctgaaacccagtaggtcattattgatgctaatgacaccaggtgaagagcgggaactcgagtggtgcttttgaatgaatccctactacatggtgaattgcccaccagtggctttctcccagcaacccaggcctcctgagacccagattatatgatgtgcttggactacccctgccactctgagatcaattgctttctcttgaattctctgcatcctgctccttataatccacaaattaatttgttctctcacaatttccagctgtgtgactttcaagaagacacttgacttctctgagccttattttgatggtatgtaaatggaagttataacatgcaccaacatgcaccttgtagagatggggtaggaataatataaaccataatgaatgcttgactcataattaattttaaccaaaaaatgtggctataatttttttttatgagaagggctcactgctttcctgccacagttgtgctttagaaaaaccaccttgttaggagaaatgtttgtatcatctatgacttagaaaggcctgtctggaagcttccctgtcacatgctaggttttaggtccttcatctgttattgtcaaatgaaatgtaaaggttatcatattctcattcaaagttctgttcaatgtggcaaatgtgcacagggtgaaatcttcccctcctactccacacccacaaaaatgaaaatgaaaaaggataaaattatattattccgtgtcaaattacacttaaaaacaagacaatagtctttatgtgacatgaaggaatagcagcagttatcatttattgcagaagtcctgtgccccagatatggtgtcaagcattttatgtcagttacctcattaattcatcactctgactctatcaagtaagcactgctattaacctacctccttttacaggcgaggaaacctgaggcacacagagagtaatggatttgctcaagatcactaagcttttagaactagagcataggttgccacacaccacagacttcacttttaatgtttgcactatgacatctgtcattggaaaggagagacatccctcaggaggaagcagagaagaagccatagcctcagttaggaacagcccgcacagtgaggctgtggcaggtgccatgctccaggaggccctgataactccatcacgtggggtggggctttatttctggaaagatggcagtgcaggaaggaatcactgaagatgtggggaacagcagcaccatgagagatagctaaccaattcaagaaaaacaataactcaaaaacaagaacagcaatcaagaggacttcacaactgagaaaatatgaaaaaataaaatataaaaaggtctttaaaattagcatacacagtaaccttataaagatagcaaaagggaagtgaatccataaaataacatcaggcatgtgtgaaacaggaatagtcaggcatgaagtaacaggtatcttggaaaaataaccaaaaaaagagactttggaaatgaaaacataattactgaggacagttttaaaaaatgtaataggttgactaggggactatatatatataagtagtaagttattgggttgggggatcatgtggggaaatcccttaggattcagcacagagacacacctaaacagagtaaggtaaataggtgtaaatataggaataacaaaagatatctcacaaaacatgtcaaaaaatttcccagaaacagctgaggagctgagcacttgcagagagggtggtggtgcccagggttggctctgaaggcacagtgatgatgatactgaagatatttcactgtttgatttagaagggagggcagacaactaatagaccaaagaaatttaaactcagagatccagtggcctcacttttcctttaattatttcaagtcagtgcaatcgccacctattttctctatgaaccgcccagcagttgctttcttgcctgtgtggcctgtgtggtgacaatgatctcgttgtcaggtggcttttgggcagtgaagaatgtcaccggtagagtaatgattggactatgttggtggaatcacattgatgacaatggaaagggccattgggcatttgagtcctgggagacatcctcttaagagagtaaaactgtcttagaggctgaaagaagaatcttctggttgggactaatggcctgtccagtgctgtgagtgatatgtgcttttagtgcctgatttgatttggctctgtgtccccacccaaatctcatctcaaattacaatccccatgtgtcaagggagtgacctggtgggaggtgattggatcacatgggtggttcctgcatgctgttctcatgatagtgagtgagttatcaagatctgatggtttaaaagcgtttggcagttcccgccttgctctttctctctcctgctgccatgtaagacattccttgtttccccttcaccttctgccatgattgtaagtttcctcaggcctccccagccatgcagaactgtgagtcaattacacctcttttatttataaattacccagtctcaggcagttttgtttgtttgtttgtttgtttgtttgtttttgacacggagtctcactctgtcacccaggctggagtgcaatggcatgatctcggctcactgcaacctctgcctcctgggttcaagcgattctcccacctcagcctcctgagtagctgggattacaggcacccaccatcatgcccagctaatttttgtattttagtagagctggggtttcaccatgttggccaggctggtcttgaactcctgacctcaggtgatccgcccgcctcagcctctcaaagttctggaattacaagcatgagccattgcgcccggcctcaggtagttctttatagtagtatgagaatggactaatacagtgccctcttctccttcagagtaaagtggttgaacgctagacatgatcagacttctcaaatagagggagaaaatttatgtgttttacgatgttggggggcaacctaagagattcttgactctgaaccttttagatctcagtttatgttgcaacagaaagtgttggcttttttccccccacttaataactttatttaaaacaaacaaaagtagttttcatattaagtttttattttctctccagcacttggggctagaaagtgtgttgtcactacaaacgtccaaatttatttaatggtatacagaggtatgcacaaggtcatgtaatatcagtatatcccaaattaaccaaagtgtgtttattgatatatgtaatgaaggcctttgctatttgatccatagaacatagtatgttcttagtctatttcaaagctctatgtgtttacatattatttctgtagattattttcagaagcaagttttgtttccacagtatgagtgagcacgttggctaatgtgtaagttagaaataattgataatttttaatatgtacttcatggtaaaatttcttagacatacataaatgagtaaaaacgaaatttagggaattggtattagtttctaaagttttgtttattttcatttgtaagaagtcatttacttaaggtccaattattataaatgaattatcatagtttatgtttaaggaatacccagaaattgtgctgttctacttattttataagaggatagccagattttactttggagcctcctggagctcttcaatgctctttggcctaatgatatctatcttttattactaaaaacgcattatttttatgttttaatgagaataatcatttacatacttcacataatgggtaaagacattttgttttatgaatctatattttttcttactataatgagaatgttatagattatgcatttgtattaatggcatttcttaaagcagtagatttaattataaactaaagcaacctagaaactactgtaggtatctgtaaattgtgttgtaggtactatagacttagtggagtctcttaatcagattatgttgtgaatacatttgtacattattaaaatatatttcaagatgttttgctgattttaataggtgtctttattggagtgataactttaaaggtacaaaactttatatttgtataagagtctactgtttacgaaggaaaaaggaaaaaaaacccagaaatattaatatctaaagatttataatttaaggtaaaacataccagtggttgaaagaggaatatttccttccatgaaaatagcaattggcttggaaggtgtgagacataaagtttcatgcctccaaaaatcatagtttggaatacaggactccaaaattgatgcaataggccaggtgcggtggctcacacttgtaaccccaacattttgggaggctgaggcaggtggatcacctgaggtcaggagttcaagatcagcctgaccaacatggagaaaccgtggctctactaaaaatacaaaattagccaggtgtggtggcgagtgcctgtaatcccagctactcgggggctgaggcaggagagtcacttgaacccgggaggtggaggttgcagtgagctgagattgcgccattgcactccagcctgggcaacaagagcgaaactccgtctcaaaaaaacaaacaaacaaacaaaaaattattttaactgatgcaatagtgtcaggaagatggcaggatccgtgcttggagcagcaagttgccttcccaaggaaggaactgtcaaggagttctcaaggaactccaatccttcaatgaagatatgctagatgcatagatgcttattcaagtaaaaaatttttgtagaaatcacgtgcagaattcattttcaactttagattgacttggtgcaacatggataaaattggaatatttgaaagaacggggagcctggaagtccatgagctaaaactccccccttcatctaccatatttcgcccccactcacgacattagatgcagatgacgagggaagactttgggacacatgaggaactgggagcccatggatgcctctccagaagactaaagattaggcctgtgggcttaggattaaaacttcctagtctgaaatcaagctctaccagctcccaagtgtgtgaccctggggacactattaacttctctgtttcttgagtttcctcaactgtaaaatggacataataatcacaccaacctcataagattgttatgggaattaaatgaactgatatatgcaaagtgcctaatagtatctgactgtatcctcaaacctagatattcagttttactattattattatacatattagctagacattattgttgttaggtagaattttagtaatagcaacaattttaaaaaacagatcctctgccctcaaggatttatgatgttatgtgacaacctcggccaatgtctgggggaggtgggggtaccatggtgatgagctgaggtcatgtgcttagccctagaatcatgggtgctgagatcatgtgctcagcaccaaggtcatggtgcagccatggcctctggggagaatcactatgactagggcaaggtgcatcctaattagggtctacacagatgctcatagaaaaagtgctccaaatcttgcctcatgctgggataggagacaagaaaatgctcccaagtggaaatccagaggaacaggagagatggactgagagggagaggagacatcacatagaaatacacctgtatagagcaggctgcacacaactgtgagtcctatgagcagagaaggtggcagggcctgtccaggtgagctgggacacagggctggggatatctgtctgaatgactctcatgaagagacctcagactctatgctctgcaggggaggagaagccccaccttgccatgatgtcccaggagggaagttgctgtgggaggaaggggccatgagactggggccatcttccattgtgaaagaggaagtggacacagttgccactgctaggaagttgctgacgtctgtgcttggggttcccagacctgggagccttggacagtactggagagaggttgactgacatagagcctgctctatgtcccagagactcttacctcatgccaggggtcccatgacccttcctaatttgagagttcagacctatagggttctgtagccaaggattgagcttgcagcttcagagaccataattccaggtgtggcacatttgagggcttgtggctacagaagcctttgggggtggaaccaaatctcctgggtgacccctacaagaagtctctcaaaccaacaccaactaacaagctgagcaaatcaaaaaacaacaactgctcttagatctgtcggagaaatgaggtcatagggcaaaattagagagacagcagggtgatatggagaattacaacttcctgaattagaaacctccatgggaaagagtgctggggtcagaaaacctgcaccatgaatggtgaattgctataagttcagtgaggaccagtctgagctaaaaactcaggaggacccagtcatgggaactcccacacttctgtgaattttacctacagcagcttgattggtcctcatagtgggtatgagagaaatattcagtagtgcttcctgaagaggaaggagaaaggggaccatttcaaattataccagagtgttctcatcatcttatgcttgttccatatcagaaatatacaagaagacaagcactgttccaactatccttgctatgttttacaaagaaataataatttaatcctcaatgtttctaatcctttgaattaccataaactaaatatttttcccttctgtccacatttgcaactgataatattatattttctaatattttgacaaaaattatgaggaccacagagtagtcattatattcccctttggatgtagagttgctttccagggtttcagtattttcacagtcgtttttgtaatcttgcactaccatgcaaagtgaggactgccctgtatttagtataatatatgtagtaatataatacagtgctaaggagaaaagctaatcaaattaagagacattggaatgctagggtggagaggaaaatggatattttacatagggaggtttacataagttgcctttaataaactgaaggacagaagagtgagccacgcagctgttgcggggaagaagccgaggaatgacaggatttgacttttccaaaaaataactgaggctggaaaaatgcaatccatcagaggctctataagcggtccaggaggagatgatgctagctgggaccatggaggagtggtggaggtgagagatgtgcaggttatgagtacaactcctttgtgtgccggagcaggcttggactggctcaggagaaccaactgttaaattttcaggaattgtgtattctagttgttaaagtgttagaagcttgaaatgggccatgttggggatattcaccccatagaaattgacaaacactacaattcagccttctgttttctttcaaacatttaccatctatctcaccaggggacataagcattttgaagcagaactgaatatgagatataaacaaagaagaaatcaagaaggacttcacagctttagggctgtcacagtatttttaccatgagcaacagagttgggaaggttgcaggatgatagaaaaactagtgtttccatcacagagagaggagggagagatgctttctttctaggtgtgaggagtaggacactgtcttagtccatgtatgttgctataaaagaatacatgaggctgggtaatttataaagagaggtttatttggcttttggttctgcagactgtacaagaagcatggtacttgcatctgctgctgagggcctcagagtgcttctgctcacagtggacagtgaagtggagttggcataacatggggagagaggaagagaaaaagagaagagggagctgctaggcacttttaaacaatcagatcttgtgggtgctaatagaccaagataacaccaagtcattcatgatgaatccatccccatgacccaaacacctcccacctgaccccacctccaacataggggatgaaatttcacattgagatttgtagggaaaaaatatccaaattatatcatacgtataaacaaagaggaaggataatcatttttctccttaaaaccaggatgagtgttaatttgtattcaggaggcaatagagaatctcaacaaggctgggtaattgggtaggcaggaatccagaaggcagaataactcttgagaatctggactgcagtttgtggcttacggagagtccaagacgatggaggagaggtgtcctgatgtgtttagatttggcgtgtttcccacatcctagggaggtgtcatgagtcactccccagagccccatcccatggcctctgctcaggaccatgaatgaagactgctctggagaatcaaggactctgcaaaggagcaacaggagcctgtgggcaggaagatgtcctgggaggggaggtgtttggagctcagtctggggaagcttctcaccagccccttctctcagtcagagccattcaaggaaggaagtaggcaggagagactgggggttccatgtggcaggggaggagggaaggagctgtgggtaacatgtccatatttaatcatctgctcatcatttaagaaacatttcctgggaggctgttgtattcctggtgctggtctccttctgggatgcctgttgcaagtggagaggcagccctgagataggactctgctggctcagccctcctcctgagtcttgatgcctctctcctcattgcttccactcaggcacacagagggtcagaatgggtacagccctaagagctgcccatctgtggtttctcaacatgacttgacagtgaggattcttttgggcccatggagatcagcatcaaataatctagagatggcctgcaagggaccacccactcagtagcccctgatgcatgctcctcttctcacctcctcatgcgaccccttgggtgctgtaaaaacctttaaacaccctggctatagctcacctcctcaagcactcacacacttcctggggttgggagactcttagagtcctgactcttagagaccctgagagtcctgaggatgctgagggagctctgtcaccttctctaaactccactgaccctgatgctgcatgatatgtgggctgggccctcctcctggccctgcccttttggagcagcccttggtcaggcatccatcccccacacttacagtcaggccttctgcttccagtagacatagatgacagagacaccaaccaccagcagcaccttggggcccaggaggaaagctatgagaagtggagcagcagaagccagtgctgggcctggaaatcaggagacaggagaagttaggaaggggctacccaggatgccatcccagaggcccccacttaccccacctgaggctacctgggaccatcaatgctccaaagcttttgaaactgcatcttaccctggctaccctagctccaacccaaggcagaagccagggaaagaggttcctcattcccttaccctgtcccaggctgccaggttgtcctcccggagggacgaagtggagagaatgtgtactcatgcattcatgtgtggcacctgagtccctcacttgatcctcacaagcctgtagggcagggattattattccattctgatggggaaattgaggctcagagaatttagggagggtcacaaggttgctcgcatccaaacttagggaagcccatcattatgtcccttaggatgattcctgagactgcgtccttttgaacaagacaagtccaatttcccagggtcataggaagaattacaaaagggaaagtaggtgtcatgagtataactgagtacccccagtttgctaaaaaacagtttattttctttgttttctttcccctttccccctgctcccagtttcctacttagcccttcagaaatgcaaatataacctttcacctccccctcaccagacattccctgcagggcaagttcttctgtatactccaagacagatctctcctggagagctggcacaccaaagcatacccaccatagaaacttcacctccaggggtagcctccagactttcatccaccaggagggcatatggaaagcatgcccccttggccacgtttgcaacttacttctgctcaggatgacgccacctcaactgtcaggtagctaagtcaccaggctagtagagggacccctgcccttgttcccatccccattaccttataaaagtgtctgctttcttctccaaaggggaagcagcacatttgaaagcaggacacgttgtgtcccttccccaacctagctttggaataaattcacttttttttgtatcagacctcgcgctccttgattggattctacatgcagcaagcaactaacatgctttttggttatatgaagatggcttcagagtgagagagttgcaggctgctctgtttagccccagtggtgagggttgaccccatgttcttgagagctggggaggcccttgaggggctgggcctaatgtactgtggtggatagaaaacaccctggcatgactgtcatgcttgggagggactcagacatcaagctcacatcaaccccagagcaggtgccatctgaaatctctctgttggacacacagtcagatctggggaagcacacatttggattctttgcatttttacaatgagcatttttttgctgttaaaagcaaacaaatgaagatatgtttacttctgttttcatgtacgttttctgggaaataaaatggtgctgatgggtccttaaggaaggaatggagatctcagcatatgtggctggaaggttggaggccggcagttctcagctggggggctctctaggactttgtctcccctgaggagagctgcactctccaagtgcactcctccttctagggggcagcccatagaaagattggctgaattgaaaataggaaggccacgcctctctactcaattagcagaactctaagggactctctcagcccttggcttctctgcagaatcagctgggtctttgtcctgcctgcactgtggctcagcacgtccctctcctacacttctgcctcactccctcaggcatattgaccctgacagcactctagcatgcttcctgaactcctgtatccacctccagttggcctcctagcaaaattgacagtggaaatggtctgaaaagcagactctaaaatgcaagtttggaaactgaccactcatcaagatcagctggcaatgaggaccccagggctggtagtgaatggagctgggcaggccctggcttgcagctatggtgcaattaataaaactttcactgtcagtgaagcgggaaggaaattccttggcatcaggcatttgaaaccggattgggaaatgatagttatgaggactaacgtgtttgatggctgttgctgggcatcaattctttggggaaagacgatgagaagctaagagtaacttatcatgaattaaggctcggtgtaaaaaccagaggacttcttggcagcagtgtagattgttatctcctggagccagagggcagaaagaatagaagattgggttccagaacattataagagtagcagaaccacagagatggatgaatctcagcttcaatgggctgctatgctgggctagggccctgatggggaagttgtgggaccctgagatgtgggagggaatgtttgggtcaaagcacttacagatcatcagccatcttctgagtttctggggacagttgcagcagcataactaattatctctataactaacctccccaaaccaaaagaagaaacaaaaaaggaaaagtaaattttgcacaaacctgactctgagtatcacttggacaaagaatgccaaactgcaaaatgactgtgggtcaaaagagaaccttcaccacaccctagtgcacaatctcactaggctgccacgctgctggtgcagtatgtcacataaggcatcttgcatgttgtgtaccagcctagacaacctaaaacgcatttcctgccatagcacatgagcaaggatgctacatccagcacactgaaagcacccaaaaatggcagccctggtcggagctctagtgagtggatggaagtctaaaaagcaaattcagcttcagatagatggtgcagattcatctcttccggctcctccttgagaagtacaactaagaactctggaaatatgaggagcaggcataggagaacttccaaggtgaaaaaggaaggcagactggctagggatctgaggactgaggaacagccgtgaggccaggcacctgggacccacccccacaatatgagctcccagccatagaacatgacaaaaaaaatgacacagaaaagagaaaaagtctgtattcaataatataaatccccacttcaagaaactacaagaagtagagcaaaataaacccgaagcaagctgcagataggaattaataaaaaagagaagagagcagaaaattaatgaaattaaaatataaaaaacaatgcaaaaaccaactgaagcagctgatcctttgaaaggatcaataaaatgggaaaaaattatagcaagtctgatgatgaagaaaaaagaaatggcacattttaaatatcaggatgaagcgagggctatcactacagaccctgcagacatcaaaaggatcataagggatattatgaacaactctacacacagaaatatgacgacatagataaaatggaccaaaaactctttgaaaagcacaagttgccagatctcacccaatatgaaatgaataatgtgaatagccctaaactattgaggaaagtgaattcataattttaaagtaccccaaaatattcttgaggtacagatatttcatagaaaaatactaccaaacatttacagataaattaataccaaatctggtgcacagaaaaacgtttacaaaagaaatttggggaaatttgaatgtatgctccattttaggtgatgtgagataattattttaacaattttatgaaatttaatggtataaaattttaaattttatgaagtttataatgatattgtttttgtaaaaaatgtcctctattatcagatcacccaattgcggactcctcttgcaactgcgtgggcgcataactgggtgagcagtggatgtgacgatgcactttccatacatctctgattataggggacattgttgtcctccacttcctgtcttcactcttccagcagacaaatcagcgacccagcactgacccagtagataaagccaacgccgtagagtctgtggctgggccttctaaaagtcttctggaatagacacccctcctggtattatatgagagggaaataagatatattttggtcatagatgggggaacactggccaaattgacatccttgggacgatgcccagcagaaagagacgtttctcaaattagcataaatttgcattataggctggtagtgaccctgtcctcaggacctcagacttaccttaattagtttgggccagtcatctggtctaatgccttgatctaattgtcttcaacaatatcccccattgcttcccaagtcctggtttccccttctgtaaaactccagactcactggatggttgaagcaggaaaggagatcatagatgaacagaaacttgcacataataaatctgcagagagccattgtgattattattggtcaaatatcaccatcgggacccaaaggaggcccttgctttgaccactcatggtcacctgggggcgtggtccaggcttaaactccacatgtctttctgaaattcacacagcagatgcaggagtctgcagggggcaggtcacagatatgaatggaaaagtttaggaaggaacagacaaggcagaggtcagaaggagtaggaaggagacagggtggctgatgagaaacgggaatgtaacaactgtcaggggtaaaaagcaagatgcagaacgtgaggaacacatgatccccttgcctcctttcttcctcattcagcacacatttatgtcaaaaaatctgtcaggttgtacctcaaacttttaatagtgatgactcttggagggtgagatttgggagaatgatgctgactttaaaattctactttatacttatagacttctagcttattttatgacaaacataaataattttaacatgaaagaaaaagataaaatttaaaaatttgaagtaaccttaccaggagcagtatttgagccctgctccttcgggtgggctgagaccttcaggtcatggcttttgctgaccgctggctgcccgtcatgctccacctggcaggtgagcttcacatcatccctgtgggcagatacattcaccaggagccagctcatccagttgtaggtaccatccttgttttctgtaagggttgaggccgtttctgtcctggacacgtttccattctccaaccaggtcagctgtagtctctgggggtagaacttcctcacctggcaggtgacattcacctggttctctgccctcacgggctgttgagtaacctccaaggtgggtggaactgaaacagcacagggcagaagctctgaccttgtggcacagacagatccagggagggctccataacgtagctcccccaccacggtgagggcatcaccaggacagtgctaggcatgcagcaggtgctcagacattgagggtgctctttgcatatgaatgaaattactaagcacaacgcccagcacacagtaggtgctcaaggactggtagctcctactaggctaagaatgagggaaatctataagcaccacccctggcatgcagttggaatgctgtaactgtagcaaaataaagaaaatcaccaagcacatagaggcttagctcatagtaggtactcattaactgtgtttgctatcagtgaaataaatgaaacggctagcacagtccttggcacctggtgggtggtgtggtcacccagccactgccattaaaatgttagtaagtggctggcacatctaggggcatgggaggtgggcagttaggaatttaggttccaggcatttcaagccctggagcaagagtagagctggatgagtggagggtggtggggggtgggcttggtggtcaggtgtgggcttgggctgggtgagggtcctctacctcggatggtctcagacaagttggcagtcccacgaagagggtccccctgcaaggtgacgtgggccacctcgcagatgacttgagagtgaacgtcctcgcgggtcagcaccaccttggctgtgctgtggatgctgtaggacacactgtctcctgcggggtccacgttggtctggaagtctgagagctcattcccatttttgaaccatttcagggtgatgtctctgggtgagaagccgtgggactcgcaggtgaagctcactgtgtgctgaggtgtggccctcgccgcagggcccgataccacgggggcagagggtttggctacaaaaggaccatcgataatcaggagacatgactcagatgacaatcactaacgataagtgtgtgagatgttaagaaccttctgagacattattttttatccttccaataatgtggaaagattaatgagggtggtgtccttattgtcattttacagagcaggatgcaaaggttgggagaggtgaggacccatgtgaggtgagacagtgtaggggcagggcccagagggaagtccaggcctgagttcaaagtcctctccacacagggagacttccaccaatctgggcataggaacaaaattactgattggtctccctccatgttattaactggtcctagctgtcctcccccggaaggctcactaacctcagagagggcatttatagaagccaatacagggatcaatggcaaagtggcaccaccgtgagagctgcaaccaggctgctcagcccaggacaggggtgggctgacacccccagctcctcatccgcaaaacaggaggacggaggacggcgtttctacttcctgggatgtcgccaggattcaatggggcaatggaagcagttttgctctggatcaaacacagaagatgcttccccgaaaaaacacagatctatctttaacccagactttacagatacacagaggtctctctttaggtattataaaaatatgaaacattccgtatttttcttttcacaaatatttcgttctgtcaaataaaaggcattaattaaggataaagctttaacgtagagccaagagtttgtaagagcattggaatcacacctgctagaggtcaagccacaggatgttgcagtagatagacctggataacaactgaagccagggtccgtgggattttgatctctttcacctggagtactttaatgaaataaccaatgagagtgggtttgcagttgaggattttcaaccagctaatgaactgtttccaaaaacaacctttagtgaaaatcccctataaaaaaccggtcctgtattgccatacgggacactattcagggtttcactgactcagtgtacccaaattgcacctctttatctttcagataaatgctatttcctttggccttcctaacaatcattttgctgttgttgttagttgttctaatctgctggaagtcctaaatttgaaaagaggaaatttttgggaatctgaatcttcagttaggacaggtttgggtgaaaaacaaggatcactgagtactaagaaagccaaaggtggttagctttttcatcgttaattaattacaagagacaaagacccaggccacaccaacagacagaaacctattctgggccttgaaagcaaacacattggagaatcagaacaacgagtgcagtttctccatgtagatgaattttaagggtgtctgcaaattgctaattgttaccttgaaccttctgccgtcctcttagaaagcacatattatacgtttgactttgccaatattaacttgctccctgatatgcgtgaaataatgtgagagcacagtaaggagggtgtcacttgaagatgtcaagtctttgagacaccagcagcatgggtgtccctagaaggctgagaggctgtcttcagttccgattttttgagggcttcttggcagcctgatgctggctgctctctctgtacctctcaacacttcaatcctccctctatttgtcagagggggtcctcatgtgagcccttgtgtagggcgagactctgagaggatccttggtggccaagggccaaaagtagatagaaaccccaccctgggaagatgagtgagggtaagtgcaagggcatagcctggcatgtagtaggtgcttaataaatagcccctgtgactgtaatcatgaggtttggtcattactgcttctggagctgcatagctattctttaggcaacagaacaaagaggcacacaaacaccaaggaaaggctcaaaccctactcaccgcagctgccagaaaaaacccaaatgataaaaggagcagcaaccaccatgtttggcgaactggctttcaagtaagatcacaggggaagctggaagcattttggaagaaggagggaaaagatacctcagtgacatctgggagtgctgagggagggaggcttctggggctgaggagtgaggatttgctgggactccagcacgtgtttagatacaaatgttttcaagacagaaggttccccagccctgaggctgcatctgagccaggctttgtcccagtctcctatcttgggccctgaggccagtagcatgggaggggtcctgttcaggcttctggggcctcccagaatgtttccagaatggctgttttgaagcacccatgacccaaaaagctgttctcaaagccccaaaacctggggcaccgcttttgctagggggctgtgtatgagaatcttctggagccattaagaactttagatatccaggcccaaattagatgcaattaaattggcattttaggggggttcctgggtccagctttgcaaactttttttttgatagttttcccaatgattctaatgagcagccaaggttgaaagccactggactccaacccaaaccccatttatacttggggcctacagaagccctgacctgtctgaggtcacacagcttcaccctaacacaactcacctttattgagcatttactgtgtgcttgttgatgccctaagcattttacacaatatcactccttcagactcggcccagtctgtgaggtcagtgttaccatcaaagggtgaggacatcgaggcctatggtggtgaagcaccttgtcccaggtcacagagccaggaagtggcagagccgggaagaggcccaggcagctgggatactgcctgtgttctcctaacgacagttctgcagaagctcagtaataacctgaatgacaccaccattaggggctctgtgcacatcctctccaatcctcacagaacccagaataggccatgataatcagcatctcaccgatggggaaaccgaggactcaagggaaggcaagactggcccaagatcacacgatcttgaaataacacctcactttgggggtgcctacagtgcgctaggtgatttacagagagaaccttacgcttacgactttcctaaaggagtccatgattgtctctattctacagatgaagatgccgtggctgaacaaaatgaaggcactgtctcccgattctccatgtgtcccagtgggcatttcctgtgtcccaccaagcacttatgtccattaacagagcaagtgttctaacttcttgagctccaacactgactgccacctcaattgtccctttgagattctagacttcatgcaatgttagggagaagcctccctcctgggtgcccaggcctggttaccctgcagccataagcaaaagacagtgggctcctgacagccggaggggagaatctcaactcttgctcacatgggccccaaacactctctaggaaatgcctcatctcctcatccttagtcctcagcaccatgaacgggcagatacgtgctctgctgggctgcaggaggctcgactctgctcattggacgctgctgagtgaagaggaaacaacacaacatgggggaagagtcctaaatgcctcatgtgtgttgagacctgtcctttaggaaccggcttggcatatcatgagacacgcgcagggcctttctgatgggagtgtgaagacaggccctcctacccctacagggttcttgttttgtttttaatgctttttgctgtagaactgaacaatgcaagagtttagaaagagaaggttggagcatttctccactcttgaaaaaccacagttgagtgtcacaaagacaaaggctgtgagtcaggctgcggggttccagccttggctccctgacctgctcccaagtcaggtctcctctctgagcttcagtgtcctcatctttaaaggaggtagcaaatggcttctccctcatagcactggttataaggagactctggcacagttgctgctctctggcccccttccccacctccctcctttctcatgtagctcatcatttaggccgagagcatggcaaagaggagtgagtacttcactaggagtgagcagatctgagtcacacctgagccaccactggctgtgactgcctgggctggggaggcaccacctgggcatttcagtgtctttgccaatattatctgcacaatcaggaaaaagccaccttccttgtctaagttcaagggttgtggggagctgatttcagtcattactgggcaatgtacattttcatatacatacatgtacatgaaagcatcatgttttacgctttacatatacacatttttttaaaaagctgttagtaaagctatgtgtcttctggagattccgttttttgcctttccaaattccagaggctgcccacattcctttctcacagttacatcttcccatcactctaacctcttgcttgcaccctcacaaatccttctctaagaattaatctccttcctccttcttgtaaggacctttcttatgtattgtgtccaccccgatgctagaggcagatgttaaaaccactgtattaaaaatgtttgaagtggggctgggcacggtggcttatgcctgtaatctgagcactctgggaggctaaagtgggtggatcacctgaggttgagagtttgagaccagcctgagcaacaaggagaaaccctgtctctacaaaatacaaaattagccaggcgtggtggcctatgcctgtaatctctgattgctacatcatctaggagggaaatcaggcaatattctcaaatatgaaaacacactatcctgtgacctaggaacgccacttccagtgggtgtctcccgcctgagtagggtgacacatgtacaaggtcatccattgcatgattgctttagtagctaaggttgggaataacttacatatccatcaacagaagactgtaaaataaattttgatatttccatagattggagtatttttcagctgtaaacacactggagcagctctctatgtcctgacgtggaatctcgatatggaatgacagggcttacatttgggagaagttttccaatcacaaacaagctttagtatctgaatgtgaggtgcattcttaacatttgggaaactgatgaaaagagaaatgctggctctctgacacctggctctgtttgaggagcttttatctagcacctatgatgcaccaggctcttctatggagacagcgtctaacgctggggaaggaaggagactgccacgattcagatatggactctggctccaattctgccactaactggccctgtgaccatggacaaggcccctgtcatgtcttggcttcagtctcccatctgtaaagggggttgggctggatggtctgaaggtccttcctgtgctgacattccataattcaggacttaggacgaagctcttgggcctctgggaggaaaccccagataagcattgttgcagccttatatgggaaacccctaagtcacccacttgtgggacctctttcctgaggtgagggacattctgagatgatgcagctctgctcggagcccatggtaactgtgtgactcagtccccaaatcgcagaagggtttcccaaatagacccacagcaaatgccaaacgtattggcatctcctcccaccaggccatcagattcaacagtgaatgtgcctcccagaaatcttgcccgtggggtgtttctgaggatgaaataaagaaaaacacaatttaccctcttcatgagctggacagatttctcctcattagaagggaagagaatgtaagcttggtggggaagagctttgggctgtttcattcactgctgtttgcacagcatctagggcagagcctggcacacagtggggtctcagtgagtgcctgctgcataaagaagagacttggccaccctgagggggaagcgttctctggaggcagaaggcaaggtccagccctgtgcctgggcaagtcactcaaattgtcagttccctcatctgtggaaccaaagggctggatcagctttggaaacacaagagctgtagagccgcaagctggggatgccttctgtcccatcatttccaagccgtggagcctcgagcgactgccatgacatctccaagcctcaactcatgtgatctggagaaggggtgacatcagttcatgaaagggtggctgctcagccaccaccacacctgactgttgctctaagaatggataatgtaattattgagttattgtcacacactaggggatgaaggaagcccacgctgtactcaccacgcacagacagctcggtgcctgctccagacttaaactccacgtggtcggggctccctttccggaacttcacacagtagtaggtgccggcatctgctggggtgatgttactgatgcggatggaaaagtccatgttgtttctctttgtgaggtctgaaacagttgttacccgtgggaagtggccttctttctgattgtagattaattcccggcctggtccagctcctctgaaccactggatgggccccacagggatcagggaagtcacagtgcagtgcagagtggccgactctccagctgcaactgatatggacttgtcaggctgaatcacctgcagctcttcctcgccagctacccctggaaaggagcacaaagcagtcattttttcatccttacgtgatcctctgtgtttcctcaagtgtttatcaatggctttcattgaccgggtgcacaccaggaaaaggccttgagctcagcacactacacgtattatctcatttaaccctcacaactggcctgtgacataagactgtaatacaagcgaggacactgaggcacagagaggttcaatttctgtttccttactttcttttgttctttctgtttgctttttttcttttcttttctttttgtttttctttttcttttttttaagacagggtcttgctctgtctgctgcccaggccggagtgcagtggtacaatcacagctcactctagcctcaacctcccaggctcaagtgatcctttctccttggcctcccaagtagctgggaccacaggtgcgttccaccatacctggccaatttttgtgttttttgtagacacacagtttcaccatgttgcccagactggtgtctacctcttgggctcaagcaatgcatctgccttggccttccaaactgctgggattacagacgtgagccaccatgcctggccaagaggttcaatttcaatgtagagctttgggttgaggacctgagtagaactcttgagccctccttggaagtgccatgttttgctaaatatgtgcctccactctgtggctacatggagtgttgcactttttgcatcaatggattgggtggggccgtgtgacttctttagacccttgagttacgagcagaagtgatgggtataatttgtgggctgtgcatgtaactgcaagagcctctgtggatcaatttctcccttcctgagacccacaaggctctaatggggcctgctccattgcctggatgcgtgaatgaccgttgcatgcagaactgccaatccacactgaatatgtagcttccagtagaaatacaacattgttttaagccccttgtaatatttcacccatagcataaacacattacataagtttcctaatgctgatgtgacaaattaccaaaacttagtgtcttaaaacaaatgtaacattttatagttctgggggttagaagtccaaaatagtgttactggggtacaatgaagaagaaatgaagaacgtcaaatacacaaagatagagaataaaacagtggtgactaggggtgaacttaggggaggtgatggggaggtcaaaaggtataaaattgcagtaagtctgacgaagaagtccagagattgaatgtgcaatctgaggattctagttaataatgttgtattgaattctgtatttttgcttaaaaagcacattttaggtgctgttgacatacaacacatgcagcataactatgggagatgatggatgtgtccatttgcttaactttaataatcatttcactacgtatatgtatatgtgtacgtatatgaaagcatcatgttttacaccttcaatttccacaatttttaaagagctttcagcagagctatgtgtcttctggaggctctgttttttgccttttcaaattctagagttttctcacattcctttctcacagttacatcttcccaccactctaacctcttgcatcttcacatgcaaacatcctggaatacagggatgtttcaacgtcattctccaagaattaatctccttcctccttcttataagcacacttgtgatgtattagctccaccctgatactagacccagatattaaaatcactgccttaaaaatgctgagaggtaaaggaaataacggaccaagaactaaaggaatataaatgtcttaacaaaatgagaatgtaaagaaagagaaattataggaagaaatcaaacagaaacttaggaattgaaagtacaataactaaaagttcactagaggggtcccccagtgggtataagcaggtggaagaataatcagaaaactggaagatggtataattgaaattattgagactgaggtattggtggaaaatagaataaagtatagagcacagaatctaagggaattgtgagacgttatcaaatgtatcaacatacaccttactggagttccagggggaaaaaagagaaagagagaaaggaatagaagattatttgaagacatagtggacaaaaaccttcacagactagataaaatacaggaatctacctattaagacacagaagaaatgcaagttgaactcaaaaataaactcagagacccacactaagacacattataacccaactgttgaaaactaaagtcaaagagagaatccttaaagcagcaagacagaagtgattccttacataaaagagaccctcaataagattttcagctcagctcttatacaaagcactgaaggccagaagatagagggatggtaagttcaaaatgttgaaagaggaaaaatatgtcaatcatgaattctatacctggcaaagtgtccttcaaatacaagggagaaattacgatattctcagataaacaaaagctaacagagttcatgaccattaaaccttgcctacaagaaatgctaaagggagtgcttcaggtggaaatgaaaggatgctacatggcaactcaaagttgtatgaagaaataaagatatccagttatgtgtacatgttttaaaaatcatgcttcaatatcccacaaacaagctgtgagcaccctgcccaggtgaccaggtaaccagtattttaaagctggtccctgccacaattcctcttcttgtcctcctctactgtgacctagtgacattgaaacaccctagtaaaacccatcatggtttttgcttgtgtcctccaccttgactcccagtaaaggcacttgcccagggatcccatctctcttgcctacccatctgcttgattgagcctgctccttgggagctcctcccacatggcttcctgcatggcctgccctacttccttctctaggaactgtgagtatgcctcttcatatgaacttttcatggccatgttagagtgatcctcaaaattcaaccagcaggaatcactctaacattttcaatagtaatggcaatgaggatgggatcattctaaactcaggtggaaagttcctagggaatgcctttgactcatgacttactgatttgctactctgattggctccacaatttgagaaggcttttcaccctgatgactttcttgtgctatgctatgtacagctttgtgttgccttttggagtgctgccatggctctccatcctgaagcgaggatcctgttccaatatcaataatgacatctgcctttcttcaagagcacaagatgatataacattggtaacacctcttcaaagaagattcatgtgatatgcatattaatgtcacataatccagcatcagtaagttttttctggggtgcttgtggcaacatattcttcatttacaaattttacttacaaattaaaatcaacaggccctcctgttagtgtctttaaatgaattaacaaataaaagtatctcttctctgtagagactttggctgtgtctttcatgcctcttggagtctctaaaccactcatgatggccagacattttccccagggcctttgatgcaaatataatgcccctctcagcttttgctatactccattacaacaagaaatttctggttatctattgggctctcctggcttagagtccagatctggggagcatactttcctgtcgtactctttaaccataaattgtcccaaagccagactctgcttatctgaaatggagcccactggaatctaaacttccatgaaaatacaaaactaagatcactgccaggtagagctgcacacctttctgttaacagttggcattattattactcggtttgttgatgcaataatcctcaaccaaacactagctgagttcagcagcatattagaaggaatatacacaatgagcaagtggtatttattcctggaacacaagaatgtttcaatatacaaatgacaaagaatgtaatacaccatatttatagaagaaagagaagaaacacatgattatctcatttgatgcaaaacagcatttgagaaatgtggacatctttttgtgaaaataccatcaataataggaatatatgaaaatttctataagataaaagttatatacacataccttattttattttcccttatcagtggctaatttatgattttatttacctatttatcatgtatattgattactgtcattattatgactttattgaaaaaagaaatcagtaaggtaatcgcatttacaattactaccaaaaaagctaaaatagctagaaacagatttactcaaggacatgaaagacctccacaaaaaaagctataacaccctgatgaaaaataaatagaacaaaaataatggaaagatatccatgcttgtggattagataattacttttgttaaaaatatacatactacccaaagagatctacagattcaattcattattagtaatatttcaatgacattttcctcagaaatggacaaaacaatcctcaagttcacattagtcatagaaaattgtgagtagaaaaggcaatcttgagcaaaaagactggaggcatcacattgcctgatttcaaacttgactaccgtgccatagtaatcaaaacagcatggcactggcataaaaatagacacatagacaaatggatcagaccagagagcccagatataaacgcacacatttacactcaattgacctttgacaaaaatgtcaagcagacacaattgggaaaggtcagtctcttcaaaaagtggcattgggaaacctggatatccatctgtagaggaataaaattagaccttcctctcacatgacacacaaaaatcaattcaaaatgtattaaagacttaagtgtaggatctaaaagtgtaaaagtactggaagaaaagtgccatgacattggtgtgggcaatgaattttcagatatgagtcccaaagcacaggcaacaaaagaaaaatagacaaacggcattacaacaaactaaaaagcttctacacagccaaggaaacaatcaacagagtgaaaagacaaccagcagaatggaagaagatatttgctagccatgcatctaatgaaaagtcaatatacaaaatatataaggaagtgaaacaactcaatattaagaaaacaacccaactaaaatatgggccaaagatcttaaaacccatttctcaaaagaagacattaaaatggccatcagacctataaaaatactcagccttactattcatctggtaaatgcaaattaaaaccacagtgagctatcatctcacacttgttagaatggctactataaaaaagatgataactagttttggagaggatgtggagaaaagggaattcttgcacatagttagtgggaatgtaaattagtagagccattagcaaaaacagtatggaggctcctcaaaaaattaaaaatagaactatcatatgatctggcaatctcactattgggcatacatccaaaggaaatgacataagcatgtcacagagatatctgtgctcccatgtccattgcagcattatttacaatagccaggatattaaattaacctagatgtccatcagcagataaatggagaaaggaaattggtatacacaatggaattctaatcagcctgaccaaagaaggaaatcctatcatttccaacaatataaatgatcctggaagatattatgctaagtaaaataagccaggcacagaaagacaatactgcataatgtctctcatatgtggaattttaaaaagttgaactcatagaagtagatagtagaatattggttaccaggcactaggcagggggtgcatttggagagatattggtcaaaggatacaaaatttcagtttagttaggagaaattagttccacaaatctattgtacaatatggggtctagagttcataacacaattcgtaacctcaaaaattgttgaaagcagattttgagagatctcaccacagaaatgatacatatacaaggtaggtcatatgttaattagctcaaattaggcattctgcaatgtacacatatttcattaatatggtatacatgataagtatatacagttctgtcaaataaaaataaaatattttgttaaaagtttcattgaaattagaaacttggagaaacaatgataaaaaatgaaatctcctgtgtgtgcatgtacacttacttatatgcatacatgcatatacatatgtatacacacatatgtatacacacatttgcaaatatatatacacacacatatatgtatatatacacacacacacatatatatgtatatatagacacacacatatacattcacaaatatatatcaaagtgtgacctattgtgatagtatataagtttgttttgtgtattaaataaaattacaacacacgttaaaatctcattaaaatatctggcccatagaaagtaaaatatgtggcccatagaaagcatccaacacattaataacaaatttagaagtacatacatcacagttgtaactctggttgttgctaacaagtgtggtaggcaataattaattctatgtttacttccctgcattttctaatatttctgctagtagcataacacgactaaaagaatgaactttggagccggtcgacctggacttgaatctcagctgctccactgactgaggtaggggacaatgaatggacaagttcctccctctgcctgagtctttgtttggaaataggggataatagttgcagctttcacacagggatgttgtgaggattagtggagctaaaacaggcaaaatgctaataactgtgtctacatggtaggaagagctcaattgttaaactcttactgctgtcatttgggtacagtgtatgtgtgagaaaaataatttgaaaagtgagacccctgccctctagggcctgtgaggtgacatcacagcagggcccagtggggaattgagaggctgctgtgcccagccctgtggttctggggtcagctccatggcctgagaagggatcaggacaggtaacttgtctgggagctgtgagcagggttctcccaggctgcaccaggaaaggccctccaatcctgcctgtcttgggaaggggaaagaaattatccatgggaaatttaagagaaccaaaggaggttgtagtacctgttatgggctgaatgtgtcccacaaaatgcatgtgttgaagctctaatccccagcacctctgaacgttacagtttgggagacagggtctttaagaagtaatttagttaaatgaggtcattggggtgggccttaatacaacaagactgatattctcataagaagaggagatgaggacacagacacacacagaggaagatcatgtgtttaagacacagagagaaaatggccctgtataagccaaggagagagacttcagtagaaactaaccctgctgacaccttgatcttggacttcagcctccttaactgcaaggaagtaaatatctgtagtttcagccacccagcctgcagttctttgttatggaagccctaggaaaggaatataggacccagtaagcagcaaatgtggaacttcttaaagaggaagaggccacagagaaatgggtggtaagaatcaggtcacaggggagggaggagcatgggggaacagaggacaaagtgaggagcacccttagggaggatggtggctgaacactcccaggatacaccacaccactgccctactcaagtgagcactattacagacttcacatcctcagtttggtgaagagagagggctgggcctagagccacataaccctgttagggtgtctctgagcttactctgtggacttgggcatgtcacttggccctagggcctcaggactggtgaggatttagataatgattcttctctgctttttcaattgaaatattatcaaaatgtaagtaattgttgttgtggtggttgaatcgtcctgtggttcaatgcctctggtagccagctgcagatccacagagaaagtgctcagctccctgattttctgctctcagtcaaagcctaatccttggcctttcttggcagcacttgtcattgtccggaatccctgaaagtccagggacaggccatggctcagtgggcaggaaaaaagattttaaccgaaggcagtgctcacctgtgagtctccccagcagtagcgtcatcagcaggaaaggactaggaaggtggggccaggaggctggcacgggcattctggagaccttaggagcctgctctgtccaaacgtctgtgctgggaagatcgcagactctgctctgaggagagaagacaagccctgcctcccttagttc

SEQ ID NO: 1409 - DNA, 22704 bp, Homo sapiens
taatttataaagagaggtttatttggcttttggttctgcagactgtacaagaagcatggtacttgcatctgctgctgagggcctcagagtgcttctgctcacagtggacagtgaagtggagttggcataacatggggagagaggaagagaaaaagagaagagggagctgctaggcacttttaaacaatcagatcttgtgggtgctaatagaccaagataacaccaagtcattcatgatgaatccatccccatgacccaaacacctcccacctgaccccacctccaacataggggatgaaatttcacattgagatttgtagggaaaaaatatccaaattatatcatacgtataaacaaagaggaaggataatcatttttctccttaaaaccaggatgagtgttaatttgtattcaggaggcaatagagaatctcaacaaggctgggtaattgggtaggcaggaatccagaaggcagaataactcttgagaatctggactgcagtttgtggcttacggagagtccaagacgatggaggagaggtgtcctgatgtgtttagatttggcgtgtttcccacatcctagggaggtgtcatgagtcactccccagagccccatcccatggcctctgctcaggaccatgaatgaagactgctctggagaatcaaggactctgcaaaggagcaacaggagcctgtgggcaggaagatgtcctgggaggggaggtgtttggagctcagtctggggaagcttctcaccagccccttctctcagtcagagccattcaaggaaggaagtaggcaggagagactgggggttccatgtggcaggggaggagggaaggagctgtgggtaacatgtccatatttaatcatctgctcatcatttaagaaacatttcctgggaggctgttgtattcctggtgctggtctccttctgggatgcctgttgcaagtggagaggcagccctgagataggactctgctggctcagccctcctcctgagtcttgatgcctctctcctcattgcttccactcaggcacacagagggtcagaatgggtacagccctaagagctgcccatctgtggtttctcaacatgacttgacagtgaggattcttttgggcccatggagatcagcatcaaataatctagagatggcctgcaagggaccacccactcagtagcccctgatgcatgctcctcttctcacctcctcatgcgaccccttgggtgctgtaaaaacctttaaacaccctggctatagctcacctcctcaagcactcacacacttcctggggttgggagactcttagagtcctgactcttagagaccctgagagtcctgaggatgctgagggagctctgtcaccttctctaaactccactgaccctgatgctgcatgatatgtgggctgggccctcctcctggccctgcccttttggagcagcccttggtcaggcatccatcccccacacttacagtcaggccttctgcttccagtagacatagatgacagagacaccaaccaccagcagcaccttggggcccaggaggaaagctatgagaagtggagcagcagaagccagtgctgggcctggaaatcaggagacaggagaagttaggaaggggctacccaggatgccatcccagaggcccccacttaccccacctgaggctacctgggaccatcaatgctccaaagcttttgaaactgcatcttaccctggctaccctagctccaacccaaggcagaagccagggaaagaggttcctcattcccttaccctgtcccaggctgccaggttgtcctcccggagggacgaagtggagagaatgtgtactcatgcattcatgtgtggcacctgagtccctcacttgatcctcacaagcctgtagggcagggattattattccattctgatggggaaattgaggctcagagaatttagggagggtcacaaggttgctcgcatccaaacttagggaagcccatcattatgtcccttaggatgattcctgagactgcgtccttttgaacaagacaagtccaatttcccagggtcataggaagaattacaaaagggaaagtaggtgtcatgagtataactgagtacccccagtttgctaaaaaacagtttattttctttgttttctttcccctttccccctgctcccagtttcctacttagcccttcagaaatgcaaatataacctttcacctccccctcaccagacattccctgcagggcaagttcttctgtatactccaagacagatctctcctggagagctggcacaccaaagcatacccaccatagaaacttcacctccaggggtagcctccagactttcatccaccaggagggcatatggaaagcatgcccccttggccacgtttgcaacttacttctgctcaggatgacgccacctcaactgtcaggtagctaagtcaccaggctagtagagggacccctgcccttgttcccatccccattaccttataaaagtgtctgctttcttctccaaaggggaagcagcacatttgaaagcaggacacgttgtgtcccttccccaacctagctttggaataaattcacttttttttgtatcagacctcgcgctccttgattggattctacatgcagcaagcaactaacatgctttttggttatatgaagatggcttcagagtgagagagttgcaggctgctctgtttagccccagtggtgagggttgaccccatgttcttgagagctggggaggcccttgaggggctgggcctaatgtactgtggtggatagaaaacaccctggcatgactgtcatgcttgggagggactcagacatcaagctcacatcaaccccagagcaggtgccatctgaaatctctctgttggacacacagtcagatctggggaagcacacatttggattctttgcatttttacaatgagcatttttttgctgttaaaagcaaacaaatgaagatatgtttacttctgttttcatgtacgttttctgggaaataaaatggtgctgatgggtccttaaggaaggaatggagatctcagcatatgtggctggaaggttggaggccggcagttctcagctggggggctctctaggactttgtctcccctgaggagagctgcactctccaagtgcactcctccttctagggggcagcccatagaaagattggctgaattgaaaataggaaggccacgcctctctactcaattagcagaactctaagggactctctcagcccttggcttctctgcagaatcagctgggtctttgtcctgcctgcactgtggctcagcacgtccctctcctacacttctgcctcactccctcaggcatattgaccctgacagcactctagcatgcttcctgaactcctgtatccacctccagttggcctcctagcaaaattgacagtggaaatggtctgaaaagcagactctaaaatgcaagtttggaaactgaccactcatcaagatcagctggcaatgaggaccccagggctggtagtgaatggagctgggcaggccctggcttgcagctatggtgcaattaataaaactttcactgtcagtgaagcgggaaggaaattccttggcatcaggcatttgaaaccggattgggaaatgatagttatgaggactaacgtgtttgatggctgttgctgggcatcaattctttggggaaagacgatgagaagctaagagtaacttatcatgaattaaggctcggtgtaaaaaccagaggacttcttggcagcagtgtagattgttatctcctggagccagagggcagaaagaatagaagattgggttccagaacattataagagtagcagaaccacagagatggatgaatctcagcttcaatgggctgctatgctgggctagggccctgatggggaagttgtgggaccctgagatgtgggagggaatgtttgggtcaaagcacttacagatcatcagccatcttctgagtttctggggacagttgcagcagcataactaattatctctataactaacctccccaaaccaaaagaagaaacaaaaaaggaaaagtaaattttgcacaaacctgactctgagtatcacttggacaaagaatgccaaactgcaaaatgactgtgggtcaaaagagaaccttcaccacaccctagtgcacaatctcactaggctgccacgctgctggtgcagtatgtcacataaggcatcttgcatgttgtgtaccagcctagacaacctaaaacgcatttcctgccatagcacatgagcaaggatgctacatccagcacactgaaagcacccaaaaatggcagccctggtcggagctctagtgagtggatggaagtctaaaaagcaaattcagcttcagatagatggtgcagattcatctcttccggctcctccttgagaagtacaactaagaactctggaaatatgaggagcaggcataggagaacttccaaggtgaaaaaggaaggcagactggctagggatctgaggactgaggaacagccgtgaggccaggcacctgggacccacccccacaatatgagctcccagccatagaacatgacaaaaaaaatgacacagaaaagagaaaaagtctgtattcaataatataaatccccacttcaagaaactacaagaagtagagcaaaataaacccgaagcaagctgcagataggaattaataaaaaagagaagagagcagaaaattaatgaaattaaaatataaaaaacaatgcaaaaaccaactgaagcagctgatcctttgaaaggatcaataaaatgggaaaaaattatagcaagtctgatgatgaagaaaaaagaaatggcacattttaaatatcaggatgaagcgagggctatcactacagaccctgcagacatcaaaaggatcataagggatattatgaacaactctacacacagaaatatgacgacatagataaaatggaccaaaaactctttgaaaagcacaagttgccagatctcacccaatatgaaatgaataatgtgaatagccctaaactattgaggaaagtgaattcataattttaaagtaccccaaaatattcttgaggtacagatatttcatagaaaaatactaccaaacatttacagataaattaataccaaatctggtgcacagaaaaacgtttacaaaagaaatttggggaaatttgaatgtatgctccattttaggtgatgtgagataattattttaacaattttatgaaatttaatggtataaaattttaaattttatgaagtttataatgatattgtttttgtaaaaaatgtcctctattatcagatcacccaattgcggactcctcttgcaactgcgtgggcgcataactgggtgagcagtggatgtgacgatgcactttccatacatctctgattataggggacattgttgtcctccacttcctgtcttcactcttccagcagacaaatcagcgacccagcactgacccagtagataaagccaacgccgtagagtctgtggctgggccttctaaaagtcttctggaatagacacccctcctggtattatatgagagggaaataagatatattttggtcatagatgggggaacactggccaaattgacatccttgggacgatgcccagcagaaagagacgtttctcaaattagcataaatttgcattataggctggtagtgaccctgtcctcaggacctcagacttaccttaattagtttgggccagtcatctggtctaatgccttgatctaattgtcttcaacaatatcccccattgcttcccaagtcctggtttccccttctgtaaaactccagactcactggatggttgaagcaggaaaggagatcatagatgaacagaaacttgcacataataaatctgcagagagccattgtgattattattggtcaaatatcaccatcgggacccaaaggaggcccttgctttgaccactcatggtcacctgggggcgtggtccaggcttaaactccacatgtctttctgaaattcacacagcagatgcaggagtctgcagggggcaggtcacagatatgaatggaaaagtttaggaaggaacagacaaggcagaggtcagaaggagtaggaaggagacagggtggctgatgagaaacgggaatgtaacaactgtcaggggtaaaaagcaagatgcagaacgtgaggaacacatgatccccttgcctcctttcttcctcattcagcacacatttatgtcaaaaaatctgtcaggttgtacctcaaacttttaatagtgatgactcttggagggtgagatttgggagaatgatgctgactttaaaattctactttatacttatagacttctagcttattttatgacaaacataaataattttaacatgaaagaaaaagataaaatttaaaaatttgaagtaaccttaccaggagcagtatttgagccctgctccttcgggtgggctgagaccttcaggtcatggcttttgctgaccgctggctgcccgtcatgctccacctggcaggtgagcttcacatcatccctgtgggcagatacattcaccaggagccagctcatccagttgtaggtaccatccttgttttctgtaagggttgaggccgtttctgtcctggacacgtttccattctccaaccaggtcagctgtagtctctgggggtagaacttcctcacctggcaggtgacattcacctggttctctgccctcacgggctgttgagtaacctccaaggtgggtggaactgaaacagcacagggcagaagctctgaccttgtggcacagacagatccagggagggctccataacgtagctcccccaccacggtgagggcatcaccaggacagtgctaggcatgcagcaggtgctcagacattgagggtgctctttgcatatgaatgaaattactaagcacaacgcccagcacacagtaggtgctcaaggactggtagctcctactaggctaagaatgagggaaatctataagcaccacccctggcatgcagttggaatgctgtaactgtagcaaaataaagaaaatcaccaagcacatagaggcttagctcatagtaggtactcattaactgtgtttgctatcagtgaaataaatgaaacggctagcacagtccttggcacctggtgggtggtgtggtcacccagccactgccattaaaatgttagtaagtggctggcacatctaggggcatgggaggtgggcagttaggaatttaggttccaggcatttcaagccctggagcaagagtagagctggatgagtggagggtggtggggggtgggcttggtggtcaggtgtgggcttgggctgggtgagggtcctctacctcggatggtctcagacaagttggcagtcccacgaagagggtccccctgcaaggtgacgtgggccacctcgcagatgacttgagagtgaacgtcctcgcgggtcagcaccaccttggctgtgctgtggatgctgtaggacacactgtctcctgcggggtccacgttggtctggaagtctgagagctcattcccatttttgaaccatttcagggtgatgtctctgggtgagaagccgtgggactcgcaggtgaagctcactgtgtgctgaggtgtggccctcgccgcagggcccgataccacgggggcagagggtttggctacaaaaggaccatcgataatcaggagacatgactcagatgacaatcactaacgataagtgtgtgagatgttaagaaccttctgagacattattttttatccttccaataatgtggaaagattaatgagggtggtgtccttattgtcattttacagagcaggatgcaaaggttgggagaggtgaggacccatgtgaggtgagacagtgtaggggcagggcccagagggaagtccaggcctgagttcaaagtcctctccacacagggagacttccaccaatctgggcataggaacaaaattactgattggtctccctccatgttattaactggtcctagctgtcctcccccggaaggctcactaacctcagagagggcatttatagaagccaatacagggatcaatggcaaagtggcaccaccgtgagagctgcaaccaggctgctcagcccaggacaggggtgggctgacacccccagctcctcatccgcaaaacaggaggacggaggacggcgtttctacttcctgggatgtcgccaggattcaatggggcaatggaagcagttttgctctggatcaaacacagaagatgcttccccgaaaaaacacagatctatctttaacccagactttacagatacacagaggtctctctttaggtattataaaaatatgaaacattccgtatttttcttttcacaaatatttcgttctgtcaaataaaaggcattaattaaggataaagctttaacgtagagccaagagtttgtaagagcattggaatcacacctgctagaggtcaagccacaggatgttgcagtagatagacctggataacaactgaagccagggtccgtgggattttgatctctttcacctggagtactttaatgaaataaccaatgagagtgggtttgcagttgaggattttcaaccagctaatgaactgtttccaaaaacaacctttagtgaaaatcccctataaaaaaccggtcctgtattgccatacgggacactattcagggtttcactgactcagtgtacccaaattgcacctctttatctttcagataaatgctatttcctttggccttcctaacaatcattttgctgttgttgttagttgttctaatctgctggaagtcctaaatttgaaaagaggaaatttttgggaatctgaatcttcagttaggacaggtttgggtgaaaaacaaggatcactgagtactaagaaagccaaaggtggttagctttttcatcgttaattaattacaagagacaaagacccaggccacaccaacagacagaaacctattctgggccttgaaagcaaacacattggagaatcagaacaacgagtgcagtttctccatgtagatgaattttaagggtgtctgcaaattgctaattgttaccttgaaccttctgccgtcctcttagaaagcacatattatacgtttgactttgccaatattaacttgctccctgatatgcgtgaaataatgtgagagcacagtaaggagggtgtcacttgaagatgtcaagtctttgagacaccagcagcatgggtgtccctagaaggctgagaggctgtcttcagttccgattttttgagggcttcttggcagcctgatgctggctgctctctctgtacctctcaacacttcaatcctccctctatttgtcagagggggtcctcatgtgagcccttgtgtagggcgagactctgagaggatccttggtggccaagggccaaaagtagatagaaaccccaccctgggaagatgagtgagggtaagtgcaagggcatagcctggcatgtagtaggtgcttaataaatagcccctgtgactgtaatcatgaggtttggtcattactgcttctggagctgcatagctattctttaggcaacagaacaaagaggcacacaaacaccaaggaaaggctcaaaccctactcaccgcagctgccagaaaaaacccaaatgataaaaggagcagcaaccaccatgtttggcgaactggctttcaagtaagatcacaggggaagctggaagcattttggaagaaggagggaaaagatacctcagtgacatctgggagtgctgagggagggaggcttctggggctgaggagtgaggatttgctgggactccagcacgtgtttagatacaaatgttttcaagacagaaggttccccagccctgaggctgcatctgagccaggctttgtcccagtctcctatcttgggccctgaggccagtagcatgggaggggtcctgttcaggcttctggggcctcccagaatgtttccagaatggctgttttgaagcacccatgacccaaaaagctgttctcaaagccccaaaacctggggcaccgcttttgctagggggctgtgtatgagaatcttctggagccattaagaactttagatatccaggcccaaattagatgcaattaaattggcattttaggggggttcctgggtccagctttgcaaactttttttttgatagttttcccaatgattctaatgagcagccaaggttgaaagccactggactccaacccaaaccccatttatacttggggcctacagaagccctgacctgtctgaggtcacacagcttcaccctaacacaactcacctttattgagcatttactgtgtgcttgttgatgccctaagcattttacacaatatcactccttcagactcggcccagtctgtgaggtcagtgttaccatcaaagggtgaggacatcgaggcctatggtggtgaagcaccttgtcccaggtcacagagccaggaagtggcagagccgggaagaggcccaggcagctgggatactgcctgtgttctcctaacgacagttctgcagaagctcagtaataacctgaatgacaccaccattaggggctctgtgcacatcctctccaatcctcacagaacccagaataggccatgataatcagcatctcaccgatggggaaaccgaggactcaagggaaggcaagactggcccaagatcacacgatcttgaaataacacctcactttgggggtgcctacagtgcgctaggtgatttacagagagaaccttacgcttacgactttcctaaaggagtccatgattgtctctattctacagatgaagatgccgtggctgaacaaaatgaaggcactgtctcccgattctccatgtgtcccagtgggcatttcctgtgtcccaccaagcacttatgtccattaacagagcaagtgttctaacttcttgagctccaacactgactgccacctcaattgtccctttgagattctagacttcatgcaatgttagggagaagcctccctcctgggtgcccaggcctggttaccctgcagccataagcaaaagacagtgggctcctgacagccggaggggagaatctcaactcttgctcacatgggccccaaacactctctaggaaatgcctcatctcctcatccttagtcctcagcaccatgaacgggcagatacgtgctctgctgggctgcaggaggctcgactctgctcattggacgctgctgagtgaagaggaaacaacacaacatgggggaagagtcctaaatgcctcatgtgtgttgagacctgtcctttaggaaccggcttggcatatcatgagacacgcgcagggcctttctgatgggagtgtgaagacaggccctcctacccctacagggttcttgttttgtttttaatgctttttgctgtagaactgaacaatgcaagagtttagaaagagaaggttggagcatttctccactcttgaaaaaccacagttgagtgtcacaaagacaaaggctgtgagtcaggctgcggggttccagccttggctccctgacctgctcccaagtcaggtctcctctctgagcttcagtgtcctcatctttaaaggaggtagcaaatggcttctccctcatagcactggttataaggagactctggcacagttgctgctctctggcccccttccccacctccctcctttctcatgtagctcatcatttaggccgagagcatggcaaagaggagtgagtacttcactaggagtgagcagatctgagtcacacctgagccaccactggctgtgactgcctgggctggggaggcaccacctgggcatttcagtgtctttgccaatattatctgcacaatcaggaaaaagccaccttccttgtctaagttcaagggttgtggggagctgatttcagtcattactgggcaatgtacattttcatatacatacatgtacatgaaagcatcatgttttacgctttacatatacacatttttttaaaaagctgttagtaaagctatgtgtcttctggagattccgttttttgcctttccaaattccagaggctgcccacattcctttctcacagttacatcttcccatcactctaacctcttgcttgcaccctcacaaatccttctctaagaattaatctccttcctccttcttgtaaggacctttcttatgtattgtgtccaccccgatgctagaggcagatgttaaaaccactgtattaaaaatgtttgaagtggggctgggcacggtggcttatgcctgtaatctgagcactctgggaggctaaagtgggtggatcacctgaggttgagagtttgagaccagcctgagcaacaaggagaaaccctgtctctacaaaatacaaaattagccaggcgtggtggcctatgcctgtaatctctgattgctacatcatctaggagggaaatcaggcaatattctcaaatatgaaaacacactatcctgtgacctaggaacgccacttccagtgggtgtctcccgcctgagtagggtgacacatgtacaaggtcatccattgcatgattgctttagtagctaaggttgggaataacttacatatccatcaacagaagactgtaaaataaattttgatatttccatagattggagtatttttcagctgtaaacacactggagcagctctctatgtcctgacgtggaatctcgatatggaatgacagggcttacatttgggagaagttttccaatcacaaacaagctttagtatctgaatgtgaggtgcattcttaacatttgggaaactgatgaaaagagaaatgctggctctctgacacctggctctgtttgaggagcttttatctagcacctatgatgcaccaggctcttctatggagacagcgtctaacgctggggaaggaaggagactgccacgattcagatatggactctggctccaattctgccactaactggccctgtgaccatggacaaggcccctgtcatgtcttggcttcagtctcccatctgtaaagggggttgggctggatggtctgaaggtccttcctgtgctgacattccataattcaggacttaggacgaagctcttgggcctctgggaggaaaccccagataagcattgttgcagccttatatgggaaacccctaagtcacccacttgtgggacctctttcctgaggtgagggacattctgagatgatgcagctctgctcggagcccatggtaactgtgtgactcagtccccaaatcgcagaagggtttcccaaatagacccacagcaaatgccaaacgtattggcatctcctcccaccaggccatcagattcaacagtgaatgtgcctcccagaaatcttgcccgtggggtgtttctgaggatgaaataaagaaaaacacaatttaccctcttcatgagctggacagatttctcctcattagaagggaagagaatgtaagcttggtggggaagagctttgggctgtttcattcactgctgtttgcacagcatctagggcagagcctggcacacagtggggtctcagtgagtgcctgctgcataaagaagagacttggccaccctgagggggaagcgttctctggaggcagaaggcaaggtccagccctgtgcctgggcaagtcactcaaattgtcagttccctcatctgtggaaccaaagggctggatcagctttggaaacacaagagctgtagagccgcaagctggggatgccttctgtcccatcatttccaagccgtggagcctcgagcgactgccatgacatctccaagcctcaactcatgtgatctggagaaggggtgacatcagttcatgaaagggtggctgctcagccaccaccacacctgactgttgctctaagaatggataatgtaattattgagttattgtcacacactaggggatgaaggaagcccacgctgtactcaccacgcacagacagctcggtgcctgctccagacttaaactccacgtggtcggggctccctttccggaacttcacacagtagtaggtgccggcatctgctggggtgatgttactgatgcggatggaaaagtccatgttgtttctctttgtgaggtctgaaacagttgttacccgtgggaagtggccttctttctgattgtagattaattcccggcctggtccagctcctctgaaccactggatgggccccacagggatcagggaagtcacagtgcagtgcagagtggccgactctccagctgcaactgatatggacttgtcaggctgaatcacctgcagctcttcctcgccagctacccctggaaaggagcacaaagcagtcattttttcatccttacgtgatcctctgtgtttcctcaagtgtttatcaatggctttcattgaccgggtgcacaccaggaaaaggccttgagctcagcacactacacgtattatctcatttaaccctcacaactggcctgtgacataagactgtaatacaagcgaggacactgaggcacagagaggttcaatttctgtttccttactttcttttgttctttctgtttgctttttttcttttcttttctttttgtttttctttttcttttttttaagacagggtcttgctctgtctgctgcccaggccggagtgcagtggtacaatcacagctcactctagcctcaacctcccaggctcaagtgatcctttctccttggcctcccaagtagctgggaccacaggtgcgttccaccatacctggccaatttttgtgttttttgtagacacacagtttcaccatgttgcccagactggtgtctacctcttgggctcaagcaatgcatctgccttggccttccaaactgctgggattacagacgtgagccaccatgcctggccaagaggttcaatttcaatgtagagctttgggttgaggacctgagtagaactcttgagccctccttggaagtgccatgttttgctaaatatgtgcctccactctgtggctacatggagtgttgcactttttgcatcaatggattgggtggggccgtgtgacttctttagacccttgagttacgagcagaagtgatgggtataatttgtgggctgtgcatgtaactgcaagagcctctgtggatcaatttctcccttcctgagacccacaaggctctaatggggcctgctccattgcctggatgcgtgaatgaccgttgcatgcagaactgccaatccacactgaatatgtagcttccagtagaaatacaacattgttttaagccccttgtaatatttcacccatagcataaacacattacataagtttcctaatgctgatgtgacaaattaccaaaacttagtgtcttaaaacaaatgtaacattttatagttctgggggttagaagtccaaaatagtgttactggggtacaatgaagaagaaatgaagaacgtcaaatacacaaagatagagaataaaacagtggtgactaggggtgaacttaggggaggtgatggggaggtcaaaaggtataaaattgcagtaagtctgacgaagaagtccagagattgaatgtgcaatctgaggattctagttaataatgttgtattgaattctgtatttttgcttaaaaagcacattttaggtgctgttgacatacaacacatgcagcataactatgggagatgatggatgtgtccatttgcttaactttaataatcatttcactacgtatatgtatatgtgtacgtatatgaaagcatcatgttttacaccttcaatttccacaatttttaaagagctttcagcagagctatgtgtcttctggaggctctgttttttgccttttcaaattctagagttttctcacattcctttctcacagttacatcttcccaccactctaacctcttgcatcttcacatgcaaacatcctggaatacagggatgtttcaacgtcattctccaagaattaatctccttcctccttcttataagcacacttgtgatgtattagctccaccctgatactagacccagatattaaaatcactgccttaaaaatgctgagaggtaaaggaaataacggaccaagaactaaaggaatataaatgtcttaacaaaatgagaatgtaaagaaagagaaattataggaagaaatcaaacagaaacttaggaattgaaagtacaataactaaaagttcactagaggggtcccccagtgggtataagcaggtggaagaataatcagaaaactggaagatggtataattgaaattattgagactgaggtattggtggaaaatagaataaagtatagagcacagaatctaagggaattgtgagacgttatcaaatgtatcaacatacaccttactggagttccagggggaaaaaagagaaagagagaaaggaatagaagattatttgaagacatagtggacaaaaaccttcacagactagataaaatacaggaatctacctattaagacacagaagaaatgcaagttgaactcaaaaataaactcagagacccacactaagacacattataacccaactgttgaaaactaaagtcaaagagagaatccttaaagcagcaagacagaagtgattccttacataaaagagaccctcaataagattttcagctcagctcttatacaaagcactgaaggccagaagatagagggatggtaagttcaaaatgttgaaagaggaaaaatatgtcaatcatgaattctatacctggcaaagtgtccttcaaatacaagggagaaattacgatattctcagataaacaaaagctaacagagttcatgaccattaaaccttgcctacaagaaatgctaaagggagtgcttcaggtggaaatgaaaggatgctacatggcaactcaaagttgtatgaagaaataaagatatccagttatgtgtacatgttttaaaaatcatgcttcaatatcccacaaacaagctgtgagcaccctgcccaggtgaccaggtaaccagtattttaaagctggtccctgccacaattcctcttcttgtcctcctctactgtgacctagtgacattgaaacaccctagtaaaacccatcatggtttttgcttgtgtcctccaccttgactcccagtaaaggcacttgcccagggatcccatctctcttgcctacccatctgcttgattgagcctgctccttgggagctcctcccacatggcttcctgcatggcctgccctacttccttctctaggaactgtgagtatgcctcttcatatgaacttttcatggccatgttagagtgatcctcaaaattcaaccagcaggaatcactctaacattttcaatagtaatggcaatgaggatgggatcattctaaactcaggtggaaagttcctagggaatgcctttgactcatgacttactgatttgctactctgattggctccacaatttgagaaggcttttcaccctgatgactttcttgtgctatgctatgtacagctttgtgttgccttttggagtgctgccatggctctccatcctgaagcgaggatcctgttccaatatcaataatgacatctgcctttcttcaagagcacaagatgatataacattggtaacacctcttcaaagaagattcatgtgatatgcatattaatgtcacataatccagcatcagtaagttttttctggggtgcttgtggcaacatattcttcatttacaaattttacttacaaattaaaatcaacaggccctcctgttagtgtctttaaatgaattaacaaataaaagtatctcttctctgtagagactttggctgtgtctttcatgcctcttggagtctctaaaccactcatgatggccagacattttccccagggcctttgatgcaaatataatgcccctctcagcttttgctatactccattacaacaagaaatttctggttatctattgggctctcctggcttagagtccagatctggggagcatactttcctgtcgtactctttaaccataaattgtcccaaagccagactctgcttatctgaaatggagcccactggaatctaaacttccatgaaaatacaaaactaagatcactgccaggtagagctgcacacctttctgttaacagttggcattattattactcggtttgttgatgcaataatcctcaaccaaacactagctgagttcagcagcatattagaaggaatatacacaatgagcaagtggtatttattcctggaacacaagaatgtttcaatatacaaatgacaaagaatgtaatacaccatatttatagaagaaagagaagaaacacatgattatctcatttgatgcaaaacagcatttgagaaatgtggacatctttttgtgaaaataccatcaataataggaatatatgaaaatttctataagataaaagttatatacacataccttattttattttcccttatcagtggctaatttatgattttatttacctatttatcatgtatattgattactgtcattattatgactttattgaaaaaagaaatcagtaaggtaatcgcatttacaattactaccaaaaaagctaaaatagctagaaacagatttactcaaggacatgaaagacctccacaaaaaaagctataacaccctgatgaaaaataaatagaacaaaaataatggaaagatatccatgcttgtggattagataattacttttgttaaaaatatacatactacccaaagagatctacagattcaattcattattagtaatatttcaatgacattttcctcagaaatggacaaaacaatcctcaagttcacattagtcatagaaaattgtgagtagaaaaggcaatcttgagcaaaaagactggaggcatcacattgcctgatttcaaacttgactaccgtgccatagtaatcaaaacagcatggcactggcataaaaatagacacatagacaaatggatcagaccagagagcccagatataaacgcacacatttacactcaattgacctttgacaaaaatgtcaagcagacacaattgggaaaggtcagtctcttcaaaaagtggcattgggaaacctggatatccatctgtagaggaataaaattagaccttcctctcacatgacacacaaaaatcaattcaaaatgtattaaagacttaagtgtaggatctaaaagtgtaaaagtactggaagaaaagtgccatgacattggtgtgggcaatgaattttcagatatgagtcccaaagcacaggcaacaaaagaaaaatagacaaacggcattacaacaaactaaaaagcttctacacagccaaggaaacaatcaacagagtgaaaagacaaccagcagaatggaagaagatatttgctagccatgcatctaatgaaaagtcaatatacaaaatatataaggaagtgaaacaactcaatattaagaaaacaacccaactaaaatatgggccaaagatcttaaaacccatttctcaaaagaagacattaaaatggccatcagacctataaaaatactcagccttactattcatctggtaaatgcaaattaaaaccacagtgagctatcatctcacacttgttagaatggctactataaaaaagatgataactagttttggagaggatgtggagaaaagggaattcttgcacatagttagtgggaatgtaaattagtagagccattagcaaaaacagtatggaggctcctcaaaaaattaaaaatagaactatcatatgatctggcaatctcactattgggcatacatccaaaggaaatgacataagcatgtcacagagatatctgtgctcccatgtccattgcagcattatttacaatagccaggatattaaattaacctagatgtccatcagcagataaatggagaaaggaaattggtatacacaatggaattctaatcagcctgaccaaagaaggaaatcctatcatttccaacaatataaatgatcctggaagatattatgctaagtaaaataagccaggcacagaaagacaatactgcataatgtctctcatatgtggaattttaaaaagttgaactcatagaagtagatagtagaatattggttaccaggcactaggcagggggtgcatttggagagatattggtcaaaggatacaaaatttcagtttagttaggagaaattagttccacaaatctattgtacaatatggggtctagagttcataacacaattcgtaacctcaaaaattgttgaaagcagattttgagagatctcaccacagaaatgatacatatacaaggtaggtcatatgttaattagctcaaattaggcattctgcaatgtacacatatttcattaatatggtatacatgataagtatatacagttctgtcaaataaaaataaaatattttgttaaaagtttcattgaaattagaaacttggagaaacaatgataaaaaatgaaatctcctgtgtgtgcatgtacacttacttatatgcatacatgcatatacatatgtatacacacatatgtatacacacatttgcaaatatatatacacacacatatatgtatatatacacacacacacatatatatgtatatatagacacacacatatacattcacaaatatatatcaaagtgtgacctattgtgatagtatataagtttgttttgtgtattaaataaaattacaacacacgttaaaatctcattaaaatatctggcccatagaaagtaaaatatgtggcccatagaaagcatccaacacattaataacaaatttagaagtacatacatcacagttgtaactctggttgttgctaacaagtgtggtaggcaataattaattctatgtttacttccctgcattttctaatatttctgctagtagcataacacgactaaaagaatgaactttggagccggtcgacctggacttgaatctcagctgctccactgactgaggtaggggacaatgaatggacaagttcctccctctgcctgagtctttgtttggaaataggggataatagttgcagctttcacacagggatgttgtgaggattagtggagctaaaacaggcaaaatgctaataactgtgtctacatggtaggaagagctcaattgttaaactcttactgctgtcatttgggtacagtgtatgtgtgagaaaaataatttgaaaagtgagacccctgccctctagggcctgtgaggtgacatcacagcagggcccagtggggaattgagaggctgctgtgcccagccctgtggttctggggtcagctccatggcctgagaagggatcaggacaggtaacttgtctgggagctgtgagcagggttctcccaggctgcaccaggaaaggccctccaatcctgcctgtcttgggaaggggaaagaaattatccatgggaaatttaagagaaccaaaggaggttgtagtacctgttatgggctgaatgtgtcccacaaaatgcatgtgttgaagctctaatccccagcacctctgaacgttacagtttgggagacagggtctttaagaagtaatttagttaaatgaggtcattggggtgggccttaatacaacaagactgatattctcataagaagaggagatgaggacacagacacacacagaggaagatcatgtgtttaagacacagagagaaaatggccctgtataagccaaggagagagacttcagtagaaactaaccctgctgacaccttgatcttggacttcagcctccttaactgcaaggaagtaaatatctgtagtttcagccacccagcctgcagttctttgttatggaagccctaggaaaggaatataggacccagtaagcagcaaatgtggaacttcttaaagaggaagaggccacagagaaatgggtggtaagaatcaggtcacaggggagggaggagcatgggggaacagaggacaaagtgaggagcacccttagggaggatggtggctgaacactcccaggatacaccacaccactgccctactcaagtgagcactattacagacttcacatcctcagtttggtgaagagagagggctgggcctagagccacataaccctgttagggtgtctctgagcttactctgtggacttgggcatgtcacttggccctagggcctcaggactggtgaggatttagataatgattcttctctgctttttcaattgaaatattatcaaaatgtaagtaattgttgttgtggtggttgaatcgtcctgtggttcaatgcctctggtagccagctgcagatccacagagaaagtgctcagctccctgattttctgctctcagtcaaagcctaatccttggcctttcttggcagcacttgtcattgtccggaatccctgaaagtccagggacaggccatggctcagtgggcaggaaaaaagattttaaccgaaggcagtgctcacctgtgagtctccccagcagtagcgtcatcagcaggaaaggactaggaaggtggggccaggaggctggcacgggcattctggagaccttaggagcctgctctgtccaaacgtctgtgctgggaagatcgcagactctgctctgaggagagaagacaagccctgcctcccttagttc

SEQ ID NO: 1410 - DNA, 55661 bp, Homo sapiens; identical to SEQ ID NO: 1408

SEQ ID NO: 1411 - DNA, 31082 bp, Homo sapiens
tttcctagaaggtatttactgatttctatatacttaacacatgtacaagacaggtatttcaaaagattaaagagggcagacagtgcgcagatgtctttctcattcctgtgtgcacagatgtctttctcattcctgtatccccatctccttacccagagacacttcccaaacaacaagcgaaatagtaacagctttcgctgttacaggaaataaagagtaatgaggtatgtaacacgaccaaatcttgaaatatatcatttaaaaaccagtaaatagcataactcgaatctaagcagtgaaaatatgaacgtctacctgaaactcacaggtgcgggagcccacgcacaccataatcaatggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccgcagcttcctgaacgtctcccagcgctcccgctgtgcgcccaggtccagatccttgggggacggggcgggccccggcgggtacggggttggcgcggagggcagcaggtctctggggcccgccttccggacccgccgccagcggcgcttccgtcgccacctacccagccacctcttggccgccgcgtggctcccgaccccgacttggacccgggggcactgcgcgcggctggcgcccgtgaccgcgatggccgcgcaggcggcgggaggatccccgggccgctttcgcctccgccgctgagcagtggcgcggttcctcactctgcccatggcgcctgcagcctccggagcgcgtgcccacaccccaccctcatttccccgtcagtcgctgagcagcctccttgcctgcgccagcaggattggccccttgttgaatgcgatgtaaagagacccttcccttgaccctatcacaacagccttcgctggcctgaaaggcagtcatgaggcgttcagcaaacacctgccgggcaccagataccctcacctgggcgctgggatgtggagatgcatcaggctttccaaagcactcacattcatttaggatcaggtgtatgcaaatacagtccccaacaccttgggacactttgctctgacagaaataagaaccaggggctctgggaacagagaggaacgcccacacactgtaattggaggggcgtgtgggaggggcacggaaagactcttctaaagtcttcttgggggcttgattcttttattcggctgtagcgttttatttttcttgtaattttcgttgcgatgaagtcctctttacctaatgttgacatacctacttctgctgttttaattaatgtttacctgatgtgacttttcccacccgttgtatccttttcatttacccagggcgaccgaagtggaactgagtttcatataaacatgggataatcagaccgtgtttctcactgactctgccagtatctaccttttcatacatgtttctagttcatttccatgatctctgggctagtgtttaggtccacagatttattgtttgttttcttttgtttcctccgtgtctcggctaaccgagacctcctttttttgcccttctgtggcttacgtgtacaccttgcaggatttatcctgatttccgaaagtgttttcgagtgtttggctttgtaaaattgtctcagtggttgctctgggattttcagtgtgcatatgtgacttaccacaggctcctggtatccagttctcatcacttccattgaagtgtagaagcatcagccccttttagcccctctgccttcctgcttgtagacaacgttgtctggagtatcggatggtttcatagtttttgctttaatcgtcaaacatgacttccacaattcacaaggaaaacggtggcttagtgtttgtcccctaagggtgttttttctactggtcttgactcctttctgatagatacttccagaggccatcttttattctttcctcttttgtttcaagcacctactctagccattctttcaccgtgggtctgctcgtgacaaaatgctttcctttacctgagaatgtcttgatttccccttcgtccatgaaggatggtatcactggatacaaaattcacagctgacaggacttttgttcaacatctgaaacttttcgggacacttcctgatgaccgccactggtcagaggagacatttgccctcattaaaactggtgttctcctataatcaatgaaccacttcggtcttgctgctttcagtgattttatcagcttcaaaaactgactatgatgtgtgtgttggtgtgaatcgctttgtggttgtcttatctgaagtttgctcgttttccagaatctatgggtttatggttttcactaaaatttggatattttcagccttcttttcttatactcctctttcagtccactctctacttttggtactccagtcgtagggatattggaactttgttattgtcctaacttcgctgaggatccattcagcttttaatcagtccacgatctctctctctcgctcaggcacagtcagtcctattttctgtttgtttgttttgtttcttgaggaagagtctcgctctgtcacctaggttggagtgcaatggcgcaatctccgttcactgcaacctctgcctcccgggttcaaacgattctcctgcctcagcctcccaagtagctgggattacaggcgcccaccaccacgccaagctaatttttgtatttttagtagagacagggtttccccacgttggcccgcggtgatctgcccgccttggcctcccaaagtgctgggattacaggtgtaagccaccatgcccggccgtcaatcttattgattgggcctccattacgatgatggtatcttttgtcatcacaggtctcttaccgagtgcatccagcaatgtttccaaattctgttattgttttcgttttctgttccatcatttcttttttatacatcttctactcattgctgagattttccattttctagtctggttccagactatttgcaattacataatgaagcatttttatgatggttgctgtaaaatgtttgtcagataatggcaacatctgcgtcgtctctatgttggtaccactggattctatttcctcattcaagctgtgttattcctggttcttcacatggtgggctatgctctatggcatacaatgtattttgcttgttactttaggagtctctggacaggagacaaatatttgatgttagaagtcagctactttctttaggtttagcatgtagattctggtgtccatttttaggttctgggatttttaaaaagtttattttcagagcatttgcggtgctatttttgtgtgtttggcttacctgccgacacagcagccccaactgctccctactggtggtatttgagaggcagaaaaaaactaaagtccacactttattccaggtttcctacttacttcctacctaatatcattttttttttctgttcccagataccatgcagcctaccacactacatttaatcatcatactgccttaggttcctcttggctgggacaacttctcagactttgcttgtttccatgaccttgagagttttcagggtcactagtgaggtattttctagaatatctttttttttttctttttctttttcttttttttttttttttttttttgagacagggttccttgcttcccaaagtacatgggactacaggcatgcgccactatgcccggctaatttgtgacttgtgtgtgtgtgtgtgtgtgtgtgtgtgtgtgtgtgtgtgtgtgtgtgttttgtagagacaaggttttgccatgttgcccaggctggtcttgaactcctggactcaagtgatctgcctgcaccggcctccctagaatatttttcaactcaagtttttctaatgcttgtctcatgattagactgatgttgtgagctaccggagaatcaccacaaaggtaaagagctgttttcgtctgatcgcatcaagggtacataatatcaacatcagttttgattgtgtaagttgaccttggtcacctggcagaagcagtgttggacagggtgctcccatgaaaagttgctcttttaacccctgtccacatgctactctttggaaggaagtcattaagcgaagttcacacctaactggtgctaagttttaaatcctttctttgaggcagagtatctacatacattctttggaattctccttcatggcacagctatctatgctcctgcatttatttccttattcaatcgtttatgtatatcatgatactttcacggatatttacttgatactttagattataatccaatactttgctatttctttttcattattatcattcttgcagttgtggccactgggtgcacgttcagttcacccctaggtcccgttggtatgctcccattatttggggctccattttgtgtaattccttgctttgtggctcatcctgcacatttctgtcttgcatatgttctaggctggtctggcctatttactagctcctaggatcagccaattctccaaggatttctgtttccttttattagaaaatggtatcagagaccaacgtctggcaactaggtgtgctcgtagctgccagagtctagtggttcctaggccctctctgctgaagcagaaaggaaatacgtatgtatgtatactaacccacgtatgtacacatttctataaatattttgatacatgaccatgaggatctataataagctgaatatgagttcctacccatgtctgcaactctattccattgcagcacgaatcattcttgcccctgccacattacgatctgcacctccctctccagcagtgaaaaacctgcctctcaccctccaccatccatttactcattgcagttccagtacacatggagaacggtgtcagatttttcaacctgtgtccataccggcaacaggtttgtctagtcgagtatgctgcatatgtacaattgcctttgtctttagccttacacacttctttcatttccaaagttgcttagatcagcactttgtacttcacagccttcagtgaagcttttcattcattggtaaggttagaaccttttgtcacattctgcatttcaacctgatagttccctacctccctaatgatgtcttaaaagattaaacacgttaagtttcattctgtgtcctgtcagtttccacggattctgacaaatgctttgtctcatacaaccatcattagggtatctcaccctgtcctcacacagagacagctatttttatttcctcttcttcggaggacacgaaccctatcataaagactccaccctcatgacctcataacctcaaaccccattacctcccagaggcctcacttgcaaataccatcacactgggagtcgggacttcaacacgtgaatttgggcgggaagcaaacattctgtctataacgcacatgatggtttcactgccctaaagcattacctgtgctttacctactcatgtcctcctgtaaaagtcccctccacatagcttgcctccttctactcatccttttgaataaagtttctctttactaatcctggatttgtattttgtttgacaacacgtacgttttgaagcaaactgggcaaacacttaatagcgagaatgctggaccaccagtgtggcaagactattgagccttgttaaggaccaagcagactctcttccaaatttgctggaagatagagacttcccactttacatgaatggacgttcctgttctgcatccttggcagcagttggtttgtcagtttgggggtcttggccgttctgttagatgtgtagtgtcatgtaattattatttgagtttgcatttatctatcaatgccaaataacagtaaacattctttcacatgctcatttatcacttccaaatctttggtgaggtgtctgctcagacctttagctcatttttaaattgggttatttgtggttgtttggtttttgaatgtccacagttttttgaatatttggaatcaagtcttttctcagatatctctttgaaaatattttctttcagtccttaggttatctttcttccttaacagtaatgtcttccacacagcagaagttttaagttttaacaaactccaaataattgctttttgttcacagactctgtggtagggtttgtgactaaaaccccatcaggaaacacaaagacatgttgatgtttttcctgtgttttcttccctgtgttttatatttctatatttctttttttattttatatatattgtttgtttgcttgttttgttttgttttgagacagagtctcgtcctatcgtccaggctggagtgcagtggcgcgatctcggctcactgcaacctctgactcccaggttcaagcgattctcctgcctcagcctcccgagaagctgggattacaggcgtctgccaccatgcccggctaatttctttttgtagttttagtagagacggggtttcactatgttggccaggttgttctcgaatgattgacctcgtgatccacctgcctcagcctcccaaagtgctgggattacaggcgtgagccaccgcgcctggcctataatttatatttttatatttcatgtgctttataatttgaattttacatacgggactttggtcctttttgagttaatttttgttaaagtgtaagttcttggtctaggttaatgttttttccatatgggcccgaaatctcccaccaccatttactgaaaaggctatccttttcccattgtattgtgcacgtgcctttgtcaaggatcagttgagaaatatttctgcagttcgattattgggcttgctagtctgttgcattgaactgtgtgtgtattcttagtaaatgccaccctgtcttgattactgtagttttatagtaggtcttagaatcgcatcttatgacttttgcaactccattctcctttttttagaatggcttttctattctagcacatttgtgcttcagtacgaaatttcgagtcaatatgttgatatctacaaagtgaatgctgtaattttgattgggattctgatgttacaatagatcagtctcagaggatttgaaatcttctaacaattacaaatcttccagtccgtatatatgacatctctctccacttattcagatcttctttgttttttctttcctcatcaatatttgtagtctctgcaagcagatcctatgcctgacatttagatttagacctaagtacttaataggtacttaagttgccctttaaaaaaatcaaattctcattgttcactagtcatatacagctaaacagtcatcatcaatatatcgattgtgtcctgtgaccttgagaacctcatttattaattcagcagtttgttgcaattctttggagttttctacatagataaccatatcccctgtaagcaaaaagtccctctttctttatgttgttgtctcttcaggttttacctgggcattggtagcctctcttagcatatggatcatatggcttttagaactgctttttgccctaggctttacaatatacatatttacctatcccagtccaccgtccagtaacagtacatcacttaatgtgcagtgcagctacctaacccgacagaattcccaattaacccctcatgaacttatccgtatgctatatagtcaccaaatacattgtcagtattattttaaacaaaccgtgttcctttagaccttgcaagaataagcaacagaaaaggtgcgattttacctccacttgttccttcactgattctggccctgcctttatgtagattcaagtgtctcatctatcttattttccttctgccttttaacatttctcccagagcagagtttctgaaggttaatttgcttgattttaatttgtctgagaaagtctttgtttcctgttcacttgctaatgataattttgcaggacatacaattctagctaggtgatatttttcttcactcaacactttagtatttcagtctacgctcttcttttttcgtgggttctgacgagaagttggccataattttcttccatgttcctctaccagtaaggtgtttttattgaggttttcagactttctcttcctctttagttttctgcagtttcactatgtctagacgtgagtttgtgttgtgtgtgtgtgtgtgtgtgtgtgtgtgtgtgtgtgtatttggtatatatgctgcttgatatatgctgagagattcctgactctgtgctttggtgtctgttattaattttgacagcgctaggcccttattgcttccaacgtttattctgctctgttctctctgtcttctttctctgtctgggattcagattaataggtcgaaccttttgcaattttcacacagtaagatgttcaattccatttcttcccctctttttcctctttgcattccgttttggaaagtgtctgttgtcctctgacctttcagcatgctttccaattcttacctttgttgtgctgactctactgatgagcttctggaagacattcgtcatttctgttagtgtttttgatttctagtatttccttttaattctttctgagaattcccatctctctctccctttgtcctcccacttgaatctgaggctaacagagtgctcctgctcagggagagcctgtgtcttgcagcacgttcagttgtaacccgccgttatttccctggagcctggttgtagtggtggtaaggtgtaggggcaggaaagcattccacagctttatgactggatctctgcctttcaatgggactgtgtctctgggctgtgaccttgacaagtgtttctccagtggtattaccctctccccatgtccgtggtcctttccctggcttcagcattcccaaataatacctttacacacttgagccctcttgatttgtttttcccccacaggtgacactggaagcctggaggggcagacgatggaggaatacccttcctgcacctaagataaggctttggtcaagtcttttgctctgaagactgggcctttgtcttggagaaggcactgggagtatttgacaacgattactcttcctctctcccagccagaaaaaccacggcgtctttttcagatcttcaccatgaaaacccatgtgttgagccaaaggccatgaacatgtggatgcccctgagactgcgggcccccagcgtattctcacactaatgccagtccacacacagcctcaagcacttcatcgtatttactactgaagcactcctacaggcttctgtctgcagaagctgctgattcaggtaagcagatctcagctgtgacactggatttgacagtctctcaagattccagggtggtgtcttgctgtcccctcttggttctctgatgagtccaaaagatacctgaatccattttccagcattttcttgttgtaaggatgggattggtcatttgtctatttacacatagagctgaaagtggaagtctcatttgtggccatttttgaaacatgtcacaatcagaataagtctatggcttgcaaatatcttgccaagtcctaggagaagccgatgacagttgaaagtagttgtcgcagggagccagcaggagaagtaggtgtgtgtggtgggggtgggaggttttcagaaccaaatgacttctgttctcattgaatgcaaattactattacattgtttagtaatgtaattactaaaaggtatgactgtttaactcttaaaatcctatatatatataatatatatattatattatatattatatattatatatattatatataatatatattatatattatatatattatatataatatatattatataatatattatatattatatattatatatattatataatatattatatattatatattatatattatatattaaatatattatatattatatataatttatatattatatattatatattatatatattatatattatatattaaatatatataatatattatatattatatatattatatattatatataatatattatatatatatacgatttgagaaaattaaataatggacagtgcattttatgtagaaattgtctagaaattttgcatgaaggaatgcacagaaattgtaaacataatttgaaggttaaataaatgccctcaaatgcatacaatttctaaaactgttattacctcttgcttgctggttgatgtcagctgtcagtattacctcctcactaggcatgcattgcctaggatcacagcagctttacacaccaattggccagggcgatgatgttaaaatcggcctctgccaaatcatgaggaggcaatgacgtagaaggggaccttatccccatttcacaaatggagaaaccaaggctaaaagagactaagtaacttgctgaaagtcatacactatgtaagtggtggatctgggacagtctcccaagctgtgtctgacatcagcacccatgtcctttctggtatacttctctgcctatccaagggtgggcagcattttgaattgtcacacctttttcggataatggtgttctttttttgttttcttttcatctgagcttggaaaaaaagtactcacaaatacacaagtagagatgaatacaatcatctgatactttttagaaaataaaaacccataagcctcattaaattgacttagaagctggaaacaaagataaaaatcttccaaatttatttactgaaagtagcctgataccaaaatctggaaaagacagtacatgcacaagggaccccaggtgcgcacgggcacacaggcacgcacacacacacacacacacacacacacaaacacacacactcacaggcatgcacacgcagagagaaatatggatctatatcacttatgaaatctatcactaataaatttcattttgtgcccctaaagtttcagtggataaatagcaatgatatgtagaaaacctaccacacatctggtaggttttttactcatgagaagatgatgtcatatttagaaatatatatgtacaacatggtgactactgtgaatagcaatgcattgcatacttgaaatttgctaagagagtagatctccagtgttcacaccatacacaaaagggtaactgtgtgagatgatggatatgttaattagcttgatcttggtaatcatttcacagtgtatacacatatcgaaacatcacattgtacttcctaaatatacgcagttttatttttcagtcatacctcagtaaacctgggagaaatctcatttgctgtagaggaacacttctcatccaggggcattttgcctcccagggaacatctggcaatgtttggagacatttttgtttatcgttactggggaaaagaggaggtgcttctggcatccagtggatccaggctagtgatgctacttaactccctgaaagcacaagacggccacgcgctataattatctcgtccaaaatgtcaatagcatcaacgttgacaagctctgtcgtagggtatttacataactcagaaaagccagaaacaaaatttaactcatgtgcagtcctgccagtgatccataacaattgctaaacatttgatatgtgtgtgtgttaaattttctgctacagttttttacctcataatcaccaaaagactatggttggaggaaactattttatttcaaaggttaattcttccaccacattctacaagtgtttttcaaatattccacatattagtctgtgcttaagaacacatgtcccttaagatttgtaatttcagctgacttacatggaggggtattctactagtatcaatccaccatcacctgtctcctgattttcacctttctgaacagaggtatcatttccatatatttggtgaaaataaagaaaagcagtgcctcataccacaatgcatgtgatatacaaagggctgcgtgtttgactaactgcatcaaagcaatcccattaccccaccagtgactggctttgaaatgggcctttcccagttgccatccatgagatatgggtgtttgttggcttacagtcttcgaagaatattttctcagctcttagagatatagaagagacacaaaagatggtacacacgcacgcacacacatatggttgcacacacacagtctaaaagaatatctaggattataattaacaaatgaatttagtgtgatattgctgggtataaggtcaatatcacaaaattcaattgaatttgtatatcctggcattaaacatgtaaagagacaacttttaaatgtcatttctcatagtatcagaacacatcaaatgcctaggaacaaatctagcaaagattcccaagacctctgcccggaagtctacacaacattttcgagagaaattaaagaagacctaggtaaatcagagctatatcgcacttatggactggaagacaatgtcatgaaagtaaaccgaagagagaattctaatgaaaatgatttatagattcaatgtgaccccagtgaaattcccggctctttttctgaaaagggaaataaatgggcacgccacttctaagttctataaggatgtccaagatccaagaaaagccaaggccttctaaagcaagaacactttttagaaccctcacagccagatagcaataccaaccataaaggtatcataattaaggaagtgtggtacgtgcacagtaatagacaaatagaccaatagagcaaagagagggtcccacaaacacaggtgcacatacatacgtatatggtcacgctcatttacaaaaaatgtgccacctcaatgctctggaggcaagatggtctattaaataagtggagctggactaatttggatatccatatggaaaaagattaacattggcccctaagttacaccatacacaaagattaactccagaggttatggcttgtacaaaataatgcataagcatatctgcatgaccttgggggtgagcaaagatatctgaaataggacacagagtcactaacgataaaggaaaacattgttcatctttacgttatcaaaaggaaggacctctgttcatcaaaagatgaatttagagaatcaaaagataaatctcatgatagaagaaagatatttgcaatatacatatgtatataccacaaatgtctgatgtacagaatgtaataccccctaaaatcaagaggggaaaagaataatgcaacaaaacattggcaaaatatttgaacagcaccttcacaaaacaggacatccagcggactaatagacaaacagacaaacagctgctcaacctcagtcaccagggagaagtcagctaaagtcccaatgagatctccccaaacacctgacagaagagccaacacaagcaacaacatgaagccttggtgaggatgtggaagagccctctacggccggcaagagtgtaaacaggtacttgcactttggaaaactgtttggccatagctatgaaagctgaacatgtgcattttctataagccagcaattctgtctgtgttagttgcctattcctgcaaaacaagctgccaagccttagtggcttgaaaacagtgtgtatcttccagcttacagttctgtaggtcagaggctttgttctctgctccatgtatcacagggtgaaatcaagctcagccaggcagtgtttctctgcggaggctctgaggaggaatccgattcccagctcattcaggttatgggcagaattcagtcacgctctcagctcctaggcaccgcctgcagttccttgccatgtagaccaccccgtacaccctctcacacttgaatgtctcaggaagagcccaggccattttaagagctcacctgattaggtctggcccacccaggataacctccttatgggaaagtctcctgatcgggaccgtgatacatctgcaacatctatttccacaaataatgtgacgtaatcacaggagggatatctcatcatattcacaggctcttctcacactcagagtgagggggttatacaaggccaaggttagttagggtcaaccttggaattctccccaccacagtttgccctctggcccccagggatccatctgtctcacatacaagatactttcaccccatcccagatttctcatgatattccagcatcacctcaattcctgaagttcatctaaatcttatcagttcaaagtcttgactctcctcatctccaccatctaaatcaggcacggatgatgttcctgggtgtgatccactcagtacaactccgggaacagagtccctctccaactttgggtcggtgacactaaagtgacaagctatcttcctctaacactcccaaaatacagtgatgggagaggcatagggtaacagctgtaaacattctggtttgatgcctggggaggggaagaggaaaggtaggaaggtgttagcattctaaagcagactggaaatccaactgggaaaacaccagaattctctgataaagtttcaaagcctggaacatcctcggcacctctcggtcctgcctgtgggcccttggttcttcctcctgggtcatgtttccttcttcatgaatggtagcaggtgtgtgcagctgagtagtcgtatcagcctgctccctgcccttagcatcttaggggtcccacagcccgtctctcttttcctttgaggccagtgggtctggcatccagtggatccaggatagggatgagacttaaccccctgaaagaacaagacagcctcccacaagaattatctgaccccaaatgtcaatagtcaataatgcagatggtccaggctgacagtatttctgctacctgaagtttctcaagaaccttgtgtgattcatgtggattttactggcattcactgtattacacacaagccgcgtcgcccatttgttcaagatactgccttcttcatttgcggttattgcggagatgatggagagacagcacccttaagcttcccagaggcctgctgatatagttgagacaatctctgaggcacatctttagcttcctgaaaggggttttttgtgggactgaatactctggactgttggccttactgagctctcagcaaacgttgaaccttgaacagccacactctctgagttctccctaggccacacactcagaagcattctcttcatttagcgcccccaaccccacccccacagggattcctctagcatggctcagtccaagtcccaaagcctctgaaccagggaagccgatgtcgtaattctcagtccagagctgaaggtctgaaaacccactgggccactggaataagtcctgaagtcccgcccctccccccccccaacatctacatagcctgaaaatttcccaaatcatcccatccctgttccttttgtttaacatctcttcccacaatttctctttcacctttcactttctatattggcatcaagaagtaagcaggccactccttccgcaatttgcttggaagggtcctcagcaatataataaatataacttcataattttaaagttcagctttccccctttccccattaccgtggaatacaatcctgccaagctctctgccactctctagtgacattcccccttcccatagtttccagcaacatgctcctcactccttctgcagcccttacagtcggaaactttcaagttcacatttgtactagaagtctgtacaccgtgattttggccttctcagaggcaatgtagggtctcccgaaagtcctccttattgttggagagctcccagcagcagatattttaaattccagatttgtactgactgtctgctcaaggcaaccttggtttctctcttaggctccccaaatcctgccaacctccacccactgcctcggccatatatccaagtttgtcgtttatatttttcttctttccacaaaactgtgggcaataatcttgttaaactttcggccactacctagcagggatctccctttctccagtttacaatgacgcgttccttcctccttctgaaccctcatcagcagtgtcctgaaaagtcagacttctactaactgtctgtccatggcaatgaaacctttcccaaggcgatttaggcattctatcttgtgcacttaagaattcttccagccttcgccaactacccagttccaaagccacagtcacacttttaggtgtttgcagtgtgtgatggttaattttacgtgtcaacctgactggaccaaggaatacctagagaactggtaaggcattacttctggctgtgtctgtgagggtattttcagaggagattgtcatgtgagtcagtggactgagtggccaacattcgcccttgacaaaggcaggcatcatccagtcagccaggggcctggagagaacaaaaaaaggaaaagaaaggatttcttcccttccccttccccttctccttccccttccccatccttttccctttctccttccccttccccttcccctctctctctctctctgtctcacagagctaagacactctccctctcctgatcttgaacatcacgacttcagactctctggcactgggactccaggacttacaccagtggcccaatgggttctcaagccttcagcttcggcctgagaattaaaacaccagcttccctgcttttgaggctgcgggacttggactgagccagcctccatcatcacgtgagtcaatccccctaataaatcacctcttgtacatttatatctatcctattggttctgtgtctttggagaaccctgaataatacacagtgtagcaccgcacattcaggtaccaaaacctatactggttttctgttggtgcagaacacattactgcactcttagcagcttaaaccaacactcattagctcacagtcacgtaggtcagaagtctgtgcattgcgtcactggcctctcagctcagggtctcacagggtgggatgctgttagacttgctgtgttcttttctggagtatctggggacgatgcccttgctgacccatccatgttgcagctgaattcagtgccctgcagctagaggactgaggtccccttctcttgctggctgtcagcggggggacagcactcatctcctagaggacacctgcagttccttgtcatgtgccccctccaaacgctttctctgcttcaaatctctcagcaaaaacctagacccttgtaaatgcacatccgattaggtctggcccaccccacataatctccttatcttaaagggcaactgattgtgaccctcattccatctgcaaaatcttcttgccctaaaagtaatataagtctactaaaagcaggcaccctgtagtcccagctactcgggaggctgaggtaggagaatggcgtgagcctgggaggcttagcttgcagtgagctgagatcgtgccactgcactccagcctgggcgacagagcgagactccgcctcaaaaaaaaaagtaatataagcatgggagtaatatcctgtcatatgcacagtttccaccccaactcaatggaaggggactcgaaaattcaagggtcaatgggagtcatcatagaatgctgactaccacacaatccaagaatatatgcaacagaaatgcataagcatcttctccataagtcatgaatgaagacattctcagcatcatcactgatgtgagtcagaaccagaaaacaatctgaaggactcatcacagttgaatcgatcaatagattgtggtatattcatacaacagaccattatacaacaataacacaagcaaacatctctacatgcaccagcatgggtagacctcaaaataagagtattaagcagcaaaacaagccaggcataaaaatgtccatgatttataattctgtttgtgtagggttttaaaacagacaaaaaaataaccacactgacagagatcagaaacctggatactttcaggggtgatgactagatagggacataatacaggtttctggggtgccaccaatgttctatatactactacacatctaaaatcccgaatgttgtgtaaaccaattatttttcctgactcgtttgtccataaaacatgacctgagctgatatgatgttgtttgtagtcttttggggtcttatctttctgggtaaaaatatttacatttctcagtggaaatattgttttatcgggttcagctcactagtccagaccctgccatggttcttatgtaaagtatggtttatgaattctaaaacatttggtcccaagactttcaggtaagggattgtggataggtggtattagaggattttaacataattctgccaacccaacacagatttagtagacaagagctaagaaagactgaacagagcttatcgaagacagattgaattttagcctgtttttttcttttttttccagcaacatttcagatgatatgttttttctccttggacctatcaatataatggactaacaatatatttctaaatatgacatcatcttctcatgagtaaaaaacctaccagatgtgtggtaggttttctacatatcattgctatttatccactgaaactttaggggcacaaaatgaaatttattagtgatagatttcataagtgatatagatccatatttctctctgcgtgtgcatgcctgtgagtgtgtgtgtttgtgtgtgtgtgtgtgtgtgtgtgtgtgtgcgcgcgtgcctgtgtgcccgtgcgcacctggggtcccttgtgcatgtactgtcttttccagattttggtatcaggctactttcagtaaataaatttggaagatttttatctttgtttccagcttctaagtcaatttaatgaggcttatgggtttttattttctaaaaagtatcagatgattgtattcatctctacttgtgtatttgtgagtactttttttccaagctcagatgaaaagaaaacaaaaaaagaacaccattatccgaaaaaggtgtgacaattcaaaatgctgcccacccttggataggcagagaagtataccagaaaggacatgggtgctgatgtcagacacagcttgggagactgtcccagatccaccacttacatagtgtatgactttcagcaagttacttagtctcttttagccttggtttctccatttgtgaaatggggataaggtccccttctacgtcattgcctcctcatgatttggcagaggccgattttaacatcatcgccctggccaattggtgtgtaaagctgctgtgatcctaggcaatgcatgcctagtgaggaggtaatactgacagctgacatcaaccagcaagcaagaggtaataacagttttagaaattgtatgcatttgagggcatttatttaaccttcaaattatgtttacaatttctgtgcattccttcatgcaaaatttctagacaatttctacataaaatgcactgtccattatttaattttctcaaatcgtatatatataaaatatattatatataatatataatatataatatataatatattatatataatatataatatatatttaatatataatatatataatatataatatataatatataaattatatataatatataatatatttaatatataatatataatatataatatataatatataatatataatatatataatatattatataatatatattatatataatatatataatatataatatataatataatatatatattatatatatataggattttaagagttaaacagtcataccttttagtaattacattactaaacaatgtaatagtaatttgcattcaatgagaacagaagtcatttggttctgaaaacctcccacccccaccacacacacctacttctcctgctggctccctgcgacaactactttcaactgtcatcggcttctcctaggacttggcaagatatttgcaagccatagacttattctgattgtgacatgtttcaaaaatggccacaaatgagacttccactttcagctctatgtgtaaatagacaaatgaccaatcccatccttacaacaagaaaatgctggaaaatggattcaggtatcttttggactcatcagagaaccaagaggggacagcaagacaccaccctggaatcttgagagactgtcaaatccagtgtcacagctgagatctgcttacctgaatcagcagcttctgcagacagaagcctgtaggagtgcttcagtagtaaatacgatgaagtgcttgaggctgtgtgtggactggcattagtgtgagaatacgctgggggcccgcagtctcaggggcatccacatgttcatggcctttggctcaacacatgggttttcatggtgaagatctgaaaaagatgccgtggtttttctggctgggagagaggaagagtaatcgttgtcaaatactcccagtgccttctccaagacaaaggcccagtcttcagagcaaaagacttgaccaaagccttatcttaggtgcaggaagggtattcctccatcgtctgcccctccaggcttccagtgtcacctgtgggggaaaaacaaatcaagagggctcaagtgggtaaaggtattatttgggaatgctgaagccagggaaaggaccacggacatggggagagggtaataccactggagaaacacttgtcaaggtcacagcccagagacacagtcccattgaaaggcagagatccagtcataaagctgtggaatgctttcctgcccctacaccttaccaccactacaaccaggctccagggaaataacggcgggttacaactgaacgtgctgcaagacacaggctctccctgagcaggagcactctgttagcctcagattcaagtgggaggacaaagggagagagagatgggaattctcagaaagaattaaaaggaaatactagaaatcaaaaacactaacagaaatgacgaatgtcttccagaagctcatcagtagagtcagcacaacaaaggtaagaattggaaagcatgctgaaaggtcagaggacaacagacactttccaaaacggaatgcaaagaggaaaaagaacatcttactgtgtgaaaattgcaaaaggttcgacctattaatctgaatcccagacagagaaagaagacagagagaacagagcagaataaacgttggaagcaataagggcctagcgctgtcaaaattaataacagacaccaaagcacagagtcaggaatctctcagcatatatcaagcagcatatataccaaatacacacacacacacacacacacacacacacacacacacacacaacacaaactcacgtctagacatagtgaaactgcagaaaactaaagaggaagagaaagtctgaaaacctcaataaaaacaccttactggtagaggaacatggaagaaaattatggccaacttctcgtcagaacccacgaaaaaagaagagcgtagactgaaatactaaagtgttgagtgaagaaaaatatcacctagctagaattgtatgtcctgcaaaattatcattagcaagtgaacaggaaacaaagactttctcagacaaattaaaatcaagcaaattaaccttcagaaactctgctctgggagaaatgttaaaaggcagaaggaaaataagatagatgagacacttgaatctacataaaggcagggccagaatcagtgaaggaacaagtggaggtaaaatcgcaccttttctgttgcttattcttgcaaggtctaaaggaacacggtttgtttaaaataatactgacaatgtatttggtgactatatagcatacggataagttcatgaggggttaattgggaattctgtcgggttaggtagctgcactgcacattaagtgatgtactgttactggacggtggactgggataggtaaatatgtacattgtaaagcctagggcaaaaagcagttctaaaagccatatgatccatatgctaagagaggctaccaatgcccaggtaaaacctgaagagacaacaacataaagaaagagggactttttgcttacaggggatatggttatctatgtagaaaactccaaagaattgcaacaaactgctgaattaataaatgaggttctcaaggtcacaggacacaatcgatatattgatgatgactgtttagctgtatatgactagtgaacaatgagaatttgatttttttaaagggcaacttaagtacctattaagtacttaggtctaaatctaaatgtcaggcataggatctgcttgcagagactacaaatattgatgaggaaagaaaaaacaaagaagatctgaataagtggagagagatgtcatatatacggactggaagatttgtaattgttagaagatttcaaatcctctgagactgatctattgtaacatcagaatcccaatcaaaattacagcattcactttgtagatatcaacatattgactcgaaatttcgtactgaagcacaaatgtgctagaatagaaaagccattctaaaaaaaggagaatggagttgcaaaagtcataagatgcgattctaagacctactataaaactacagtaatcaagacagggtggcatttactaagaatacacacacagttcaatgcaacagactagcaagcccaataatcgaactgcagaaatatttctcaactgatccttgacaaaggcacgtgcacaatacaatgggaaaaggatagccttttcagtaaatggtggtgagagatttcgggcccatatggaaaaaacattaacctagaccaagaacttacactttaacaaaaattaactcaaaaaggaccaaagtcccgtatgtaaaattcaaattataaagcacatgaaatataaaaatataaattataggccaggcgcggtggctcacgcctgtaatcccagcactttgggaggctgaggcaggtggatcacgaggtcaatcattcgagaacaacctggccaacatagtgaaaccccgtctctactaaaactacaaaaagaaattagccgggcatggtggcagacgcctgtaatcccagcttctcgggaggctgaggcaggagaatcgcttgaacctgggagtcagaggttgcagtgagccgagatcgcgccactgcactccagcctggacgataggacgagactctgtctcaaaacaaaacaaaacaaaacaaaacaagcaaacaaacaatatatataaaataaaaaaagaaatatagaaatataaaacacagggaagaaaacacaggaaaaacatcaacatgtctttgtgtttcctgatggggttttagtcacaaaccctaccacagagtctgtgaacaaaaagcaattatttggagtttgttaaaacttaaaacttctgctgtgtggaagacattactgttaaggaagaaagataacctaaggactgaaagaaaatattttcaaagagatatctgagaaaagacttgattccaaatattcaaaaaactgtggacattcaaaaaccaaacaaccacaaataacccaatttaaaaatgagctaaaggtctgagcagacacctcaccaaagatttggaagtgataaatgagcatgtgaaagaatgtttactgttatttggcattgatagataaatgcaaactcaaataataattacatgacactacacatctaacagaacggccaagacccccaaactgacaaaccaactgctgccaaggatgcagaacaggaacgtccattcatgtaaagtgggaagtctctatcttccagcaaatttggaagagagtctgcttggtccttaacaaggctcaatagtcttgccacactggtggtccagcattctcgctattaagtgtttgcccagtttgcttcaaaacgtacgtgttgtcaaacaaaatacaaatccaggattagtaaagagaaactttattcaaaaggatgagtagaaggaggcaagctatgtggaggggacttttacaggaggacatgagtaggtaaagcacaggtaatgctttagggcagtgaaaccatcatgtgcgttatagacagaatgtttgcttcccgcccaaattcacgtgttgaagtcccgactcccagtgtgatggtatttgcaagtgaggcctctgggaggtaatggggtttgaggttatgaggtcatgagggtggagtctttatgatagggttcgtgtcctccgaagaagaggaaataaaaatagctgtctctgtgtgaggacagggtgagataccctaatgatggttgtatgagacaaagcatttgtcagaatccgtggaaactgacaggacacagaatgaaacttaacgtgtttaatcttttaagacatcattagggaggtagggaactatcaggttgaaatgcagaatgtgacaaaaggttctaaccttaccaatgaatgaaaagcttcactgaaggctgtgaagtacaaagtgctgatctaagcaactttggaaatgaaagaagtgtgtaaggctaaagacaaaggcaattgtacatatgcagcatactcgactagacaaacctgttgccggtatggacacaggttgaaaaatctgacaccgttctccatgtgtactggaactgcaatgagtaaatggatggtggagggtgagaggcaggtttttcactgctggagagggaggtgcagatcgtaatgtggcaggggcaagaatgattcgtgctgcaatggaatagagttgcagacatgggtaggaactcatattcagcttattatagatcctcatggtcatgtatcaaaatatttatagaaatgtgtacatacgtgggttagtatacatacatacgtatttcctttctgcttcagcagagagggcctaggaaccactagactctggcagctacgagcacacctagttgccagacgttggtctctgataccattttctaataaaaggaaacagaaatccttggagaattggctgatcctaggagctagtaaataggccagaccagcctagaacatatgcaagacagaaatgtgcaggatgagccacaaagcaaggaattacacaaaatggagccccaaataatgggagcataccaacgggacctaggggtgaactgaacgtgcacccagtggccacaactgcaagaatgataataatgaaaaagaaatagcaaagtattggattataatctaaagtatcaagtaaatatccgtgaaagtatcatgatatacataaacgattgaataaggaaataaatgcaggagcatagatagctgtgccatgaaggagaattccaaagaatgtatgtagatactctgcctcaaagaaaggatttaaaacttagcaccagttaggtgtgaacttcgcttaatgacttccttccaaagagtagcatgtggacaggggttaaaagagcaacttttcatgggagcaccctgtccaacactgcttctgccaggtgaccaaggtcaacttacacaatcaaaactgatgttgatattatgtacccttgatgcgatcagacgaaaacagctctttacctttgtggtgattctccggtagctcacaacatcagtctaatcatgagacaagcattagaaaaacttgagttgaaaaatattctagggaggccggtgcaggcagatcacttgagtccaggagttcaagaccagcctgggcaacatggcaaaaccttgtctctacaaaacacacacacacacacacacacacacacacacacacacacacacacacacacacaagtcacaaattagccgggcatagtggcgcatgcctgtagtcccatgtactttgggaagcaaggaaccctgtctcaaaaaaaaaaaaaaaaaaaaaagaaaaagaaaaagaaaaaaaaaaagatattctagaaaatacctcactagtgaccctgaaaactctcaaggtcatggaaacaagcaaagtctgagaagttgtcccagccaagaggaacctaaggcagtatgatgattaaatgtagtgtggtaggctgcatggtatcttggaacagaaaaaaaaaatgatattaggtaggaagtaagtaggaaacctggaataaagtgtggactttagtttttttctgcctctcaaataccaccagtagggagcagttggggctgctgtgtcggcaggtaagccaaacacacaaaaatagcaccgcaaatgctctgaaaataaactttttaaaaatcccagaacctaaaaatggacaccagaatctacatgctaaacctaaagaaagtagctgacttctaacatcaaatatttgtctcctgtccagagactcctaaagtaacaagcaaaatacattgtatgccatagagcatagcccaccatgtgaagaaccaggaataacacagcttgaatgaggaaatagaatccagtggtaccaacatagagacgacgcagatgttgccattatctgacaaacattttacagcaaccatcataaaaatgcttcattatgtaattgcaaatagtctggaaccagactagaaaatggaaaatctcagcaatgagtagaagatgtataaaaaagaaatgatggaacagaaaacgaaaacaataacagaatttggaaacattgctggatgcactcggtaagagacctgtgatgacaaaagataccatcatcgtaatggaggcccaatcaataagattgacggccgggcatggtggcttacacctgtaatcccagcactttgggaggccaaggcgggcagatcaccgcgggccaacgtggggaaaccctgtctctactaaaaatacaaaaattagcttggcgtggtggtgggcgcctgtaatcccagctacttgggaggctgaggcaggagaatcgtttgaacccgggaggcagaggttgcagtgaacggagattgcgccattgcactccaacctaggtgacagagcgagactcttcctcaagaaacaaaacaaacaaacagaaaataggactgactgtgcctgagcgagagagagagatcgtggactgattaaaagctgaatggatcctcagcgaagttaggacaataacaaagttccaatatccctacgactggagtaccaaaagtagagagtggactgaaagaggagtataagaaaagaaggctgaaaatatccaaattttagtgaaaaccataaacccatagattctggaaaacgagcaaacttcagataagacaaccacaaagcgattcacaccaacacacacatcatagtcagtttttgaagctgataaaatcactgaaagcagcaagaccgaagtggttcattgattataggagaacaccagttttaatgagggcaaatgtctcctctgaccagtggcggtcatcaggaagtgtcccgaaaagtttcagatgttgaacaaaagtcctgtcagctgtgaattttgtatccagtgataccatccttcatggacgaaggggaaatcaagacattctcaggtaaaggaaagcattttgtcacgagcagacccacggtgaaagaatggctagagtaggtgcttgaaacaaaagaggaaagaataaaagatggcctctggaagtatctatcagaaaggagtcaagaccagtagaaaaaacacccttaggggacaaacactaagccaccgttttccttgtgaattgtggaagtcatgtttgacgattaaagcaaaaactatgaaaccatccgatactccagacaacgttgtctacaagcaggaaggcagaggggctaaaaggggctgatgcttctacacttcaatggaagtgatgagaactggataccaggagcctgtggtaagtcacatatgcacactgaaaatcccagagcaaccactgagacaattttacaaagccaaacactcgaaaacactttcggaaatcaggataaatcctgcaaggtgtacacgtaagccacagaagggcaaaaaaaggaggtctcggttagccgagacacggaggaaacaaaagaaaacaaacaataaatctgtggacctaaacactagcccagagatcatggaaatgaactagaaacatgtatgaaaaggtagatactggcagagtcagtgagaaacacggtctgattatcccatgtttatatgaaactcagttccacttcggtcgccctgggtaaatgaaaaggatacaacgggtgggaaaagtcacatcaggtaaacattaattaaaacagcagaagtaggtatgtcaacattaggtaaagaggacttcatcgcaacgaaaattacaagaaaaataaaacgctacagccgaataaaagaatcaagcccccaagaagactttagaagagtctttccgtgcccctcccacacgcccctccaattacagtgtgtgggcgttcctctctgttcccagagcccctggttcttatttctgtcagagcaaagtgtcccaaggtgttggggactgtatttgcatacacctgatcctaaatgaatgtgagtgctttggaaagcctgatgcatctccacatcccagcgcccaggtgagggtatctggtgcccggcaggtgtttgctgaacgcctcatgactgcctttcaggccagcgaaggctgttgtgatagggtcaagggaagggtctctttacatcgcattcaacaaggggccaatcctgctggcgcaggcaaggaggctgctcagcgactgacggggaaatgagggtggggtgtgggcacgcgctccggaggctgcaggcgccatgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccggacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaa

SEQ ID NO: 1412 - DNA, 501 bp, Homo sapiens
gagagccaaacccagcaaacatcatgtcagagaaaaagaactgtaagaactcgtctacaaataacaaccagactcaagacccttctagaaatgagctacaggtccctaggagcttcgtggaccgcgttgtgcaagatgaacgagacgtccaaagccagagttcctccacaataaataccctccttaccttgctcgattgccttgctgactacatcatggagcgggtaggcttggaggccagcaacaatggcagtatgcgcaacacttcacaagatagggagagagaagtggacaacaaccgtgagccccacagcgctgagagtgatgtgactcgctttttgtttgatgagatgcccaaatccaggaagaatgactgaagactgggtcccagagccttgaagggaacctcacaggcttagccagggcaaaaatgtgtcacagctgaggaatatctgctgttgtcatcaacaagtgctattaaaggatgtaaatccatgagta

SEQ ID NO: 1413 - DNA, 6302 bp, Homo sapiens
tcatctacaacacatttatttgtacaatccagaaactagcaggaccaaaattagcagcaatgctgagacatttactggcagctttgccttctaccctaaggtcaaagtacttgagacattgcctgtgtgcctaaggaggcatcacacaaggaaagccccaccccctacttccttcatctgagcaaaggaacctgtttacatgcacagtgcttagtgggtgggactctccaaagcagtggaaattcatctttaacctaatttatacaggtctgcgtcacgatggcaaattgaaggtgccatgatttagctggtttctctggaacattcctttcaggagcccacacttgtcacacttcatgccccaaagggatcaggtgctctgggatgtctacctggaatacatccttgcctcctttcctaggtatgggctccagtaaccacctggggtttgaaatcacagtcaggtacttctgcttcaggttggtcagtgcagcttgattttctagttccacaacctcatcgggagttaagtcttcggggcattgcaaagtttccccaatgtcaacgagtcctgtacacaaagagagatacacatgaatgcctttcacttccatagcccaaggcctgcccatgtgacaacacagttactcaaagtcacaatcaatagagagtaagacagcatcagcaaaatgacaagaagggagtcaagtccttcttccgtagctttgataacgaaccaaacccgattcaggaaacgctgggagaggcagggggagggctccagaaaggcagaggagagggccttgtcctcatgaagccacacaagtaagaggcaggtccaagccagacttctgagagcagcggttgcagattggaagggcaccagccactgcctgggaagctacaggtgatgcctgagcaggtcaccaggggacagatgctgatgtcgggcctcagtcacctagaggttaggggactttcccagggtgctgtgagtggtggggctggggcaggttcatgaagccaggcgggcagcccaactctagaggccacctgacccattcggcgggctgggctgcttttcatggtctctgccacacatgtgcactcacacatgtatgtgcaaatacacacagccaaacaccacaaacaccatgtgcacatggccctgaccaggcttctcactgagatcagaaacagaactgcggcccagagtggagaaatgatttaccagagcttgcggaagccagccataccaacccccagcccaaggtccttgccgcccctttgaaggtgtgttgccaaaggaaactgtgttatacacgccaatcagttcagatgacaagagaagcccccaaattcccaagcaagatcttgggcagcagccctaggcgttgtctgcgcatttggtacattgtcacttacccgctatcactcctcgaccaaacttttcccctttcctgagcaaggcctgaatctgagcaggagtcatcccgagtctctccaccagcagctcccgacaggcatcgccttcccagtccctgtgagcaatgtggacggcgatggtacagttccgctggctgctcagcagaggacgccagcgcgtctccacagtcttgattccatttaagacaaagccagcataaggctgccggaaggagaggcagccaaacttcatcttcgcaagcgccccgggcctcccgtagcctgcggaagcacagaagcgcatcacacgccagcccttcaagctcatgggcagtggcctgaccttccccccgtgtctctcaggtggcctaaatcgcactgaccttgatggtctgctgcttccgtctgtcactgatgtcgagcaccacagcaggcccaagggaaggggctaggattcggctgactcaggtccatcccatggagtctttggggcggtccggagtagggcggggacagctagaggaaggcacaggcaggatagcatgtggtcagtgctatgacagaggtcaccgagccctagggcaacacagaggacagagggccccctcggcctagccagagcggagagtcggggctggtgttagccctcttccagcacagagggacagtcccacgctctgcttctcttccctttcccctgctgtgccctgccaatactctcagtgccctggccctgccgccaccaaggcactgaccttcccagctcctactccagggctgctgagcccacatcgttgatatccaatctcagctctgtcctcaggatgcaccgtgacctcagatggccctcagtcagacatctcctctccacccctctgggtgccaccttcctcaagccccttcccccaccactgctctccactgtcagcagacgcccctgtcccaatctgagctgagaaaagaagaatgataatcagaacaactggcaaccccccacacatgccttccacgtgccagcctctgggatggcatgatcttcagatcatcaaattgaatcttcaagtaacccagcagggtcagtggtactgtgaggcccactctatggctgaggagaatgaggcaccagcccacagtcacacgggctctgacttcccacaactcttgcccagcctcctgcgtgtgtggcttgggagagggtcccctcctcttgcacggaggacagccctgtgccttggaaggaaccctgggcttgaaaccagaacctcagcccagtcatagactcttgagatgcctcagtttccacatggctgtgaggaagggagataaggcaccaagagcacccagcccagtacgtggcacctaacagaacagtcagaaatagtggccgccctcacccctcaggcccgtggccccgccccctggccctgaactccacccttgagctgcccctactcctctctctgtccttcctttcaacacataaacgcaacctctagtacgctctatgattttaagaaaatatacccaccctcatgagacaaagccctgatagggccaaagctgcctggtattcactcctttcccagtctgcactgcagccttctgagctccagatctcctgcttttctcccgcctctggggtgagctgcctcagctgagccggttgcctgctgtgctctggaccctgctcctctggctcactccgggccctgggtgccaccagccaccatctatgctcgctcagcatccctactctgagcacacgcgcgcctcccactctgcctcccttctctacaaccctgaacagccgagacctcagaagagctgtctacatgcgcagtctctacttcctctctgaaccttctgcccccacccccacctttctccctttattccccaccccccccaccacccactccactgactgacctatccccacaagcacccatggccggcctcatgccagtcctgtcttcatcttagtccatgctcagcagccccagcatggctgggcacactccttcccttcttctgggacccccatgttgctcaccgtcctgctctgaatcccgtggtgcaggccaccccccttcagactcagccttaggtggacaggcccatacatactcaggaccccaaccatcaccaccaagtccacctcccttccacctctgtgagtggcatcaccagctacagtgttcctgccccagacctagctgctctctgcactgcctttctttcccacatctgcggcccacatcccgtggcactgtgtccaaaaccgacactgaatctgatccctttccataatctctatggccacaatcccaatccaatcccctaaaaccccctgccttctgaagaagtctcctgatagcacccccacccccccccagcacttgtcctctgcactcttgtgaccacactgccatcggaatgatcttggtacagggacaatgagattatgtcactcctctactgaaacctttcaagggctccctgccccaactagcacagaatccacacttcctctcagggcactcaaggtccctcctgatctggtttcccaccccagccacgtcctctcctctcccctttattcaccaccctgaagccacacaggccttccatcccctgagggaacatgccaagcttgtttctacctcagagcctttgtcagttgtgatgggttgcattgtgtcctcttaaaatgcgtatgttgaagtcctaaaccccagcacctcaaaatgtggccttatatataaaaacagagtcattacagaggcaatcaagtgagactgaagccatcagggcggacccgcatccaatgtggctggcgtccttatgaaaagggggatttgagagacagtcacgcacacagggagaacaccatgagaagataaacgcagagataagggagatgcttctacaagctaatgagtgccaaagattgccggccagccgcctgcagctaagagaaagggacagaccagattgtctttcacagcccacagaacaaacgaacctggccaccactttgatttcagacttccatcctccagaactgcgagacaatgattgtctgttctttaagccagcccctttatggtcctttgtttcagccatcttggcaaactgctgttcccaacacatctgcacaggctagggcacgagtttgccatttgacagcacatcaagcccattctttccacctgacaatcttcatctaccttgtttttcactgcctgggtgatatcccattgttggtcgtctcataatttgcctgaccattcctccactgatggagagttacaagttgcttcccacttttgccactagaaatgacattacttctaacactcgctgtgtgaagacatgctgaaggaaatgcctcggccgcctggcacgcccatctaagatgctgatatctgccagcaaatgactttccacaaagactcacccgtgtaccctccaccaacccatccatggtgccatttcctcacacacttgtggcccctgagcatgattattcttctgatgagtgaccaaagataaccaggttccttggttctggattacttctgacggaggctgaatgtcccccacagggcctggccacttccatcgggataaatggctacagtgaatgtttgcctcttttctgccgcccagtttcttagccaacccttttctcgtcatcaccacaaaatcacaacaactgtgtgtgtgtggaatccctagtaggaactgatgtaactgaaaaggcaagaagggggttgagtcccctcctacctggtgctgcagagagtacctgctttacggccagaggaggaaacactcttccacttggtttctttacctgcacaacaaggaagataaagaggaaaggtcattaaatgcaagtcagcaaagctggttaatggccctaggaaggtcttctactcagcaggcattggaaaccaagagctgggagggccggtcctaagagtaacacatgtgcacctcactcacggtttggttctgctaatcagagcggtgggaccctccacatctgtctgggtcacagggtgcaccagtccgcagagcagaaaatcatttcagcaagttgagtcacattcctacagctgagcacgctccatccgaggggagaaaaatcacacttcccctcccattgtcatcggacgagggtttggggggcctaaatcccattgtccactgcttaattctggttaggtcatgctgagcacggggccacaggccacagagctatgcaccgcccggcctggggtccaggcgagcttacagcacaggggccaagcgggaggcagggaagaccgggccgagatggggccgctgtgtgtggagcagcacttgcagacgcaggtcgcgggtacacgcgcttagaaggaggggggccgagaccatggggagagcaagggacaccaaagggcgcttcgggcgcgccccgcacgggttctctgcccgaaacccaggggaaagaaaccccagcccgcaagtaccgtctgcaagagggccgagcacacgggctccggcatcaggggccctggtacctttcagccgcggccggtctcacggcctctggaccctgagagtcgtgggcgttcagggccgactctggcttttggcctcagagtacagtcctccgcctcctcgcgacccagcgaggccaccggagccagcgaggagacgtgggccgcggtgagaagagagagcacccggctcgtgtcagggctgtaaggtagctgccgcttactcccggaaaccggtggccagtgacagatgctagcggtccataacttcggctttcatgcagctcccgtcgtccctttcatgaggaacgtacgtgtgcgcgtaat

SEQ ID NO: 1414 - DNA, 43627 bp, Homo sapiens
ttggatatatttctgtttattggccaatatgaaatgtttgcagagcatcataaacaaacatagccctgccagtatctacacatgcatatggctcaagagttaacaaaatttctataaataacccatttatgagaaaaaataattaaaatgtaccaatattcaatgtaaaacactgaagacctagctagtagggtggggttggtagagaggagtgggacaggagggattatgatctcaatgtgacagggctgtatgttgtagaggggtatgctgtagtgctgaatcctttcctaacctggatctgagaatcttggaggaaaaaattattttcccaggctccctcctgtcaaaatccaagtcaaggtatatggagagaaaaacagtaatccaaaaaaaaaaaaattcattctcaggaaatacctccccttccttacaaacaaaaactacattttttttttttgctagttcatttagagacaacttaactgctgtttaggctcaatgtatgttgaaaatgtttttatcaagtgtactttgttcttccactgaccaataacccctttgtagaaagacacataaaagcacagtgctcaaagaaatatgcctcagcattgaaaagtaaaactgtaaaaagaactctcctgaagcaaatactcaactatggtatttgccatggccaaacagaaattataaagacgaaaatccttcacttcacctttacccgaaatactttaaaatgcaaagccaattgccacctccaattgctgaacctcaaaaagttggaattaaggtgattctgggtatggcttgggctgtccacatagcattcatgccatgagcaagcacactgaagaagtcttactctttcactttatcatatttttgttattattattattattactgtgttaccatcattatctttcctctagagcagcagtgtcaaatgtgggcttgaaccactgccagccacatggcaacctttgaacacctgcagcctgctgaagccaaatcatcccctgtctggatattatttcttctaccagaaggtctaaacatgatcagtgaaagccagtgagataagaataacctgttgcagaaaaacaaaaacaaaaacaaaaacaaaaaaaaaacaggaaacctaaaggccaaggcctaaaaccttggttaccacatatttgctaatacctgtgtggggccaggctgcttgcttggtacaggcttgtatttcaattgcttctaatcctcagtccagtacaatgggacctttttgctttttcccaagtccttttagtaatctgatcaattggttgccccaggggcccttaatcagtgtttgtagatggatgaacccaaaagatgtagttaataaaattctaaaagcaaaaatcttgctgtagacagcactcctttgccagagctagaacctggtgatgaagtgcacattctgcctaatgtacttaataaaccacttaatagttgtgggacaggaactagctgtacaagtttcagacagattcttggagaataaagaatacaacctctaaggaacttgtttttctctgagcatgagatgtataggtgggagctaaaggcaaaaagacaattgagaaagaatcaaaggggaacggtggtgagaaagctgggattgaattgacatttcaatagaaagaggcatactcagatgtccctacatggattgagggctgtctttgagggactgctgtggggtagtttggggaactcaggccccagaaggaagattactttggctcagaaatgttctgtaaggttccaaaatggcgaacttcagcccttctccctgctgagggtggtgagaacctcaaatacagggtgaggccccagggatctagagggaaagtgtttgccctgcctcatgctgcaatgcagcagtctgagacatgaacttgggaattatggcacgaggcctcccccaagatagatattaatgtgtgtgtgtgtgtttgtgtgtctatgtatatgtgtgtgtatgtgtgtgtgtgtgtgttgaggagggagacagtgtggaggagctaaaaggggagaagggtttgattttgtccctaaagtgctaggtagatgtgccaacacaattttgagaggcttacctgaccaaaaatgcagacatgaaaaccctaccccattcactgtcctctctcctcttctctataatcaagttgagctaggaacatgtctggtagtcccatgaatgtggaatctggctccccagactacaaaagggaagcaagaaatgctccagatcagtccttgtgaaatggagaatcaatcctctggtgggatgggataggatatgccccatctgtagggtattagctcttgtggacatcacatttcaggcccctgctgctgttgtggtataggaacagagtccagagagaacaactgggcaaggctgccaggggcccaagagacctaaggagagagcaaaccaagttagaaacatgtggggaaatctcactagcacccttctttctctacccctccaaatatcataggttaagccaatggttgaggatgtaatagcagaaagacattacctagatagggatatgacaattctaccctattctacattgttgaaaccatttatcctgaagataggtttagttctaagctccacatactttagaagaacctaaagtggtattctccagagaggtggtgttgtcttcaagcctctgcagggctatcttaaagcagaggaaactgatgaggtctgtctggcacgaggaacagagccaggatggataggcgggtactacagggaaagctctttcttacattgagctcaaacccaccagtcacaattgtgtatactgtaatatacattgagaagtagtcagccctctgccacctaaagtatgtgagcaaggactacacaaactcttagtggggatattataaaatggacccaaaccttggaagaagaactggactagataaccttgaaggtacctaagttgattgatttgacatcagttataactttcaaatttgatatcagttatgactttcaaatatacatttgttcacgttttcttaggttggatgcagggagcagggaagtcattgggagaactgaaaatgtattaactgaagaaatacggaagtgggcactgcaagatatttggttagttgaaaactgggaatctacctactctcctacctcatgctacataagctttgagaaagtaacattggctatcaaatggttgcaatggtggagttgaaccaactctaaaatgtagcccccaaacctgggttcttgcacagttctagcccactaatttgccctgtgactttgagaaactaactttccctctctgtgtctcagttcctgcctctgtaaaatgtaaaatgaagtgacatacacacaaggtttgtatagttattagggaatgaaggttgatttgaaatgtagggtttccagatgacaaggcttgtatatctttttctactgtgctatgctgcttgcacacataaagggagatacctgaatatgaccattagatagtggggccctgagagagcttacgaaagaccagaatggagagactggtatcatgacaaccttgccagttccctgacaattgtagacccagaagtgtgatatctgtctggcttaaaagtttagcatcaccactgttgcccctccacccaaagtgttcctagcttgctgctgttcctccactcctagtgaataatactattccaaaagagaattccttgaggttagtccttaatttctgttttgctttttttgtttttttctgatccacctttccagctcacctcattagagttaagggctgggaacttcaaagggcacattgagctccagcctgtctccagtgctttcgactgtgtttccccccaaggtctcagctccagtataggaggcagagctggaaaacttttgcaggtccagctctgtgcattcgatggggctgtggacccagtgggagtggctctctgaggtgcaggaggccatggtaaaggactcctgtgtggggaagccactagtcgagctgcagtcgtcctcgaggatagggttaagtggctgggtctgaaagatgttctcactcacttgggactcagcactggtctccttgctgggtggcacggggaagagagattcctcctttgctgttttatcagcctcaaactgcagcaaacctcctgcaactcgaagcagaaagccactgggttacccaaaagcaggggctcttctcagctgggcactgggtactgagtacaagacaggtaaaggtctgggagctgattctttccttcctctccctggggtctagagcacctagcaccaggctgaggtgacacagttgagaaacatacttacattcaggtatcagattgaggctagctggtactggatcagagaaaataatcaatttctctagagaaaaagaaacctttgtgggaaacaggattttgataccatctcccttgccataatcttcatggcctggtcttatgtctatgtacattaagttacatggcaaactagactctgcagatggaattaaagttatggatttcaaaataaggagagaatcctggattactctatgggtccaatgtaatcctgtgtccctaaaagcagaagaggaaggcagaggagacagagagtatcagagagatgtggcatgagaagaactcaactcatcattgctagttttgaaaatagaagggggccatgagccaaagaatgtaagtggtcctagaggctaggaatgaccttcagcttacagccagcaaggaaatgggacctaagtcctttaactgcatagacctgaattctgccacttttgtgcatgatcaagcagattctctcccagagactccagaaagaaacacagccctgccaatatcttaattttggcattgtgagactctaagcagagacaaaattgagcctactgaacttctgagctatggaaactgtgataataagctactaaatgtgtggcaatttgttatggccatgatagaaaagtaatacccccttcatgcatggatctggttcaacatcaggtcacaaactgagaacctatgggatttgtgtttgtcctctttgctttggttgtgattttgctctttattcaaattcattgactatggttaacacaacttcattaaaaaaaatccagatttctgaattctcttgaaaatgtagaagatcttgcaacattaaatatttccatatggttacaaacagctggatccaagtagtgggattcccctttagataagggatgtgctctgtagtttgccacagttgcacttttctctcttgcaaccttacactggatttaattcgcacatacatctcaccccagtatgtgtgtaagtcagtgactcctgaaaaacagttttccaaagtaagaaaatgtctagccttcctagcccttataaaaacagtgaggaaactgcctgccctcatattccaagcaggttaccacattattatcttcaggatagaaggagagcagaaaagggttacccatctctcttcttctgaggcagctctctgatattttctcattttcatcttctggaccctggagtccaaatgcttcattgctcatgtttcatgtccatgcacccagggcctaagcaacaactcttatctgggacactggcctccaaagtcagagacaggaaggtctaccttgagtcacagtgtcccaggagctagcaagaagtagactttgagaaaaatcataaaggaacaacagtgttccccgtgtatcctgcagcccatgaaatgctatattcatctccaattaagccagggcacaaccaaacatacctcttgggcttttcaagatcatctgctaggccccagagccaaactgacccaaggcaaatttacattagcaggatcttcccacacaaatactgcagctttgcacacagtatccagtgggctgaaaaggagtcctgagcactcttttatctagtaaactttatcttcccccttataaatcaacttcattctctgatctgagttcctgtttcagtgtccctgcctaactctcagttcccttaatggcaatgaagctgcactgaaccttggtactcttggctggagttctaactctttgcctggtcctgatcagccacattcccacctcccccatctttgtcctcagtgagctggcttttctgtcccacattcttgtctagtagctgaagttgtgcttaatagagatcacaatgttactgtgactttaaatatgattttccatctggaattttgcatggctgtctgatatggactgggctagacctcttgacatcagtattatctgagggagaaagtccaggtttgccaactactctggacatagggctttcagttatccccatttgtgaagttattatactgatagcagtggccttagacctcaaccacttttattacagtcgtatctcagatatagccaagccttcctcaattcatgacatgctctagaatttatacctactagtatagatataaagaattggaaaagaacccagaaatcaacaaatccaatcctatctcttatcttaaagattaggaagaaagaggtctgaagaggctagatgacttgtctaaggttacacggtgatttagaggtagacatagaacctaggtctcccgattcctttcctgaggggtttcccaccgtgccacattcctttaaaatcccctgaaacataatgaaccaggtcttctaaactctcagggttggcttcagtaatctcttaagtcccatgctttccattgcagccccagatagttccccaggccaacagaagactattcatggggttttcaagcatggtagaaaaggcccattgtctctcaaccccagaacatccctctcttctgccaataagagccttgttcctgattcatgtgaaacatgaaacagccacccttaccacgctggcaatgtctgttgaagaactgcttgcagtagaggaagaagagccccaggaaggccagggtaaacaccactagcaggctgctcaccagtgcaacaagtgtggcctcctgagggggcactgtgggtgtatctgcctccactaagctcaactggaaggcacctgtgagacaaaaaaatgggggaggtcagttagcatgggcagtaaacagtcaccctgaccctggacctggacttcctcaggctgtcacccttctccctagggccttccccaattagggtggctatgctggttttacttctttctagagcaggcaaaattataaagaacaaggcaaaataatttgtatatagtgctggtatgtagaaattagtacaattaatcgaagatgcacatatcctgtgatctttctgtgccacatctaattatataatccagatcaatggaaacaagctaaaaaattcatcagtagagcacaagataaacaaatcatgatataatcctaaaatcttacattattatacagcacttaaaggcctttatggatcaatataaataatctagagggggaaaaaggaagttggagaaacagaacatatagcttgatatcatttctataaaacattatacaatacataacaatagcatatattggttatgaatatgcacacatatcacaaaagaacccaagtattaaaacattagtggagagtatggcagaggtatagtgctcaccagttatccacatactcccatgtatttcccttacacccttgcagtaaggccatcagagtacttctggccaatgaactgtgagttgaaataacatgtgtcacttccagactgaggcagttaagaaccagtatgtctcctccatctcttcccctgtgtcattgacctggaagacatatggtctagaatgcacagtcaaatgatgtaggaaggcctttgcatagtaaaaaaaaaataaacttttattgtataaagtcactgagattttgcagtttgtttgttactttagcatagcctaccaacagaatacatacaatttcaggatagtggttgtatctgaggaggtagggaggtaataggactctgagagaatctagaagagaattccattatatctgtggaatctttattcttttaaaacatctgaagcaaatatgcaaaatgctatgatttattaactttggatagatgctgggtgattgcattttaattttatatttttctgcacttaaaaatatttctacatgtttgaaaactttcatgatttaaaaaatatgtcaataattttaaaataggaagtaagtaaatagatggtagacaaaaaagatagacgattagataaatggatagtggtataggcatagattggaccctagttcttcattcagcctcttacaagtcctcagccctaggggctcctatatacttcatataataataatatctcataggtttacaaatattataatttgtgaagtgcttcctaacatccattttctcattagacctagatacccatcacacaaggtatgaagaaaaatgattatcatgactcacccttttttcagaagtaggaaatgaggttcaatgagattgaatgatttgcatagagttgcaaagataatatgttgtaaaaccagacttctaatctgattcccttgccactctactctacatgaaaaggtatgaggggatatgggtagtctttactaccctatcttgctgccacccaatgggatgaggagaaagggaagaagagaactgggtacacacattgaacctcagaggtgggggtctgcttcgtgcacgggatgcactcttggtcctgcaggcctccaatgcgtgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgttcttctggaaagcaagtttttattctatctatagcactggaatcagaagatatgtgcctgactcctcacttactcacttgctagagaagggaatgacaaaagcaagctagcatttattgaaagttaaccaataagttgagtgattgattgattgattaattggttagcactccctttcattttattggttaactcagaaaacatttttgaagcaactacaatgcatgaggatgctattctgaatattgtgactaaataattgaatcaatcagacaaaaatccacacactcatgaatttatatacttgtttattcatcataaaaccttataagggtgcaatataatccatgtttcacaaataagcaaaattgaggcacaaattgttggcctgagaagcctcttccccatgggcctgcgattccccacacacaactagagacaataggctgcagggggcacttgagattccaccataagtaaccagctcaaatgcttctttgtcctgtgggtctgagattattttcccccacataggaacaggtggctggggtatactggcaagtggtatcctactaataacaagtggtcgagcatgggaaatgttctttgactctacaactcagacacttctttatgccgacctaaatggaccaagtgacctggcccaggaaatcgtctatacctgaggcagcacaagataaaccccgcagaccaaaaatcacactacaaaggttctggaaattaaatagcctttagaactgcagctcacaaacgtaggccaaaacctgtatgctaaacataaacagatgactgcctgctaaagtaaaagtttaaataggaccctgagtctcctgacataattgacaaaatgtccagaacacaacgaaaaaccacccatgataataagaataaggaaaatcacaacatgaatgagaaaagtcaattaactgacagcaactcttagataaagcagatgttggaatgattgaacaaggattctaaagcacccataataaaaatgttttaaaaaacaatttaaaattctcttaaaaatagaaaatctcatcaaagaaacagaagttttttttaaataaacagatggtaattattaaaaataaaatgacagaaattttaaaaattcactggatgggcttagtagtagagaagagacagatgatagaatcagtgaacttgaggacagaacaacagaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaacacaaatgaaatgatttaagaaagagtggaagtgataaaagaagaaatcttggagcatcaggaaggaaggaacactgggaaagaaaaaatatggttgtataaaatgtactatctttctcttcatacattttataaatcatagtagatgactaaaacaaatttaacaaaaattatatctgatattcgtgacaatgatatttaaaagtggggaaagtaaaggaatctaaatggaacagatatttcaatacttcacttgaaatggcaaaatgttgataccagctgacattgaaaaagtaacgtgttagtttttcatgtaatactcagaaccacctctaaaaaaatgatacaaagagacacactcaaaaacactacaaataaatcatgatggaatcctaaataaaatgttcatggaacccacaggaaggcaagaaaagacaaatagagggacaaaagaaacagagaaaacaaacacaaaaagaataaaatgttaggtttaaatcttaaaatatcaaagattatttaaacataaatgttctaagtaagccaattaaaagacagggattggcatagtgaaataaaaccaaagactatcaaattgtactcaataaaaattaaataaatgaataatttttaataaattaaggagcaaattatcattaaaaatttattgagaattctccttcataattaggaggcaaaggaagttctttcaaatcattaaggtgcaaaatttcttttgctattaaccacttttatagccagaaaacattgatattcttgattttgccatggtagcacaatgctgatccaaaattttgatgctgatagtgttacaataataattatttgttttagttaaaatactaacttatacaacataaaagggtatttaccttaaaactataatcaagaatggtttatactgggaatgcaggatatttaaattttaggaatttattaatacatgtcatcaaattaatacatcaaagggaaaatatatttacaaatcaacagatgatactaaaatgaaacaaaatttaaaagcatttctggtttttaaatacaaatatacttacattttaaacgatttttaaaatactctgttatctactatatgtctgtctacttaggttccttatgtgagtagacaaagaacaatacataatgaatagaaagaatagaaagagaaacaatcagaaatagatcacaaaattggaaaggcaaatgggcaaataaacacagtaaagttggtacatttcccctatcaaatagataaaaagtaaaaccaaaattctcataaagtcctcataaattagtaattactgttaaaaggaaggcataaaattaatagatcatgaaaatatctattattcatttgcgtttaggcttctgggacatgggaatttgttgtgggaagtcagggaccccgaacagagggccacaacaggaattctatgcactgttgaaaataaatgtaatggtaatagaaattagtataaacaaaattcagaagtgttatctgctgatatatttcaagagtcttaaaatcgtacgcattatttagcttggcaattatacatcaagaaaaatgtcctgaggaaatggtgttaattttctgcaatgatttatttacagtgatgtttataattcatgagtaaaatttaaaagtaaataaaagttactttaaaaaaggctatcagatgcttctagctgcttattcaaacaattgcccctcttcttccttactataaaaacactgatttcattctaggtggcatgaagactagcctccagaacggattcttgattggtcttaatcacacaatcccattctcattggccagatacttatttcccagtctctattccagctaaagatagctacatcacccagttctggaccataagatataaggaaaaatctgttggacagcttctgggaaaagacttcttccctacaaaaggcaagctattttgaccttgcccctgattcctgactttgactattgtatggagatatgatgctttgagttttgcaatcatgaggccacaatgagaacaaaacagcaagatgtccaatatgaaggatgaaaagaggctgagtccttgataacattgctgatctgcccaacaagcaaaaaggttgcctgtctccagacttcattacataaataaatatacttatggttcatgtcatggttaaattttatgttactttcaacttactacatcctaattgattctgaggtgaaataatttgcccagagcaaagatgggactcatgcccatgtgtatctggctctaaagcttatatgtattacacatatataagctttaatatctattttaatgtccagcatgaccttacctctggcgatctttccttggtactgggatcctttatcaaccatgtgggtaccccactgtgggacataatgccatgtgtaaaaacttagaattagtgcttgtatctcttgatatccctgcgccttattctcttcattttttaaaatacaaaggtaggaataaagtgggctagataattattatgttgttttccagccacagattcctataactttccaacccaaaaccctccaaagagctcctaatgcacttagagaaagatgaaaatttctcatagacctcaagctgctatctggtctggtctatacttctctctctgacctctttgtgtactaccctccctctcattcaccatacacccattgcactaccttcctccttttccttcaaaatgcctagttcattttcaccttgggactctgcactagtatcctctccccagaggctgtctccttagggagacctttccttgtttcataatctgaagtagccacccagtcaccctaatttgattcttctcatatcttcatatccagattcttcatttatctctgtatgtgtctcaattattattttttcactaataatagaaggtaaggtccatgaaggcaaatatttttgtttgttctgccatatccatggtgtctacaaccatgcctgccactctgcaagtgttcaataagcaactgctgaataaacaaaaattgcataaaatagagtgtgaatatgcagaaaccatctgctagctgcttgcttctggcctctgtagccccagctgcagccaaaatttaataccacccccaagttcagggacctacaagggacctgaggaaagaacaattaagcagatccaggcttgaaacaagtaagttacataaagtctctgccttgctggtcattttattctgatccttatctttaattgggattttagaccctccgtggttccctatccctatattctccattgcacagcttcctcagtagcgcagaccctctagaacagaggtcttcttggctcttctctctttctcattcctaagacctgatatctggctcttgaacaccatgtggttgggccttgctttagatgacagattaccctaatgctgaacagtcctcatgggtctctgcattacacatctattcttgaaatactctgttatctcatggaaacttcccttgaccttgatcctgctaggctgacttcatgctggaatcatgactgctattgcatactctgtggatcccaggttttacccgctgaactggatcagtcataagtagggctgactcccctaatcttggcctctttcagttgccgggctggttcctaagatgcaacagaaataagtgtactgaataggataacttaccttggatagctcctgtccaggaccacaccgttggcaggtgacacaccgtccccattggtcccagtactcattttcttggcaatccatggtgggaaggctgtgggtagagaacacaagaactagcaagctagtgggaagggactataagtagtggcttccatgccacttggcttctgggtccccttaatctattctctagatctgagatagtagggacgaggaagccaacacaaaagagttaatgcttatgtagctctgaccatgtgccatgagttcttgtaaatgctttgcatgtagtaactcattccattctcaagacaatcatattaagaattattgttagcaacattttacagatgaagaaactgaggcaaagagaccaagcaatttgctcaaattcacagtcagtggctataccaggagctgaatttgtaaagagagtaataagacaaggagttggcttctgcccagggggtaaagaataatcacaatccctcatgtgtgaacagatcataacaatttagaaagtactttcacatctattattatttgatctacacaacatccatgtgaggtaagcattatagagattgtcatctttattttataactgaaaaagctgaaacattgtttctctttgccaacagtggcctcagtacctctgaggaccaatacctgccatagcttctgtcttaggcagaatgggaggggagaataacccagaatgtagacatattttggtgcacaaaggtgcacagatagggaaacattactcagataatagttcttggaatacagatgcatatagcagtagagctagcattgaagtgggatggctgttcaccaagcctggctcttaccctttcaatctacaatctgggatggatcactttatcttttctggcctcggttacttaatctaagaaaaagggatagaatgttcttcacctattgtatatagctcttgggagggttaaaggagctaaggtccatcaaaccattctaaagagctatacaaaataagacagagttaagtatgcagaaaggttgtcttctacaaagaggaattttaatgaaggggctaaagtaattcataaatggggcttatcctactcaaagagaaaggtagcatgaggttctttacttactcatgacttcatactagggtgaatttcaagtggtttctaaaagtgccaaagtcctaaatgtgtactcttagtcagaagagacgagagtgtacatgtgtaccttgagaggccaccactcctccactcaaagttccccaaaagcgacaggttaagtcattctaaatggcattccataagtgcacctttttttcatcatcaactgggccattctttcccattccttcattcaaaggaaagtgggctacaagatccatgcttgcataagataaacatactgtcttctgtgctgatttgattgctggcccatggtgttggcctcagtaggcatgcttccctccccttgccatgcactcttctccttgagaacagaaaacttcagtattctcatagccttcatgaccaggaagttaagcaccacagtaacagggccaggaaactgctctggacaactttctcatatccctttttgcccacaaaacagaaaaacattggcaggaaccaagaagtagccctctttttgagctaagttcccaacataggcgtttaaaatctccatgacaactgctgctggcatttgagggtctgagacatcctatttcatttggtttctagagctccacccccctaataaacatcatgtgtcctaaaccccaacatgtctctctaaccatggctttgaaacctctgtctaggcaaggcaggcttggtgccaaattgagcagagggactttctctcccctcttttttccctccctccctcccttccttccttccttctttccttccttcctttcctcctttctttctctctctctctccttccttccttccttgatggagttttgctcttgttgcagtgcaatggtacagtcttggctcactgcaacctctgcctcctgggttcaagtgattttcctgcctcagcctcccgagtagctgggattacaggagcatgccaccatgcccagcaaatttttgtatttttagtatagacagggtttcatcatattggtcaggctggtctcgaactcctgacctcaggtgatccacccgcctcggcctcccaaagtgctgggattaaaggcgtgaggcaccttgcccagccttccctctttttttctcatactatttattcaaagcatacaaattaaattatctttcattcgacgcttaacaaattgactttattaaagagaacaaaattatagattctggactcttttgaagaggtcagggcgtatgtgtaaaactacctaataagggttaaatgtcattacctagggagaaagtcagaccttatatgaatttttccctgtaatcaacagtttcctgtagcatatgtaaccgccttttaaaagaaaaaataagaaagaataattatgttttcagaaaattatagttactctgaggtattccatactgcagctagacactcttccaaagtatcacaaaggatgtggctgaatcctctaaacttctggctaagttggcaatatatacagacctataaagttcccaagagtagagaccactgcatgcccagtgcctagccctgcacctggcacagagtgtgtacctcaacagtgcttactatttgttagcttatcaacatgctacattccctggactatggttaactatgcatatgaatctagcaacatagatcatttctctttaagataatgactttccaaacaatagtagtaacctcacatccatcaaaaaaagagcaaagctcttagttagggacatgtagacttgagttttaattttaattctgcatcctcaaacaaatagttttacctttgtcagcatcagttttttcatctgcaaaatggatgtttaaataatatactgcacagtaatttagaaaattaaatgcaataatacatattaagggaccaagtatagggcttgatacatatgagacgtttggtaattagcaggttccctttcttctttcctcttcagaagagtgaggtttatagtaaaaggagtgcacatttgtcatttttgggatgtgtggggaagaaaaaggaaaggcacccaagcttcttcattgaccatttcagctggagcatgaaggccatgtttaagatggatgccactatagcagtttcctcctcattaatcgcaaccaccagtgacctgatgcttaaggaaaagattctccaagataccctcagtgcctaagccaccttggctaaaagaaacattgttctaagtgtttgctggatttttttcatcaaggcatttctgtataggattaacttggtcaacaaacgtttggaaacttttccgagacaattgcctttgaaatggaagtgaaaaagaaataaaatcagatttgcaaataagtgaggatgttattatggactttatgaaatagcacatgattttccacagaacagtccctctcacctccacaacctaaggttatggctgctcaagaacatttttttcaccccaactctgacatggggttgtgttctctttacattactgagggttggggagaggaagggaagtggcagatgcctcttgtctcaatcccatggagtataacacatgatgaggttctgattctgctaaagcgcatcacccactcagttgtactgtttgtcagctacaccctgaaatacttcctccaacttcccaacttgcccagagaatatctgatctgtgtaactcagaagttacacagatgaggtaatgtggaagtgctctaaaaattcatgtgggtaacatgctgggattttttgtctgtttctgattgcagtacaacatatacatagtaaggagcataaagattaaataaattaataaatttttactgtgtacatgcccatgtaaacaccacccaaataaatacacagaacttttctattaccccagcaggctccctcacgccccttcccagtcaatatcgactcctccccagataattacagcactggcttctatcactacaattagttatacctgtccttgaaattcacataaatttgaatcatacaagatgcgctcttctgtttctggtttctcttgataactataatgtctgtgatagttatccattatgttttgtgtagcaacatttgttaattactattgttgtgtagtatcctattgtatggatataccacaatttatatatttttcttggcaaacattggactgcttttaatttgaggccattataaattgagttgctatactatggtcaatggattttttaaagaatgccaagaaaattcaatgagaaaaaaaatcttttcaaagaagggtgttggggaaactggatatccacatgcaaaagaatcaaatcggacccctacctcatatcatatacaaaattaactcacaatagactaaatccccaaatgtaagagttaaaactataaaactcttataaaagttttcttacaagaaaacataataattctgtaattaatgtttttcttataagaaaatataggtgtaaatttttgtgacactggattaggaagtagttgcttagatataacaacaaaagcacaagcaacaagagagaaaaacagaacaatgacatgtcaacaaaatttaaaaattaaaaatgtttgtgcttcaaaggacaccatcaagaaagtgaaaagacaatccacataataggacacaaaaattttcatatcacatatctgataagagacttgtatctaaatatatagaaaactcttgcaactcaaaaaaagatagataatttaaaaatgagtagagaatttgaatagatatcactctaagacttacaaatggcccataaacacatgaaaagatggtcggtgttatcagcaacaaagggaatgaaaatgaaaaccacaataaaacagcactttatatccactaccaaaaaaaaaaaaaaaaaaaaaaaatagccggccaggcacggtggctcacgcctgtaatcccagcactttgggaggccgaggcaggtggatcacctgaggtcaagagttcaagactagcctggccaatatggtgaaaccctgaatctactaaaaatacaaaaattagccggggatggtggcaggcacctgtaatcccagctacttgggaggctgaggcaggagaattgcttgaacccgggaggcagaggttgcagtgagccgagatcgtgccattgcactccagcctgggggagaaggatgtggagaaactggaacccttgtgtattgctggcgagaatacaaaatgatgcagcccctttggaaattaattttgcagttcctcaaaatgttaaacatcatgttacaacatgacccagcaatttcactcctaagtgtaaatacccaaaagaattgaaaacatgtgttcatacaaaaacctgtaaacaaatgttcctagcagcattatttataatagccaaaaagtggggaaaatccacatgttcatcaactgataaatggtaaacaaaatgtggtttatccatacaatgaaaattattcagtcagagaaaagaatgatgtgcttaacatgtgcaataacatgaatgaacgttgaaaacattatgctaaataaaagaagctagacacaaaaggacaaatgttgtatgattctatttacatgaaatgtccagaataggcaatcaatcataaactagctttagtggatatcagggcctggggagaaagggaaatgggaagtgactgctgaataggtatgtttctttctagggtcatgaaaatgccctggaattagacagtggtgacggtcgtgtgactttgtgaatatgctaaaactagtgaattatacactttaaaaaggtaaatcttatagtatgtgaattatatctcattttaaaagatggttctttagctttatttaatactttgaatttattattccaataggatattgcttaagttagccccccaaaaaatgttaaagctgctatgaatatttttacacaggcctccaaatataatttgattcatccaacttctcacccaaacttatccaagtatgtgttgtatataccttgattgtgtttacaagggccaacaagtggcaatatgactagaattattcccttattttgcctgtctgtcatgtggctgctcttcccacccatctccctgtcctgattcctcaaaaaataatgtagacgattaagaatgcaagcagacagggaagaggagaaacaatacagctgacatcaatagtaatccccaaattagctcatcatgccctgaataattgatgttggccaagtttctgctggatgtgaggtacccaggctgctgggggtgcagctgctccttgctgcagcttgtggctgctgctcttctcaacttgcacacatgcctgtggggtgaaacatgctctctctatgtagtatgggtaggcaggaaagaaggacaagtctaaattaagaactcagtacttcaggatatttgctttgcctggacagtgcaggaggtgtgggattaaaaacgatgaagaagacagcagatggtctccatgccttgcccattcctctactgcgagcccatctatccacccacatgcacaagacagaatcaaagaagttgctcaacgtagccttgagaacactgctttcttgaaaatcaagcttctaaactgtacagtgccatcatttccagatgcctggcctgtaattcaaatgttgctttaccttttggtgttggcactcagcctttcccttttctgaactgacccaaggccacttctatccaaggtttatcttgtttataacctccttccaaactatcaaacatcatatcttccttctgccccactatttgtaaagtttgcatttcctgttttagctcagcatagtgaatggtcctagtcccagctctgccatcaggagaatatcccttcccaatgctggaatcaagttctccattcataccacgagggagttggtttggctaatctcttagaccagtggttctcagtcttggttgcaccttgggagtgccaaaaaatagtgacacctgggtccctcccctaagattctgttgtagttagtcaaaaatgtggcatgagcacgctacattttacagttcaccaagtgattctcatgtgcagtcaatgttgaaaatcacagttttaagggctcttttcttttagttctgaccttgtctgtttcacctgaaaataaaatgcagtcagaaaaaaaggtttttctgtatctctcccccatattcagagagaatctgttgagggagaaacccaaggtctatccatttttttctagggagaatagaaaataaagataaaggggataaaacatgttagatcatgtcatttccagcctcaaaagccattgatggctccctctttcactcataatatcacataagtcctacacagttttggatataacttaaaaaatgaatgggtatgtaaaaacataaaatatacacagtgatgtatggcatataataaagagctcatattttaaaaaattaagttcttataatggccaatagagaccttagatgatacgcctacctcaatttcccccattatttattgaccttaagttctactactcttttccttattgtcttcactccacccatgctggcctccttgttgaacttcaaactaaccagaaatgccttcatcttaaggccttcacatctgctgttccctcaagcaggaatgttcttccccagatacctgcatggctacttccctcatcttcttcagttctttgttcatatacagtcttcttagtcaggcttccctgaccactctctcaaattttcaccttctttccagaattcctatccccgtttccagttttattcttttccatagcacatatgaccttatgacatatcataaatcttatgtactttattgctttttcttccccagttagaatgtaaatgctatgaggccatggtacgtattgtgtttgctacttcatcatcagtgcttacaatagtgcctggcacacagtaggcattaaacaaatatttgttgaatgataaaatggtgaaaatctacagaatactgggaatactctcctgtctgagtaaaaggtttcatagtttataaaggattttacatcgattagctcaacagatcaccatcacatccctaggaggaagctagggattgttatcaaaaattaataaatttgggcaggtgcagtggctcccgcctggaataccggccctttcagaggcctagatgggtagatcacatgaggtcaggagttcaagaccagcctagccaacaagatgaaacctcaattctactaaaaatacaaaattgagctaggtgtggttgcatgcacctgtaattccatctacttgggagactgaggtacaagaattgcttgaacccaggaggctgagtttgctgtaaaccaagattgtgccactgcactccagcctgggcaacagagcaagactctgtctcaaataaataaatgaataaatacattaaagaagaagatcacatgatgaggaaggaacagacagatctgagatcttgctcaagatctcagtaaagaagtagagctgggggatcatcatggcagacgggaggcaggactagattgcaattccaactcagatggacagagcagtgtgaggaggtttgcatcgtgcattttagctccaggacgactgcaagaacaaaccagggatctcgagaggacctacagacactcttaggaagtggactgctcctgcaggacccaggagacactccaaatactttgagcactccaacagcagaagtgggaaagggagatcctccattccttaacacacacccacactggggaaacacttaacacactggggaaacacactggggaaagtctaatttgcaggagaagtttctgactttacctggagctgagtcaatttagagagctgagcaaaatacaggggtagaggaagcagcgggaaaagccccgggagtttgctgggtccccaagcaggcctggaaccacagggaaccttcagaagggtcgccagaggcacaggggaaaatgccacggggaaaaggaagtctccagctgaactttgtaacaatttgaaccagaagagaagcatcctggccagaacttggggtagggcatgaatctggtgtggagactctaaaggagtgggaagaaccaaagcccttttatttcacagctgggaggtgggtaacctggggcaggttctcaagccctactcacccattgcctggaaacagacttgggactgttatgggagcacagtgggagtgagactggccctttggattgcatgggagctgggtgaggcctgtgactgccagctttgacccacttccctgaccacctgcatgactcagcagaagcagccataatcctcctaggtacacaactccatggatctgggaacctcacccccacccacacagcagccacagcaagacctatccaaggagagtctgagctcagacatgcttagctctacccccacctgatgggccttccctacccaccatggtagctgaagacaaagggcatatactcttgggagttctagggccccgtgtactactggttcctctccatactaccaaagctgatgctctctgaaaagcaccacctcctggcaggaggccaaccaccacaaaaatagaacattaaaccaccaaagctaagaactgtcacagagaacatttcatcccttgacacctccaccggaacaggtgctggtatctacagctgatagaccaatagatggttcacatcacaggactctgtgcagacaacccccagtaccagcccaaagccggatagacttggtgggtggctagactcagaagagatataaaaatcactgctgcttggctcacaggaagccacatccataggtaaagggggagagtactacatcaagggaacaccccatgggacaaaagaatctgaacaacagccttcagccctagaccttcccactgacagagcctacgcaaatgagaaagaaccaaaaaaacaactctggtaatatgaaaaaacaaggctctttaacaccccccaaaaatcacactagctcaccagcaatggatccaaaccaagataaaatctctgatttacctgaaaaagaattcaggagattagttattaagcgaatcagggaggcaacagagaaaggtgaagcccaatgcaaggaaatctaaaaaatgatacaagaagtgaagggagaaatattcaaggaaatagataccataaagaaaaaacaataaaaacttcaggaaacaatggacaaacttttagaaatgcaaaatgctctggaaagttcagcaatagaattgaacaaatagaagaaagaaattcacgactcaaagacaaggtcttcaaattaacccaatccaacaaagacaaagaaaaaacagaataagaaaatatgaacaaagactccaagaagtctgggattatattaaacaatgaaacctaagaataatcagtgtttctgaggaagaagagaaatctaaaattttggaaaacatatttgtggcaataacagaaaaacttccctggccttggtagagatctagacatccaaatacaagaagcacaaagaacacctgggaaattcatctcaaaaaaaatcattgcctaggcacattgtcttcaggttatctaaagttaacacaaaggaaagaatcttaagatctgtgagactggaaaggaaaggaagaggagggaaggggaggggaggggaggggagaggaggacaggggacaggaggagaggagaggggaggggaggggagggaaagtgtaaaagcaccaggtaacccaccaaggaaaacccatcagattaacagcaaatttctcagcagaaaccctacaagctggtagaaatttgggccctatattcagcctcctaaaaatatacaactatcagccaggaattttgtatccactgaaagtaagcatcatatatgaaggaaagatacagtcttcttcagacaaacaaatgctgagagaattcaccactaccaaaccaccactacaagaactgctaaaaggagctctaaatcttgaaacaaattctggaaacacataaaaatagaacctctttaaagcataaatcacacaggacctatcaaacaaaaacaaaatttaaaaataacaaaaaagcaagatacacaggcaacaaatagcacaatgaatgcaatggtacctcacatctcaatactaacattgaatgtaaatggcctaaatgctccacttaagaaatacagaactgcagaaaggataaaaactcaccaacaaattatctgctgccttcaggacaatcacccaacacataaggactcacataaccttaaagaaaagggatggaaaaaggcatttcatgcaaatggacaccaaaagtgagcagaggtaactattcttatatcagacaaaacaaactttaaagcaacaacacttaaaagagacaaagagggacattatatcatcatacaagtccttgtccaacaggaaaatatcacaatcctaaacatatatgcaaataataccagagctcccaaatttataaaacaattactaacagacctaagaagtgagacagacagcaacacaataatagtggcgaacttcaatattctactgacagcagagatagacagcaacacaataatagtggtggagttcaatactctactgacagcactagacaggtcatcaagagacaaagtcaacaaagaaacaatagatctaacctataccgtggaataaatggaattaacagatatatacagaacatttcaaccaacaaccgcagaatacacatcctattcaacagtgcatggaactttctccaagataggccgtatgatagggctcaaaatgagcctccataaatttaagaaaactgaaattatatcaagcactctgtcagaccaaaatggaataaaactggaaatcaactcaaaaaggaaccttcaaaaccatgcagatacatggaaattatataacctgctcctgaatgatcactgggtcaaatacaaaatcaagatggaaattaaaaaaattcttagaactgaatgacaataacaacacaacctatcaaaaggacacagcaaaggtggtgctaagaggaaagttcatagccttaaacacctatatggaaatgactaaaagagcacaaactgacattctaaggttgtgcctcaaggaactagagaaacaagaacaaaccaaacccaaacccagcagaagaaaggaaataaccaagatcagagcagaactaaatgaaattgaaacaacaacaaaaaaaaacacacgaaagataaataaaacaaaaagctggttctttgaaaagacaaataaaattgatagaccattagcaagattaaccaagaaaagaagtcagaaaatccaaataacctcattaagaaacaaaatgggagacattaggactgacaccactgaaatacaaaaggtcatttcaggctactatgaacatcattacacacataaagtagaaaacctagaagagatggataaattcctggaaaaatacacccccccagcttaaatcaggaagaattatatatcctgaacagaccaataacaggcagagatactgaaatggtaattaaaacattaccaaaaaaaaaaaaaaatccaggatcagatggattcacaactgatttctagaagacattcaaagaacaattggtaccaatccttttggcactattccacaagatagagaaagagggaagccaccctaattcattctatgaagccagcatcaccctaatacctaaaccaggaaaggacataaccaaaacagaaaactacagactaatatccctgatgaacatagatactaaaatcctaacacaatactagctaactgaattcaacaacatatcaaaaagataatccaccatgatcaagtgggtttcataccagggacgcagggatggtttaacatacacaaggcaataaatgtgatataccccataaacagaatttaaaacaaaaatcacatgatcatctcattagatgaagaaaaagcattcaacaaagtctagcatccctttatgattaaaactctcaacaaaaccagcatacaacagacatacctcaatgtaatgaaagccatctatgacaaacccatagccaacataatactgaatggggaaaagttaaaagcattccctctgaggactggaataagacaagcatgcccactctcaccactcctcttcaacatagtactggaagtcctcgccagagcaaccaggcaagagaaagaaataaagggcatccaaactggtaaagaggaagtcaaactgtcactatttgctgaccatatgatcatttaccttggaaaccctaaagactccctcagaaagctcctagaactgataaaataactcaacgaagtttccagatacaagactaaagtacagaattcagtagctctcctatacaccaacagtgacaaagtggagaatcaaatcaacaactcaaccccttttacaacagttgcaaaaaataattaaatacttaggaatatatctaaccatggacgcaaaaaacctctacaaggaaaactacacaacagtgctgaaagaaatcatagacgatacaaacaaatggaaacatcccatgctcatggatgggtagaaacaatattgtgaaaatgaccatactgccaaaagcaatctagaaattcaacacaattcacatcaaaataccaccatcattcttcacagaattacaaaaaaaaaatctaaaattcatgtggaaccaaaaaagagcccacataaccaaaacaagactatgcaaaaagaacaaatctggaggcatcacactacctgatttcaaactatactataaggccatagtcaccaaaacagcatggtactggtatataaataggcacatagaccaatggaacgaaatcaaaaacccagaaataaccccaaatacttgcagccaactgatctttgacaaagcaaacaaaaacataaagtgggaaaaggacaccattttcaacaaatggtgctgggataattagcaagccacatgtaggagaacgaaactggaatgtcatctctcacattacacacaaatcaattcaagatagattaaggacttaaatctaagacccgaatctataaaagttctagaagataacattgaaaaaacccttcgagacattggcttaggcaatgatttcatgaccaagaacccaaaagcaaatgcaataaaaacaaagataaatagccgggacctaattaaactaaagagcttttgcatggcaaaagaatcagtcagcagagtaaacagacaaaccacagggtgggagaaaatctgcacaatatatacatctgacaaaggactaatatccagaatccacaatgaactcaaaaaaatcaggtagaaaaatcaaacaatcccaccaaaacgtgggctaaggacataaatagacaattttcaaaaaagatatacaaatggccaacaaacatatgaaaaaatgctcaacatctctaatgattggggaaatgcaaatcaaaaccacaatttaatacctcctcactcttgcaaaaatggccataatccaaaaataaataaaaacagtagatgttggtgtggatgtcgtgaacaggcaacacttctacactgctggtggaaatgtaaactagtacagctgctatggaaaacagtgtggatattccttaaagaactaaaaagaatcatatatatatatacacacacacacacacacacacacacacaaacacacgtatatatatatacacacacgtatgtgtatgcatatatacatatatacacacacatgtacatgtgtgtatatacgtacatatatacacgtatgtgtgtatacatacatatatacacgtatgtgtgtatgtacataaaaacacacgtttgtgtgtatatatacatatacacacacatgtgtgtatatgtatatatacacatatatattgatgagattcgagactattattcttagtgaagtaactcatgaatggaaaaccaaacactgtatgttcccactgatatgtgggagctaagctatgaggatgcaaaggcataagaatgacacaatggactttggggacttggagggaaggcagtgaaggggggcgagggataaaatactacaaatagtgtgcagtgtatactgctcaggtgatggatgcaccaaaatctcacaaaacaccactaaataacatatccatgcaaccaaataccacctgtatcccaataacctatggaattttttttaattaatagattaaaaaatactgaggctcagagggaaaatatacaactatctttatttggctagcaaaaagcaaggcagaacccaaaggtcatttagaagctatgagtctggcacacttttcaaggcagtattgaactctaaaatagagaatggaggtcctcccagtcttcactgaaattttttcttcagtgatatttcaggatgggcaaaaaagcattttattaatgttaacctgagtgcattttaaataatggtttgatagggttactgcccaagctttaggagacaagggccaggtcaaaggtggttacaataggaacagagaggaatgatggtgggagatacaaaccttacaaagtgaagacaaacagaatgaccagagttagagattctgggagtttctgcctgggaaaccagaagaatctaagtgccatgagaagcgtgaaaggagcgcagcttggtaaaagaaaagaaaatgcactgtttttcaattattttcagtatagagaagttgaaggggacagaggaacatttcagtggtcatgcccaacaagcatatacaatatgtaaaatataagttgaagttggagatgtgtcaaatgcataaaaacaccagaataacagttcttgcttatggctgcacatcagaatcatatggagcactgaaaaaaaaatcctacgctctagattaattaaataaaaacctctggggttggaataaccactggccgaagtaaatcatggcagaagttaaatcatgggtaaagaagaatggctggatgcagtggctcctgccggtaatcccagcactttgggaggtcgaggcaggtggatcacttgaggtcaggacttcaagaccagtctggccaacatggcgaaaaactgtatctactaaaagtacaaaaattagccaggcgtggtggtgcatgcctgtagtcccagctactcgggaggctgaggcaggagaatcgcttgaaccctggaggcagaggttgcagtgagccgagattgtgccactgtactgcagcctgggtgacagattctcaaacaaagaagaagaagaagaagcaggaggaggaggaggaggagggtgaggaggaggagaagggaagaaggaagaaagaaggaagaaggaaggaagaagaaagaggaagaagaaccaaacattgagggtcactcatacttgaagctggaagaggaggaatacatgacagcaacgaagaaggggaagccagagaagaaaaaaaaaaaaaagaaccttgatagagtagaataggacaaagctttaagaagtaagggatgagtaatgtgtcagctattgatactgggacgtggaggaggccaggactgaggatgtgtcatttttattttatttcatgggcatgtgataaaagtaaattatctttttgtgtttaagtatactaaaatctgtgcctggaatagacataatgtagagaccacaggtgggtactacagtttttaatgggctactttcaacatttccaaagtggctgaagaattttaactgttagtgatagcaacatctggcccagcaatgtcaggaatagtatatcaacagaggagaatgaacctgcgcaaaattaaagaagtctcatctattctcctttgtcttttattctagcgcacagagcaagaggtaaagccccagctggggaagaaaaagaaaaaaaaatccttactaaaagctgttgtcattgtacagacaaaattaataaccaactgaactgggctacttccacttggccaaaagtaaatgctaaccatatgagtcaattgttttgccttcaaaacatgcgtacgtgcacaaagacaacaaacaaagcacaaacctcaaaagacaaatacaacttagcagactgtaaattaaaaatataaatatttggttagtgtttggcaactgctgaaaaataattgttaaacgaatggggaaaagagactgtgtagccaagaatacaaagataccattataaaagaaataggatgaaattaagaacagcaaactctaggctgattttgagggaaaacgttcttctactgactgctaaaatactcttcccaagtgggagcaaaagcacagaaactaccctggattatgttcaagggtaaaatgagataatgtatgtgagagtgctgtggaaactccagattgtgctacgtatgtgaggagttgctatgattgttgttactatcccacccagagctggggaacaaagggtattggagacaagccccaagccagaccggcactcagctaacacctgaaacctcttgctttgctctgctgttatcctagccaaagtgagtcactggtcatgtaccaatcaccacaagattccataaaattacggtataataaaaaaattagttactcaaccagcagtactggaaggggagataagctgacttcccaagaaggcttttggctgagttgtcccagttgggtattgaattcatggtatgatttatttgcaggattgggactggataaaactcagtcaagtactccaatttctgatttctattaagtttgttggtcttgccccacactccctccaccctgtcccatttaccaagcaatctggaatagctgtatctgaagatgtcaacaagaacagtctctttttttttcccatggcaatcaagtactccatcccatcctcataggcctgggaataaaatatcctaaaggagcagagatacaaaccagtgggcatttacaagcccaacccaggtccacatccttaacaaaggactggaagaatacaatgagaactatagaatgaggcatgtctgtacaaaatgaaatgctgctgccaaaatatttcttcattttttctttagatgtccaagaaaagggagaaaggtatagtactttgtgaggttgtggagggaaggtgagactgataacaagaagcctatgacctcatatgtaaatgcacattctttgagaccatttttagactctgacaatcttagagtcaaagggaggtttaaaattaatcttagtcccagtggccttttgcccagtaaagaaataccatccagctctacttgaagtcctttagtaacaggcacctcagtactcataagacagcacattccatcatttgttttttttttcctcctctttggcaaccagttaaaacttcaagctatcagataattgaaaacatatagtcatgggatcctaaaagtattattcaggacaacttaaccccattccctgatgatctaagatgaggaaactaatgctcagaaaagggatagaattttcccaaagtcacacagtggtcaatggtagagctaaaagtagaattcaagtctgcatattcagggcccagtggcttctctacttcccatatacgaagaaaggagttggcccagctttaggaccaattactcagtgactatactaccaaggctccagcttctttttcctaactcccacagcccaataatggctcattttatcctcaacagaaacaattccaaagggtgggctgggtcatggagaggtggatcgtagaagggaagaagtaatgcccactctttttggcttaaccacaacggtgactaacaatctcctggaagtaggacatctcagtgtctgattccaccatatattacatggaaaatcctttatttttgagaatagcatgatgtcttttggtggtgtttggaagatataataactgttgtcatcccaagatagggagaattaatttctggtcactcagcaaccacttgatgagtactttctatgctaggcattctattagaacttagtggcaagagaaaaaaacagaggtgaataaaccatattctccaaatttaggagattgcagtctggtggggaacatagaaaatatatacagtaaactctaatccaagacaaagtatagccatcctcatatctatgttcacaaaataatagtagtcgtattttacatactgatggtgaaacttacccatatctttcctgttaagctcccaagaagagaatacacgggtggagctagtttctagaaagaaagcagtgaaaagcagcttctgcttcaatatgaagcttcagcactgaggaatggctccaaaagatgactcactctctgcaggaagcattcaagtggagaaggtcaagaagacatctaaagaaaggaattctctcaaagagggaataactggtataaggtaattggaggatccctcttttttttgactcattctttagtgccagagttggcgtaattgcccagctatctatcaccttaaaccctaacagctgtggaaaatgaaaagccatactgaacttggagtaagaaaaatgtgtcttgcagttctggcacagatgcttactaactaaatgatctctagcaagtttcattttctctaggcctgtttggccacctgtataatatatataaataaatctgcaattccctcatttggggataaggaatcagtgggatgatggatttgaaagtatttagcacatagtggaaaaaatgatttatattctttaatttttttttgagatagggtctcactttgttgcccaggctggagtgtagtggcatgatcatagctcactgcagcctcaaactcctgggctcaggagattctcctgcctcagcctcccaagtagcgggcactacaagtgcccagcacccagtgcccagctatttaaaaaaatttatatagacagggtctctccatgtttcccaggctaatcttgaactcctgggctcaagccctcctctcgcctatgcctcctaaagtgctgggattacaggaatgagccacccttcctgaccagaaaaaaataatttaaaaaataataaattacaaggaattttgtcacatttacccatcctgttccttttgcagtattcctcatcactatgaagacatactcataccccaatttatatacttcaaaaccacagagtcatatttgacttgataccatgccagataagaaatgatacaattatctgagctgtttgacctgggagcagaagatgcagggggatctgatctctggtcttcagatctctgaaaaactgtcatggaagaaaaagaacagactgctctaggtggcctcagggagaatgactaggatatccaggtacaagctttaggaaaactaagttcagcttagcaaaaggaagaacttttaacagtccaaggctttccctgaagacagtgggctctctcaggaagcagtaaggaacctccctctagaagtgttcaagcagaaactggcaaggatgttttaatgtggaatccattagggtaaaggaaaattacaattcatgaaattctacttgtcaggcactgtgctagacccttggcaggaaatatatcttttaatcctcccaataacaccatgatgtgagtactgttatccctctttttcaggttagaaagctgaggctcaaagaatttgactacttctcattgggcttactactggcatggtgggtgggaggaacaattatttgttgcatctgtttggcattaaatgcagtagtacctcagactgtgtgtaaaacacacacacacacacacacacacacaccccacatacttctaaatgtcttgtggaaataccgatcctagttgggaatgtcaagtacataatatgcttaggatcacaaacagcagataaatagcagacccaggacttgaaaatagctgtgtctagctcagaaggtacatactctttctattgcgttatccacagaagtgagatgggaatgcacaaccttgtaaggtctaagccaacccgaaaagattctgattttctcattcttcctttttcaattccatataatgtatcaactacaaagttctgtagattcaacttttgtgatggcttgttaaattcatcacctcctttctattcccacagccacgacctcagttccagggccttgttccctctctgcccctagtttatccccctcttgtgttttcctattccaatccagctgactaaccttttaccagattactcttcctaaagcagaggatctgacgttttttttaagctcaaaaactttcaatggctttccattgtctgctaaatcaaatcaaaactctagcatccactgtcttttgcagtttaccaccaatctgccttggcaagtttaacttccaattttccgctaatcgtactctaaaatccagctcagctggtgttcttttcatatgccctgagcttccctgccttaaagcagttgttcctattttctctgcttaaactgtcttctctatctccacctgttgaaatcttatctgtgtgccacagtctatcttaaataataatagttaatatttattgagtgtttattttgggccagccactgtgctaagtgtgtgcaagtattttatatggattatctcatctaatcctcacaacagccccatgaggtgggtgctattattatccactttagcctgaagttaacagaaactcagaaagggagaagtaattttatttgtccatggtaacacaagttaaatggtgagcatg[450 bp omitted]ctctggcgggtcccttcttgtcccccagttcttgcagcttgctgggtcttggccagtgtttggagtgaggcaggatcaaaataacactgcccggggctcagcttccaggaatgagagatcaagtgaaaccaagctcggcgggtgagggggtggattgaaagcccccaaacagagccagcatgctctttacacaagccctgacttgccctcaagccacgcgggttagcagttctgctttcctcaggatgctccacaagtctgatccactgtccccgccttcactaacacccagcctccttctcttctttatctcccaaccctagatgctcaaggttgttggacacgtccaggcatgttctcagaggcaatgcaggtccagtaagagcctacaggaaatggctcgccaagatcctagagatgtcagcccagatccctgatacctcagaaagcgctctccggacacaaatggatggactgacagccagccacagggcgccttcccaattgttctgattttgcggtaccctagcaggatcatcctgacctgattctgtacttctgcacctagatgccgcaggtcccagccgccttgccacaccagggggtgttcccacactcacccggtaacggacgagtagatggctcttgctcccaaatgggactccggtacaaatccacctcagcgcagagcacacatctcacccagccccctcccgtcaccccccgcccttcaccccgcgcccctcagcccccgcccctcagacccgcccatcagccccgcccctcagcccccgcccctcagcccccagcctgcatacacactcacagtatatgaaattccttgtaatcaaagttccgcttgactcatttcacatccacgtgtagcaacaac

SEQ ID NO: 1415 - DNA, 20392 bp, Homo sapiens
tttggatatatttctgtttattggccaatatgaaatgtttgcagagcatcataaacaaacatagccctgccagtatctacacatgcatatggctcaagagttaacaaaatttctataaataacccatttatgagaaaaaataattaaaatgtaccaatattcaatgtaaaacactgaagacctagctagtagggtggggttggtagagaggagtgggacaggagggattatgatctcaatgtgacagggctgtatgttgtagaggggtatgctgtagtgctgaatcctttcctaacctggatctgagaatcttggaggaaaaaattattttcccaggctccctcctgtcaaaatccaagtcaaggtatatggagagaaaaacagtaatccaaaaaaaaaaaaattcattctcaggaaatacctccccttccttacaaacaaaaactacattttttttttttgctagttcatttagagacaacttaactgctgtttaggctcaatgtatgttgaaaatgtttttatcaagtgtactttgttcttccactgaccaataacccctttgtagaaagacacataaaagcacagtgctcaaagaaatatgcctcagcattgaaaagtaaaactgtaaaaagaactctcctgaagcaaatactcaactatggtatttgccatggccaaacagaaattataaagacgaaaatccttcacttcacctttacccgaaatactttaaaatgcaaagccaattgccacctccaattgctgaacctcaaaaagttggaattaaggtgattctgggtatggcttgggctgtccacatagcattcatgccatgagcaagcacactgaagaagtcttactctttcactttatcatatttttgttattattattattattactgtgttaccatcattatctttcctctagagcagcagtgtcaaatgtgggcttgaaccactgccagccacatggcaacctttgaacacctgcagcctgctgaagccaaatcatcccctgtctggatattatttcttctaccagaaggtctaaacatgatcagtgaaagccagtgagataagaataacctgttgcagaaaaacaaaaacaaaaacaaaaacaaaaaaaaaacaggaaacctaaaggccaaggcctaaaaccttggttaccacatatttgctaatacctgtgtggggccaggctgcttgcttggtacaggcttgtatttcaattgcttctaatcctcagtccagtacaatgggacctttttgctttttcccaagtccttttagtaatctgatcaattggttgccccaggggcccttaatcagtgtttgtagatggatgaacccaaaagatgtagttaataaaattctaaaagcaaaaatcttgctgtagacagcactcctttgccagagctagaacctggtgatgaagtgcacattctgcctaatgtacttaataaaccacttaatagttgtgggacaggaactagctgtacaagtttcagacagattcttggagaataaagaatacaacctctaaggaacttgtttttctctgagcatgagatgtataggtgggagctaaaggcaaaaagacaattgagaaagaatcaaaggggaacggtggtgagaaagctgggattgaattgacatttcaatagaaagaggcatactcagatgtccctacatggattgagggctgtctttgagggactgctgtggggtagtttggggaactcaggccccagaaggaagattactttggctcagaaatgttctgtaaggttccaaaatggcgaacttcagcccttctccctgctgagggtggtgagaacctcaaatacagggtgaggccccagggatctagagggaaagtgtttgccctgcctcatgctgcaatgcagcagtctgagacatgaacttgggaattatggcacgaggcctcccccaagatagatattaatgtgtgtgtgtgtgtttgtgtgtctatgtatatgtgtgtgtatgtgtgtgtgtgtgtgttgaggagggagacagtgtggaggagctaaaaggggagaagggtttgattttgtccctaaagtgctaggtagatgtgccaacacaattttgagaggcttacctgaccaaaaatgcagacatgaaaaccctaccccattcactgtcctctctcctcttctctataatcaagttgagctaggaacatgtctggtagtcccatgaatgtggaatctggctccccagactacaaaagggaagcaagaaatgctccagatcagtccttgtgaaatggagaatcaatcctctggtgggatgggataggatatgccccatctgtagggtattagctcttgtggacatcacatttcaggcccctgctgctgttgtggtataggaacagagtccagagagaacaactgggcaaggctgccaggggcccaagagacctaaggagagagcaaaccaagttagaaacatgtggggaaatctcactagcacccttctttctctacccctccaaatatcataggttaagccaatggttgaggatgtaatagcagaaagacattacctagatagggatatgacaattctaccctattctacattgttgaaaccatttatcctgaagataggtttagttctaagctccacatactttagaagaacctaaagtggtattctccagagaggtggtgttgtcttcaagcctctgcagggctatcttaaagcagaggaaactgatgaggtctgtctggcacgaggaacagagccaggatggataggcgggtactacagggaaagctctttcttacattgagctcaaacccaccagtcacaattgtgtatactgtaatatacattgagaagtagtcagccctctgccacctaaagtatgtgagcaaggactacacaaactcttagtggggatattataaaatggacccaaaccttggaagaagaactggactagataaccttgaaggtacctaagttgattgatttgacatcagttataactttcaaatttgatatcagttatgactttcaaatatacatttgttcacgttttcttaggttggatgcagggagcagggaagtcattgggagaactgaaaatgtattaactgaagaaatacggaagtgggcactgcaagatatttggttagttgaaaactgggaatctacctactctcctacctcatgctacataagctttgagaaagtaacattggctatcaaatggttgcaatggtggagttgaaccaactctaaaatgtagcccccaaacctgggttcttgcacagttctagcccactaatttgccctgtgactttgagaaactaactttccctctctgtgtctcagttcctgcctctgtaaaatgtaaaatgaagtgacatacacacaaggtttgtatagttattagggaatgaaggttgatttgaaatgtagggtttccagatgacaaggcttgtatatctttttctactgtgctatgctgcttgcacacataaagggagatacctgaatatgaccattagatagtggggccctgagagagcttacgaaagaccagaatggagagactggtatcatgacaaccttgccagttccctgacaattgtagacccagaagtgtgatatctgtctggcttaaaagtttagcatcaccactgttgcccctccacccaaagtgttcctagcttgctgctgttcctccactcctagtgaataatactattccaaaagagaattccttgaggttagtccttaatttctgttttgctttttttgtttttttctgatccacctttccagctcacctcattagagttaagggctgggaacttcaaagggcacattgagctccagcctgtctccagtgctttcgactgtgtttccccccaaggtctcagctccagtataggaggcagagctggaaaacttttgcaggtccagctctgtgcattcgatggggctgtggacccagtgggagtggctctctgaggtgcaggaggccatggtaaaggactcctgtgtggggaagccactagtcgagctgcagtcgtcctcgaggatagggttaagtggctgggtctgaaagatgttctcactcacttgggactcagcactggtctccttgctgggtggcacggggaagagagattcctcctttgctgttttatcagcctcaaactgcagcaaacctcctgcaactcgaagcagaaagccactgggttacccaaaagcaggggctcttctcagctgggcactgggtactgagtacaagacaggtaaaggtctgggagctgattctttccttcctctccctggggtctagagcacctagcaccaggctgaggtgacacagttgagaaacatacttacattcaggtatcagattgaggctagctggtactggatcagagaaaataatcaatttctctagagaaaaagaaacctttgtgggaaacaggattttgataccatctcccttgccataatcttcatggcctggtcttatgtctatgtacattaagttacatggcaaactagactctgcagatggaattaaagttatggatttcaaaataaggagagaatcctggattactctatgggtccaatgtaatcctgtgtccctaaaagcagaagaggaaggcagaggagacagagagtatcagagagatgtggcatgagaagaactcaactcatcattgctagttttgaaaatagaagggggccatgagccaaagaatgtaagtggtcctagaggctaggaatgaccttcagcttacagccagcaaggaaatgggacctaagtcctttaactgcatagacctgaattctgccacttttgtgcatgatcaagcagattctctcccagagactccagaaagaaacacagccctgccaatatcttaattttggcattgtgagactctaagcagagacaaaattgagcctactgaacttctgagctatggaaactgtgataataagctactaaatgtgtggcaatttgttatggccatgatagaaaagtaatacccccttcatgcatggatctggttcaacatcaggtcacaaactgagaacctatgggatttgtgtttgtcctctttgctttggttgtgattttgctctttattcaaattcattgactatggttaacacaacttcattaaaaaaaatccagatttctgaattctcttgaaaatgtagaagatcttgcaacattaaatatttccatatggttacaaacagctggatccaagtagtgggattcccctttagataagggatgtgctctgtagtttgccacagttgcacttttctctcttgcaaccttacactggatttaattcgcacatacatctcaccccagtatgtgtgtaagtcagtgactcctgaaaaacagttttccaaagtaagaaaatgtctagccttcctagcccttataaaaacagtgaggaaactgcctgccctcatattccaagcaggttaccacattattatcttcaggatagaaggagagcagaaaagggttacccatctctcttcttctgaggcagctctctgatattttctcattttcatcttctggaccctggagtccaaatgcttcattgctcatgtttcatgtccatgcacccagggcctaagcaacaactcttatctgggacactggcctccaaagtcagagacaggaaggtctaccttgagtcacagtgtcccaggagctagcaagaagtagactttgagaaaaatcataaaggaacaacagtgttccccgtgtatcctgcagcccatgaaatgctatattcatctccaattaagccagggcacaaccaaacatacctcttgggcttttcaagatcatctgctaggccccagagccaaactgacccaaggcaaatttacattagcaggatcttcccacacaaatactgcagctttgcacacagtatccagtgggctgaaaaggagtcctgagcactcttttatctagtaaactttatcttcccccttataaatcaacttcattctctgatctgagttcctgtttcagtgtccctgcctaactctcagttcccttaatggcaatgaagctgcactgaaccttggtactcttggctggagttctaactctttgcctggtcctgatcagccacattcccacctcccccatctttgtcctcagtgagctggcttttctgtcccacattcttgtctagtagctgaagttgtgcttaatagagatcacaatgttactgtgactttaaatatgattttccatctggaattttgcatggctgtctgatatggactgggctagacctcttgacatcagtattatctgagggagaaagtccaggtttgccaactactctggacatagggctttcagttatccccatttgtgaagttattatactgatagcagtggccttagacctcaaccacttttattacagtcgtatctcagatatagccaagccttcctcaattcatgacatgctctagaatttatacctactagtatagatataaagaattggaaaagaacccagaaatcaacaaatccaatcctatctcttatcttaaagattaggaagaaagaggtctgaagaggctagatgacttgtctaaggttacacggtgatttagaggtagacatagaacctaggtctcccgattcctttcctgaggggtttcccaccgtgccacattcctttaaaatcccctgaaacataatgaaccaggtcttctaaactctcagggttggcttcagtaatctcttaagtcccatgctttccattgcagccccagatagttccccaggccaacagaagactattcatggggttttcaagcatggtagaaaaggcccattgtctctcaaccccagaacatccctctcttctgccaataagagccttgttcctgattcatgtgaaacatgaaacagccacccttaccacgctggcaatgtctgttgaagaactgcttgcagtagaggaagaagagccccaggaaggccagggtaaacaccactagcaggctgctcaccagtgcaacaagtgtggcctcctgagggggcactgtgggtgtatctgcctccactaagctcaactggaaggcacctgtgagacaaaaaaatgggggaggtcagttagcatgggcagtaaacagtcaccctgaccctggacctggacttcctcaggctgtcacccttctccctagggccttccccaattagggtggctatgctggttttacttctttctagagcaggcaaaattataaagaacaaggcaaaataatttgtatatagtgctggtatgtagaaattagtacaattaatcgaagatgcacatatcctgtgatctttctgtgccacatctaattatataatccagatcaatggaaacaagctaaaaaattcatcagtagagcacaagataaacaaatcatgatataatcctaaaatcttacattattatacagcacttaaaggcctttatggatcaatataaataatctagagggggaaaaaggaagttggagaaacagaacatatagcttgatatcatttctataaaacattatacaatacataacaatagcatatattggttatgaatatgcacacatatcacaaaagaacccaagtattaaaacattagtggagagtatggcagaggtatagtgctcaccagttatccacatactcccatgtatttcccttacacccttgcagtaaggccatcagagtacttctggccaatgaactgtgagttgaaataacatgtgtcacttccagactgaggcagttaagaaccagtatgtctcctccatctcttcccctgtgtcattgacctggaagacatatggtctagaatgcacagtcaaatgatgtaggaaggcctttgcatagtaaaaaaaaaataaacttttattgtataaagtcactgagattttgcagtttgtttgttactttagcatagcctaccaacagaatacatacaatttcaggatagtggttgtatctgaggaggtagggaggtaataggactctgagagaatctagaagagaattccattatatctgtggaatctttattcttttaaaacatctgaagcaaatatgcaaaatgctatgatttattaactttggatagatgctgggtgattgcattttaattttatatttttctgcacttaaaaatatttctacatgtttgaaaactttcatgatttaaaaaatatgtcaataattttaaaataggaagtaagtaaatagatggtagacaaaaaagatagacgattagataaatggatagtggtataggcatagattggaccctagttcttcattcagcctcttacaagtcctcagccctaggggctcctatatacttcatataataataatatctcataggtttacaaatattataatttgtgaagtgcttcctaacatccattttctcattagacctagatacccatcacacaaggtatgaagaaaaatgattatcatgactcacccttttttcagaagtaggaaatgaggttcaatgagattgaatgatttgcatagagttgcaaagataatatgttgtaaaaccagacttctaatctgattcccttgccactctactctacatgaaaaggtatgaggggatatgggtagtctttactaccctatcttgctgccacccaatgggatgaggagaaagggaagaagagaactgggtacacacattgaacctcagaggtgggggtctgcttcgtgcacgggatgcactcttggtcctgcaggcctccaatgcgtgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgttcttctggaaagcaagtttttattctatctatagcactggaatcagaagatatgtgcctgactcctcacttactcacttgctagagaagggaatgacaaaagcaagctagcatttattgaaagttaaccaataagttgagtgattgattgattgattaattggttagcactccctttcattttattggttaactcagaaaacatttttgaagcaactacaatgcatgaggatgctattctgaatattgtgactaaataattgaatcaatcagacaaaaatccacacactcatgaatttatatacttgtttattcatcataaaaccttataagggtgcaatataatccatgtttcacaaataagcaaaattgaggcacaaattgttggcctgagaagcctcttccccatgggcctgcgattccccacacacaactagagacaataggctgcagggggcacttgagattccaccataagtaaccagctcaaatgcttctttgtcctgtgggtctgagattattttcccccacataggaacaggtggctggggtatactggcaagtggtatcctactaataacaagtggtcgagcatgggaaatgttctttgactctacaactcagacacttctttatgccgacctaaatggaccaagtgacctggcccaggaaatcgtctatacctgaggcagcacaagataaaccccgcagaccaaaaatcacactacaaaggttctggaaattaaatagcctttagaactgcagctcacaaacgtaggccaaaacctgtatgctaaacataaacagatgactgcctgctaaagtaaaagtttaaataggaccctgagtctcctgacataattgacaaaatgtccagaacacaacgaaaaaccacccatgataataagaataaggaaaatcacaacatgaatgagaaaagtcaattaactgacagcaactcttagataaagcagatgttggaatgattgaacaaggattctaaagcacccataataaaaatgttttaaaaaacaatttaaaattctcttaaaaatagaaaatctcatcaaagaaacagaagttttttttaaataaacagatggtaattattaaaaataaaatgacagaaattttaaaaattcactggatgggcttagtagtagagaagagacagatgatagaatcagtgaacttgaggacagaacaacagaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaacacaaatgaaatgatttaagaaagagtggaagtgataaaagaagaaatcttggagcatcaggaaggaaggaacactgggaaagaaaaaatatggttgtataaaatgtactatctttctcttcatacattttataaatcatagtagatgactaaaacaaatttaacaaaaattatatctgatattcgtgacaatgatatttaaaagtggggaaagtaaaggaatctaaatggaacagatatttcaatacttcacttgaaatggcaaaatgttgataccagctgacattgaaaaagtaacgtgttagtttttcatgtaatactcagaaccacctctaaaaaaatgatacaaagagacacactcaaaaacactacaaataaatcatgatggaatcctaaataaaatgttcatggaacccacaggaaggcaagaaaagacaaatagagggacaaaagaaacagagaaaacaaacacaaaaagaataaaatgttaggtttaaatcttaaaatatcaaagattatttaaacataaatgttctaagtaagccaattaaaagacagggattggcatagtgaaataaaaccaaagactatcaaattgtactcaataaaaattaaataaatgaataatttttaataaattaaggagcaaattatcattaaaaatttattgagaattctccttcataattaggaggcaaaggaagttctttcaaatcattaaggtgcaaaatttcttttgctattaaccacttttatagccagaaaacattgatattcttgattttgccatggtagcacaatgctgatccaaaattttgatgctgatagtgttacaataataattatttgttttagttaaaatactaacttatacaacataaaagggtatttaccttaaaactataatcaagaatggtttatactgggaatgcaggatatttaaattttaggaatttattaatacatgtcatcaaattaatacatcaaagggaaaatatatttacaaatcaacagatgatactaaaatgaaacaaaatttaaaagcatttctggtttttaaatacaaatatacttacattttaaacgatttttaaaatactctgttatctactatatgtctgtctacttaggttccttatgtgagtagacaaagaacaatacataatgaatagaaagaatagaaagagaaacaatcagaaatagatcacaaaattggaaaggcaaatgggcaaataaacacagtaaagttggtacatttcccctatcaaatagataaaaagtaaaaccaaaattctcataaagtcctcataaattagtaattactgttaaaaggaaggcataaaattaatagatcatgaaaatatctattattcatttgcgtttaggcttctgggacatgggaatttgttgtgggaagtcagggaccccgaacagagggccacaacaggaattctatgcactgttgaaaataaatgtaatggtaatagaaattagtataaacaaaattcagaagtgttatctgctgatatatttcaagagtcttaaaatcgtacgcattatttagcttggcaattatacatcaagaaaaatgtcctgaggaaatggtgttaattttctgcaatgatttatttacagtgatgtttataattcatgagtaaaatttaaaagtaaataaaagttactttaaaaaaggctatcagatgcttctagctgcttattcaaacaattgcccctcttcttccttactataaaaacactgatttcattctaggtggcatgaagactagcctccagaacggattcttgattggtcttaatcacacaatcccattctcattggccagatacttatttcccagtctctattccagctaaagatagctacatcacccagttctggaccataagatataaggaaaaatctgttggacagcttctgggaaaagacttcttccctacaaaaggcaagctattttgaccttgcccctgattcctgactttgactattgtatggagatatgatgctttgagttttgcaatcatgaggccacaatgagaacaaaacagcaagatgtccaatatgaaggatgaaaagaggctgagtccttgataacattgctgatctgcccaacaagcaaaaaggttgcctgtctccagacttcattacataaataaatatacttatggttcatgtcatggttaaattttatgttactttcaacttactacatcctaattgattctgaggtgaaataatttgcccagagcaaagatgggactcatgcccatgtgtatctggctctaaagcttatatgtattacacatatataagctttaatatctattttaatgtccagcatgaccttacctctggcgatctttccttggtactgggatcctttatcaaccatgtgggtaccccactgtgggacataatgccatgtgtaaaaacttagaattagtgcttgtatctcttgatatccctgcgccttattctcttcattttttaaaatacaaaggtaggaataaagtgggctagataattattatgttgttttccagccacagattcctataactttccaacccaaaaccctccaaagagctcctaatgcacttagagaaagatgaaaatttctcatagacctcaagctgctatctggtctggtctatacttctctctctgacctctttgtgtactaccctccctctcattcaccatacacccattgcactaccttcctccttttccttcaaaatgcctagttcattttcaccttgggactctgcactagtatcctctccccagaggctgtctccttagggagacctttccttgtttcataatctgaagtagccacccagtcaccctaatttgattcttctcatatcttcatatccagattcttcatttatctctgtatgtgtctcaattattattttttcactaataatagaaggtaaggtccatgaaggcaaatatttttgtttgttctgccatatccatggtgtctacaaccatgcctgccactctgcaagtgttcaataagcaactgctgaataaacaaaaattgcataaaatagagtgtgaatatgcagaaaccatctgctagctgcttgcttctggcctctgtagccccagctgcagccaaaatttaataccacccccaagttcagggacctacaagggacctgaggaaagaacaattaagcagatccaggcttgaaacaagtaagttacataaagtctctgccttgctggtcattttattctgatccttatctttaattgggattttagaccctccgtggttccctatccctatattctccattgcacagcttcctcagtagcgcagaccctctagaacagaggtcttcttggctcttctctctttctcattcctaagacctgatatctggctcttgaacaccatgtggttgggccttgctttagatgacagattaccctaatgctgaacagtcctcatgggtctctgcattacacatctattcttgaaatactctgttatctcatggaaacttcccttgaccttgatcctgctaggctgacttcatgctggaatcatgactgctattgcatactctgtggatcccaggttttacccgctgaactggatcagtcataagtagggctgactcccctaatcttggcctctttcagttgccgggctggttcctaagatgcaacagaaataagtgtactgaataggataacttaccttggatagctcctgtccaggaccacaccgttggcaggtgacacaccgtccccattggtcccagtactcattttcttggcaatccatggtgggaagg

SEQ ID NO: 1416 - DNA, 43411 bp, Homo sapiens
ttggatatatttctgtttattggccaatatgaaatgtttgcagagcatcataaacaaacatagccctgccagtatctacacatgcatatggctcaagagttaacaaaatttctataaataacccatttatgagaaaaaataattaaaatgtaccaatattcaatgtaaaacactgaagacctagctagtagggtggggttggtagagaggagtgggacaggagggattatgatctcaatgtgacagggctgtatgttgtagaggggtatgctgtagtgctgaatcctttcctaacctggatctgagaatcttggaggaaaaaattattttcccaggctccctcctgtcaaaatccaagtcaaggtatatggagagaaaaacagtaatccaaaaaaaaaaaaattcattctcaggaaatacctccccttccttacaaacaaaaactacattttttttttttgctagttcatttagagacaacttaactgctgtttaggctcaatgtatgttgaaaatgtttttatcaagtgtactttgttcttccactgaccaataacccctttgtagaaagacacataaaagcacagtgctcaaagaaatatgcctcagcattgaaaagtaaaactgtaaaaagaactctcctgaagcaaatactcaactatggtatttgccatggccaaacagaaattataaagacgaaaatccttcacttcacctttacccgaaatactttaaaatgcaaagccaattgccacctccaattgctgaacctcaaaaagttggaattaaggtgattctgggtatggcttgggctgtccacatagcattcatgccatgagcaagcacactgaagaagtcttactctttcactttatcatatttttgttattattattattattactgtgttaccatcattatctttcctctagagcagcagtgtcaaatgtgggcttgaaccactgccagccacatggcaacctttgaacacctgcagcctgctgaagccaaatcatcccctgtctggatattatttcttctaccagaaggtctaaacatgatcagtgaaagccagtgagataagaataacctgttgcagaaaaacaaaaacaaaaacaaaaacaaaaaaaaaacaggaaacctaaaggccaaggcctaaaaccttggttaccacatatttgctaatacctgtgtggggccaggctgcttgcttggtacaggcttgtatttcaattgcttctaatcctcagtccagtacaatgggacctttttgctttttcccaagtccttttagtaatctgatcaattggttgccccaggggcccttaatcagtgtttgtagatggatgaacccaaaagatgtagttaataaaattctaaaagcaaaaatcttgctgtagacagcactcctttgccagagctagaacctggtgatgaagtgcacattctgcctaatgtacttaataaaccacttaatagttgtgggacaggaactagctgtacaagtttcagacagattcttggagaataaagaatacaacctctaaggaacttgtttttctctgagcatgagatgtataggtgggagctaaaggcaaaaagacaattgagaaagaatcaaaggggaacggtggtgagaaagctgggattgaattgacatttcaatagaaagaggcatactcagatgtccctacatggattgagggctgtctttgagggactgctgtggggtagtttggggaactcaggccccagaaggaagattactttggctcagaaatgttctgtaaggttccaaaatggcgaacttcagcccttctccctgctgagggtggtgagaacctcaaatacagggtgaggccccagggatctagagggaaagtgtttgccctgcctcatgctgcaatgcagcagtctgagacatgaacttgggaattatggcacgaggcctcccccaagatagatattaatgtgtgtgtgtgtgtttgtgtgtctatgtatatgtgtgtgtatgtgtgtgtgtgtgtgttgaggagggagacagtgtggaggagctaaaaggggagaagggtttgattttgtccctaaagtgctaggtagatgtgccaacacaattttgagaggcttacctgaccaaaaatgcagacatgaaaaccctaccccattcactgtcctctctcctcttctctataatcaagttgagctaggaacatgtctggtagtcccatgaatgtggaatctggctccccagactacaaaagggaagcaagaaatgctccagatcagtccttgtgaaatggagaatcaatcctctggtgggatgggataggatatgccccatctgtagggtattagctcttgtggacatcacatttcaggcccctgctgctgttgtggtataggaacagagtccagagagaacaactgggcaaggctgccaggggcccaagagacctaaggagagagcaaaccaagttagaaacatgtggggaaatctcactagcacccttctttctctacccctccaaatatcataggttaagccaatggttgaggatgtaatagcagaaagacattacctagatagggatatgacaattctaccctattctacattgttgaaaccatttatcctgaagataggtttagttctaagctccacatactttagaagaacctaaagtggtattctccagagaggtggtgttgtcttcaagcctctgcagggctatcttaaagcagaggaaactgatgaggtctgtctggcacgaggaacagagccaggatggataggcgggtactacagggaaagctctttcttacattgagctcaaacccaccagtcacaattgtgtatactgtaatatacattgagaagtagtcagccctctgccacctaaagtatgtgagcaaggactacacaaactcttagtggggatattataaaatggacccaaaccttggaagaagaactggactagataaccttgaaggtacctaagttgattgatttgacatcagttataactttcaaatttgatatcagttatgactttcaaatatacatttgttcacgttttcttaggttggatgcagggagcagggaagtcattgggagaactgaaaatgtattaactgaagaaatacggaagtgggcactgcaagatatttggttagttgaaaactgggaatctacctactctcctacctcatgctacataagctttgagaaagtaacattggctatcaaatggttgcaatggtggagttgaaccaactctaaaatgtagcccccaaacctgggttcttgcacagttctagcccactaatttgccctgtgactttgagaaactaactttccctctctgtgtctcagttcctgcctctgtaaaatgtaaaatgaagtgacatacacacaaggtttgtatagttattagggaatgaaggttgatttgaaatgtagggtttccagatgacaaggcttgtatatctttttctactgtgctatgctgcttgcacacataaagggagatacctgaatatgaccattagatagtggggccctgagagagcttacgaaagaccagaatggagagactggtatcatgacaaccttgccagttccctgacaattgtagacccagaagtgtgatatctgtctggcttaaaagtttagcatcaccactgttgcccctccacccaaagtgttcctagcttgctgctgttcctccactcctagtgaataatactattccaaaagagaattccttgaggttagtccttaatttctgttttgctttttttgtttttttctgatccacctttccagctcacctcattagagttaagggctgggaacttcaaagggcacattgagctccagcctgtctccagtgctttcgactgtgtttccccccaaggtctcagctccagtataggaggcagagctggaaaacttttgcaggtccagctctgtgcattcgatggggctgtggacccagtgggagtggctctctgaggtgcaggaggccatggtaaaggactcctgtgtggggaagccactagtcgagctgcagtcgtcctcgaggatagggttaagtggctgggtctgaaagatgttctcactcacttgggactcagcactggtctccttgctgggtggcacggggaagagagattcctcctttgctgttttatcagcctcaaactgcagcaaacctcctgcaactcgaagcagaaagccactgggttacccaaaagcaggggctcttctcagctgggcactgggtactgagtacaagacaggtaaaggtctgggagctgattctttccttcctctccctggggtctagagcacctagcaccaggctgaggtgacacagttgagaaacatacttacattcaggtatcagattgaggctagctggtactggatcagagaaaataatcaatttctctagagaaaaagaaacctttgtgggaaacaggattttgataccatctcccttgccataatcttcatggcctggtcttatgtctatgtacattaagttacatggcaaactagactctgcagatggaattaaagttatggatttcaaaataaggagagaatcctggattactctatgggtccaatgtaatcctgtgtccctaaaagcagaagaggaaggcagaggagacagagagtatcagagagatgtggcatgagaagaactcaactcatcattgctagttttgaaaatagaagggggccatgagccaaagaatgtaagtggtcctagaggctaggaatgaccttcagcttacagccagcaaggaaatgggacctaagtcctttaactgcatagacctgaattctgccacttttgtgcatgatcaagcagattctctcccagagactccagaaagaaacacagccctgccaatatcttaattttggcattgtgagactctaagcagagacaaaattgagcctactgaacttctgagctatggaaactgtgataataagctactaaatgtgtggcaatttgttatggccatgatagaaaagtaatacccccttcatgcatggatctggttcaacatcaggtcacaaactgagaacctatgggatttgtgtttgtcctctttgctttggttgtgattttgctctttattcaaattcattgactatggttaacacaacttcattaaaaaaaatccagatttctgaattctcttgaaaatgtagaagatcttgcaacattaaatatttccatatggttacaaacagctggatccaagtagtgggattcccctttagataagggatgtgctctgtagtttgccacagttgcacttttctctcttgcaaccttacactggatttaattcgcacatacatctcaccccagtatgtgtgtaagtcagtgactcctgaaaaacagttttccaaagtaagaaaatgtctagccttcctagcccttataaaaacagtgaggaaactgcctgccctcatattccaagcaggttaccacattattatcttcaggatagaaggagagcagaaaagggttacccatctctcttcttctgaggcagctctctgatattttctcattttcatcttctggaccctggagtccaaatgcttcattgctcatgtttcatgtccatgcacccagggcctaagcaacaactcttatctgggacactggcctccaaagtcagagacaggaaggtctaccttgagtcacagtgtcccaggagctagcaagaagtagactttgagaaaaatcataaaggaacaacagtgttccccgtgtatcctgcagcccatgaaatgctatattcatctccaattaagccagggcacaaccaaacatacctcttgggcttttcaagatcatctgctaggccccagagccaaactgacccaaggcaaatttacattagcaggatcttcccacacaaatactgcagctttgcacacagtatccagtgggctgaaaaggagtcctgagcactcttttatctagtaaactttatcttcccccttataaatcaacttcattctctgatctgagttcctgtttcagtgtccctgcctaactctcagttcccttaatggcaatgaagctgcactgaaccttggtactcttggctggagttctaactctttgcctggtcctgatcagccacattcccacctcccccatctttgtcctcagtgagctggcttttctgtcccacattcttgtctagtagctgaagttgtgcttaatagagatcacaatgttactgtgactttaaatatgattttccatctggaattttgcatggctgtctgatatggactgggctagacctcttgacatcagtattatctgagggagaaagtccaggtttgccaactactctggacatagggctttcagttatccccatttgtgaagttattatactgatagcagtggccttagacctcaaccacttttattacagtcgtatctcagatatagccaagccttcctcaattcatgacatgctctagaatttatacctactagtatagatataaagaattggaaaagaacccagaaatcaacaaatccaatcctatctcttatcttaaagattaggaagaaagaggtctgaagaggctagatgacttgtctaaggttacacggtgatttagaggtagacatagaacctaggtctcccgattcctttcctgaggggtttcccaccgtgccacattcctttaaaatcccctgaaacataatgaaccaggtcttctaaactctcagggttggcttcagtaatctcttaagtcccatgctttccattgcagccccagatagttccccaggccaacagaagactattcatggggttttcaagcatggtagaaaaggcccattgtctctcaaccccagaacatccctctcttctgccaataagagccttgttcctgattcatgtgaaacatgaaacagccacccttaccacgctggcaatgtctgttgaagaactgcttgcagtagaggaagaagagccccaggaaggccagggtaaacaccactagcaggctgctcaccagtgcaacaagtgtggcctcctgagggggcactgtgggtgtatctgcctccactaagctcaactggaaggcacctgtgagacaaaaaaatgggggaggtcagttagcatgggcagtaaacagtcaccctgaccctggacctggacttcctcaggctgtcacccttctccctagggccttccccaattagggtggctatgctggttttacttctttctagagcaggcaaaattataaagaacaaggcaaaataatttgtatatagtgctggtatgtagaaattagtacaattaatcgaagatgcacatatcctgtgatctttctgtgccacatctaattatataatccagatcaatggaaacaagctaaaaaattcatcagtagagcacaagataaacaaatcatgatataatcctaaaatcttacattattatacagcacttaaaggcctttatggatcaatataaataatctagagggggaaaaaggaagttggagaaacagaacatatagcttgatatcatttctataaaacattatacaatacataacaatagcatatattggttatgaatatgcacacatatcacaaaagaacccaagtattaaaacattagtggagagtatggcagaggtatagtgctcaccagttatccacatactcccatgtatttcccttacacccttgcagtaaggccatcagagtacttctggccaatgaactgtgagttgaaataacatgtgtcacttccagactgaggcagttaagaaccagtatgtctcctccatctcttcccctgtgtcattgacctggaagacatatggtctagaatgcacagtcaaatgatgtaggaaggcctttgcatagtaaaaaaaaaataaacttttattgtataaagtcactgagattttgcagtttgtttgttactttagcatagcctaccaacagaatacatacaatttcaggatagtggttgtatctgaggaggtagggaggtaataggactctgagagaatctagaagagaattccattatatctgtggaatctttattcttttaaaacatctgaagcaaatatgcaaaatgctatgatttattaactttggatagatgctgggtgattgcattttaattttatatttttctgcacttaaaaatatttctacatgtttgaaaactttcatgatttaaaaaatatgtcaataattttaaaataggaagtaagtaaatagatggtagacaaaaaagatagacgattagataaatggatagtggtataggcatagattggaccctagttcttcattcagcctcttacaagtcctcagccctaggggctcctatatacttcatataataataatatctcataggtttacaaatattataatttgtgaagtgcttcctaacatccattttctcattagacctagatacccatcacacaaggtatgaagaaaaatgattatcatgactcacccttttttcagaagtaggaaatgaggttcaatgagattgaatgatttgcatagagttgcaaagataatatgttgtaaaaccagacttctaatctgattcccttgccactctactctacatgaaaaggtatgaggggatatgggtagtctttactaccctatcttgctgccacccaatgggatgaggagaaagggaagaagagaactgggtacacacattgaacctcagaggtgggggtctgcttcgtgcacgggatgcactcttggtcctgcaggcctccaatgcgtgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgttcttctggaaagcaagtttttattctatctatagcactggaatcagaagatatgtgcctgactcctcacttactcacttgctagagaagggaatgacaaaagcaagctagcatttattgaaagttaaccaataagttgagtgattgattgattgattaattggttagcactccctttcattttattggttaactcagaaaacatttttgaagcaactacaatgcatgaggatgctattctgaatattgtgactaaataattgaatcaatcagacaaaaatccacacactcatgaatttatatacttgtttattcatcataaaaccttataagggtgcaatataatccatgtttcacaaataagcaaaattgaggcacaaattgttggcctgagaagcctcttccccatgggcctgcgattccccacacacaactagagacaataggctgcagggggcacttgagattccaccataagtaaccagctcaaatgcttctttgtcctgtgggtctgagattattttcccccacataggaacaggtggctggggtatactggcaagtggtatcctactaataacaagtggtcgagcatgggaaatgttctttgactctacaactcagacacttctttatgccgacctaaatggaccaagtgacctggcccaggaaatcgtctatacctgaggcagcacaagataaaccccgcagaccaaaaatcacactacaaaggttctggaaattaaatagcctttagaactgcagctcacaaacgtaggccaaaacctgtatgctaaacataaacagatgactgcctgctaaagtaaaagtttaaataggaccctgagtctcctgacataattgacaaaatgtccagaacacaacgaaaaaccacccatgataataagaataaggaaaatcacaacatgaatgagaaaagtcaattaactgacagcaactcttagataaagcagatgttggaatgattgaacaaggattctaaagcacccataataaaaatgttttaaaaaacaatttaaaattctcttaaaaatagaaaatctcatcaaagaaacagaagttttttttaaataaacagatggtaattattaaaaataaaatgacagaaattttaaaaattcactggatgggcttagtagtagagaagagacagatgatagaatcagtgaacttgaggacagaacaacagaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaacacaaatgaaatgatttaagaaagagtggaagtgataaaagaagaaatcttggagcatcaggaaggaaggaacactgggaaagaaaaaatatggttgtataaaatgtactatctttctcttcatacattttataaatcatagtagatgactaaaacaaatttaacaaaaattatatctgatattcgtgacaatgatatttaaaagtggggaaagtaaaggaatctaaatggaacagatatttcaatacttcacttgaaatggcaaaatgttgataccagctgacattgaaaaagtaacgtgttagtttttcatgtaatactcagaaccacctctaaaaaaatgatacaaagagacacactcaaaaacactacaaataaatcatgatggaatcctaaataaaatgttcatggaacccacaggaaggcaagaaaagacaaatagagggacaaaagaaacagagaaaacaaacacaaaaagaataaaatgttaggtttaaatcttaaaatatcaaagattatttaaacataaatgttctaagtaagccaattaaaagacagggattggcatagtgaaataaaaccaaagactatcaaattgtactcaataaaaattaaataaatgaataatttttaataaattaaggagcaaattatcattaaaaatttattgagaattctccttcataattaggaggcaaaggaagttctttcaaatcattaaggtgcaaaatttcttttgctattaaccacttttatagccagaaaacattgatattcttgattttgccatggtagcacaatgctgatccaaaattttgatgctgatagtgttacaataataattatttgttttagttaaaatactaacttatacaacataaaagggtatttaccttaaaactataatcaagaatggtttatactgggaatgcaggatatttaaattttaggaatttattaatacatgtcatcaaattaatacatcaaagggaaaatatatttacaaatcaacagatgatactaaaatgaaacaaaatttaaaagcatttctggtttttaaatacaaatatacttacattttaaacgatttttaaaatactctgttatctactatatgtctgtctacttaggttccttatgtgagtagacaaagaacaatacataatgaatagaaagaatagaaagagaaacaatcagaaatagatcacaaaattggaaaggcaaatgggcaaataaacacagtaaagttggtacatttcccctatcaaatagataaaaagtaaaaccaaaattctcataaagtcctcataaattagtaattactgttaaaaggaaggcataaaattaatagatcatgaaaatatctattattcatttgcgtttaggcttctgggacatgggaatttgttgtgggaagtcagggaccccgaacagagggccacaacaggaattctatgcactgttgaaaataaatgtaatggtaatagaaattagtataaacaaaattcagaagtgttatctgctgatatatttcaagagtcttaaaatcgtacgcattatttagcttggcaattatacatcaagaaaaatgtcctgaggaaatggtgttaattttctgcaatgatttatttacagtgatgtttataattcatgagtaaaatttaaaagtaaataaaagttactttaaaaaaggctatcagatgcttctagctgcttattcaaacaattgcccctcttcttccttactataaaaacactgatttcattctaggtggcatgaagactagcctccagaacggattcttgattggtcttaatcacacaatcccattctcattggccagatacttatttcccagtctctattccagctaaagatagctacatcacccagttctggaccataagatataaggaaaaatctgttggacagcttctgggaaaagacttcttccctacaaaaggcaagctattttgaccttgcccctgattcctgactttgactattgtatggagatatgatgctttgagttttgcaatcatgaggccacaatgagaacaaaacagcaagatgtccaatatgaaggatgaaaagaggctgagtccttgataacattgctgatctgcccaacaagcaaaaaggttgcctgtctccagacttcattacataaataaatatacttatggttcatgtcatggttaaattttatgttactttcaacttactacatcctaattgattctgaggtgaaataatttgcccagagcaaagatgggactcatgcccatgtgtatctggctctaaagcttatatgtattacacatatataagctttaatatctattttaatgtccagcatgaccttacctctggcgatctttccttggtactgggatcctttatcaaccatgtgggtaccccactgtgggacataatgccatgtgtaaaaacttagaattagtgcttgtatctcttgatatccctgcgccttattctcttcattttttaaaatacaaaggtaggaataaagtgggctagataattattatgttgttttccagccacagattcctataactttccaacccaaaaccctccaaagagctcctaatgcacttagagaaagatgaaaatttctcatagacctcaagctgctatctggtctggtctatacttctctctctgacctctttgtgtactaccctccctctcattcaccatacacccattgcactaccttcctccttttccttcaaaatgcctagttcattttcaccttgggactctgcactagtatcctctccccagaggctgtctccttagggagacctttccttgtttcataatctgaagtagccacccagtcaccctaatttgattcttctcatatcttcatatccagattcttcatttatctctgtatgtgtctcaattattattttttcactaataatagaaggtaaggtccatgaaggcaaatatttttgtttgttctgccatatccatggtgtctacaaccatgcctgccactctgcaagtgttcaataagcaactgctgaataaacaaaaattgcataaaatagagtgtgaatatgcagaaaccatctgctagctgcttgcttctggcctctgtagccccagctgcagccaaaatttaataccacccccaagttcagggacctacaagggacctgaggaaagaacaattaagcagatccaggcttgaaacaagtaagttacataaagtctctgccttgctggtcattttattctgatccttatctttaattgggattttagaccctccgtggttccctatccctatattctccattgcacagcttcctcagtagcgcagaccctctagaacagaggtcttcttggctcttctctctttctcattcctaagacctgatatctggctcttgaacaccatgtggttgggccttgctttagatgacagattaccctaatgctgaacagtcctcatgggtctctgcattacacatctattcttgaaatactctgttatctcatggaaacttcccttgaccttgatcctgctaggctgacttcatgctggaatcatgactgctattgcatactctgtggatcccaggttttacccgctgaactggatcagtcataagtagggctgactcccctaatcttggcctctttcagttgccgggctggttcctaagatgcaacagaaataagtgtactgaataggataacttaccttggatagctcctgtccaggaccacaccgttggcaggtgacacaccgtccccattggtcccagtactcattttcttggcaatccatggtgggaaggctgtgggtagagaacacaagaactagcaagctagtgggaagggactataagtagtggcttccatgccacttggcttctgggtccccttaatctattctctagatctgagatagtagggacgaggaagccaacacaaaagagttaatgcttatgtagctctgaccatgtgccatgagttcttgtaaatgctttgcatgtagtaactcattccattctcaagacaatcatattaagaattattgttagcaacattttacagatgaagaaactgaggcaaagagaccaagcaatttgctcaaattcacagtcagtggctataccaggagctgaatttgtaaagagagtaataagacaaggagttggcttctgcccagggggtaaagaataatcacaatccctcatgtgtgaacagatcataacaatttagaaagtactttcacatctattattatttgatctacacaacatccatgtgaggtaagcattatagagattgtcatctttattttataactgaaaaagctgaaacattgtttctctttgccaacagtggcctcagtacctctgaggaccaatacctgccatagcttctgtcttaggcagaatgggaggggagaataacccagaatgtagacatattttggtgcacaaaggtgcacagatagggaaacattactcagataatagttcttggaatacagatgcatatagcagtagagctagcattgaagtgggatggctgttcaccaagcctggctcttaccctttcaatctacaatctgggatggatcactttatcttttctggcctcggttacttaatctaagaaaaagggatagaatgttcttcacctattgtatatagctcttgggagggttaaaggagctaaggtccatcaaaccattctaaagagctatacaaaataagacagagttaagtatgcagaaaggttgtcttctacaaagaggaattttaatgaaggggctaaagtaattcataaatggggcttatcctactcaaagagaaaggtagcatgaggttctttacttactcatgacttcatactagggtgaatttcaagtggtttctaaaagtgccaaagtcctaaatgtgtactcttagtcagaagagacgagagtgtacatgtgtaccttgagaggccaccactcctccactcaaagttccccaaaagcgacaggttaagtcattctaaatggcattccataagtgcacctttttttcatcatcaactgggccattctttcccattccttcattcaaaggaaagtgggctacaagatccatgcttgcataagataaacatactgtcttctgtgctgatttgattgctggcccatggtgttggcctcagtaggcatgcttccctccccttgccatgcactcttctccttgagaacagaaaacttcagtattctcatagccttcatgaccaggaagttaagcaccacagtaacagggccaggaaactgctctggacaactttctcatatccctttttgcccacaaaacagaaaaacattggcaggaaccaagaagtagccctctttttgagctaagttcccaacataggcgtttaaaatctccatgacaactgctgctggcatttgagggtctgagacatcctatttcatttggtttctagagctccacccccctaataaacatcatgtgtcctaaaccccaacatgtctctctaaccatggctttgaaacctctgtctaggcaaggcaggcttggtgccaaattgagcagagggactttctctcccctcttttttccctccctccctcccttccttccttccttctttccttccttcctttcctcctttctttctctctctctctccttccttccttccttgatggagttttgctcttgttgcagtgcaatggtacagtcttggctcactgcaacctctgcctcctgggttcaagtgattttcctgcctcagcctcccgagtagctgggattacaggagcatgccaccatgcccagcaaatttttgtatttttagtatagacagggtttcatcatattggtcaggctggtctcgaactcctgacctcaggtgatccacccgcctcggcctcccaaagtgctgggattaaaggcgtgaggcaccttgcccagccttccctctttttttctcatactatttattcaaagcatacaaattaaattatctttcattcgacgcttaacaaattgactttattaaagagaacaaaattatagattctggactcttttgaagaggtcagggcgtatgtgtaaaactacctaataagggttaaatgtcattacctagggagaaagtcagaccttatatgaatttttccctgtaatcaacagtttcctgtagcatatgtaaccgccttttaaaagaaaaaataagaaagaataattatgttttcagaaaattatagttactctgaggtattccatactgcagctagacactcttccaaagtatcacaaaggatgtggctgaatcctctaaacttctggctaagttggcaatatatacagacctataaagttcccaagagtagagaccactgcatgcccagtgcctagccctgcacctggcacagagtgtgtacctcaacagtgcttactatttgttagcttatcaacatgctacattccctggactatggttaactatgcatatgaatctagcaacatagatcatttctctttaagataatgactttccaaacaatagtagtaacctcacatccatcaaaaaaagagcaaagctcttagttagggacatgtagacttgagttttaattttaattctgcatcctcaaacaaatagttttacctttgtcagcatcagttttttcatctgcaaaatggatgtttaaataatatactgcacagtaatttagaaaattaaatgcaataatacatattaagggaccaagtatagggcttgatacatatgagacgtttggtaattagcaggttccctttcttctttcctcttcagaagagtgaggtttatagtaaaaggagtgcacatttgtcatttttgggatgtgtggggaagaaaaaggaaaggcacccaagcttcttcattgaccatttcagctggagcatgaaggccatgtttaagatggatgccactatagcagtttcctcctcattaatcgcaaccaccagtgacctgatgcttaaggaaaagattctccaagataccctcagtgcctaagccaccttggctaaaagaaacattgttctaagtgtttgctggatttttttcatcaaggcatttctgtataggattaacttggtcaacaaacgtttggaaacttttccgagacaattgcctttgaaatggaagtgaaaaagaaataaaatcagatttgcaaataagtgaggatgttattatggactttatgaaatagcacatgattttccacagaacagtccctctcacctccacaacctaaggttatggctgctcaagaacatttttttcaccccaactctgacatggggttgtgttctctttacattactgagggttggggagaggaagggaagtggcagatgcctcttgtctcaatcccatggagtataacacatgatgaggttctgattctgctaaagcgcatcacccactcagttgtactgtttgtcagctacaccctgaaatacttcctccaacttcccaacttgcccagagaatatctgatctgtgtaactcagaagttacacagatgaggtaatgtggaagtgctctaaaaattcatgtgggtaacatgctgggattttttgtctgtttctgattgcagtacaacatatacatagtaaggagcataaagattaaataaattaataaatttttactgtgtacatgcccatgtaaacaccacccaaataaatacacagaacttttctattaccccagcaggctccctcacgccccttcccagtcaatatcgactcctccccagataattacagcactggcttctatcactacaattagttatacctgtccttgaaattcacataaatttgaatcatacaagatgcgctcttctgtttctggtttctcttgataactataatgtctgtgatagttatccattatgttttgtgtagcaacatttgttaattactattgttgtgtagtatcctattgtatggatataccacaatttatatatttttcttggcaaacattggactgcttttaatttgaggccattataaattgagttgctatactatggtcaatggattttttaaagaatgccaagaaaattcaatgagaaaaaaaatcttttcaaagaagggtgttggggaaactggatatccacatgcaaaagaatcaaatcggacccctacctcatatcatatacaaaattaactcacaatagactaaatccccaaatgtaagagttaaaactataaaactcttataaaagttttcttacaagaaaacataataattctgtaattaatgtttttcttataagaaaatataggtgtaaatttttgtgacactggattaggaagtagttgcttagatataacaacaaaagcacaagcaacaagagagaaaaacagaacaatgacatgtcaacaaaatttaaaaattaaaaatgtttgtgcttcaaaggacaccatcaagaaagtgaaaagacaatccacataataggacacaaaaattttcatatcacatatctgataagagacttgtatctaaatatatagaaaactcttgcaactcaaaaaaagatagataatttaaaaatgagtagagaatttgaatagatatcactctaagacttacaaatggcccataaacacatgaaaagatggtcggtgttatcagcaacaaagggaatgaaaatgaaaaccacaataaaacagcactttatatccactaccaaaaaaaaaaaaaaaaaaaaaaaatagccggccaggcacggtggctcacgcctgtaatcccagcactttgggaggccgaggcaggtggatcacctgaggtcaagagttcaagactagcctggccaatatggtgaaaccctgaatctactaaaaatacaaaaattagccggggatggtggcaggcacctgtaatcccagctacttgggaggctgaggcaggagaattgcttgaacccgggaggcagaggttgcagtgagccgagatcgtgccattgcactccagcctgggggagaaggatgtggagaaactggaacccttgtgtattgctggcgagaatacaaaatgatgcagcccctttggaaattaattttgcagttcctcaaaatgttaaacatcatgttacaacatgacccagcaatttcactcctaagtgtaaatacccaaaagaattgaaaacatgtgttcatacaaaaacctgtaaacaaatgttcctagcagcattatttataatagccaaaaagtggggaaaatccacatgttcatcaactgataaatggtaaacaaaatgtggtttatccatacaatgaaaattattcagtcagagaaaagaatgatgtgcttaacatgtgcaataacatgaatgaacgttgaaaacattatgctaaataaaagaagctagacacaaaaggacaaatgttgtatgattctatttacatgaaatgtccagaataggcaatcaatcataaactagctttagtggatatcagggcctggggagaaagggaaatgggaagtgactgctgaataggtatgtttctttctagggtcatgaaaatgccctggaattagacagtggtgacggtcgtgtgactttgtgaatatgctaaaactagtgaattatacactttaaaaaggtaaatcttatagtatgtgaattatatctcattttaaaagatggttctttagctttatttaatactttgaatttattattccaataggatattgcttaagttagccccccaaaaaatgttaaagctgctatgaatatttttacacaggcctccaaatataatttgattcatccaacttctcacccaaacttatccaagtatgtgttgtatataccttgattgtgtttacaagggccaacaagtggcaatatgactagaattattcccttattttgcctgtctgtcatgtggctgctcttcccacccatctccctgtcctgattcctcaaaaaataatgtagacgattaagaatgcaagcagacagggaagaggagaaacaatacagctgacatcaatagtaatccccaaattagctcatcatgccctgaataattgatgttggccaagtttctgctggatgtgaggtacccaggctgctgggggtgcagctgctccttgctgcagcttgtggctgctgctcttctcaacttgcacacatgcctgtggggtgaaacatgctctctctatgtagtatgggtaggcaggaaagaaggacaagtctaaattaagaactcagtacttcaggatatttgctttgcctggacagtgcaggaggtgtgggattaaaaacgatgaagaagacagcagatggtctccatgccttgcccattcctctactgcgagcccatctatccacccacatgcacaagacagaatcaaagaagttgctcaacgtagccttgagaacactgctttcttgaaaatcaagcttctaaactgtacagtgccatcatttccagatgcctggcctgtaattcaaatgttgctttaccttttggtgttggcactcagcctttcccttttctgaactgacccaaggccacttctatccaaggtttatcttgtttataacctccttccaaactatcaaacatcatatcttccttctgccccactatttgtaaagtttgcatttcctgttttagctcagcatagtgaatggtcctagtcccagctctgccatcaggagaatatcccttcccaatgctggaatcaagttctccattcataccacgagggagttggtttggctaatctcttagaccagtggttctcagtcttggttgcaccttgggagtgccaaaaaatagtgacacctgggtccctcccctaagattctgttgtagttagtcaaaaatgtggcatgagcacgctacattttacagttcaccaagtgattctcatgtgcagtcaatgttgaaaatcacagttttaagggctcttttcttttagttctgaccttgtctgtttcacctgaaaataaaatgcagtcagaaaaaaaggtttttctgtatctctcccccatattcagagagaatctgttgagggagaaacccaaggtctatccatttttttctagggagaatagaaaataaagataaaggggataaaacatgttagatcatgtcatttccagcctcaaaagccattgatggctccctctttcactcataatatcacataagtcctacacagttttggatataacttaaaaaatgaatgggtatgtaaaaacataaaatatacacagtgatgtatggcatataataaagagctcatattttaaaaaattaagttcttataatggccaatagagaccttagatgatacgcctacctcaatttcccccattatttattgaccttaagttctactactcttttccttattgtcttcactccacccatgctggcctccttgttgaacttcaaactaaccagaaatgccttcatcttaaggccttcacatctgctgttccctcaagcaggaatgttcttccccagatacctgcatggctacttccctcatcttcttcagttctttgttcatatacagtcttcttagtcaggcttccctgaccactctctcaaattttcaccttctttccagaattcctatccccgtttccagttttattcttttccatagcacatatgaccttatgacatatcataaatcttatgtactttattgctttttcttccccagttagaatgtaaatgctatgaggccatggtacgtattgtgtttgctacttcatcatcagtgcttacaatagtgcctggcacacagtaggcattaaacaaatatttgttgaatgataaaatggtgaaaatctacagaatactgggaatactctcctgtctgagtaaaaggtttcatagtttataaaggattttacatcgattagctcaacagatcaccatcacatccctaggaggaagctagggattgttatcaaaaattaataaatttgggcaggtgcagtggctcccgcctggaataccggccctttcagaggcctagatgggtagatcacatgaggtcaggagttcaagaccagcctagccaacaagatgaaacctcaattctactaaaaatacaaaattgagctaggtgtggttgcatgcacctgtaattccatctacttgggagactgaggtacaagaattgcttgaacccaggaggctgagtttgctgtaaaccaagattgtgccactgcactccagcctgggcaacagagcaagactctgtctcaaataaataaatgaataaatacattaaagaagaagatcacatgatgaggaaggaacagacagatctgagatcttgctcaagatctcagtaaagaagtagagctgggggatcatcatggcagacgggaggcaggactagattgcaattccaactcagatggacagagcagtgtgaggaggtttgcatcgtgcattttagctccaggacgactgcaagaacaaaccagggatctcgagaggacctacagacactcttaggaagtggactgctcctgcaggacccaggagacactccaaatactttgagcactccaacagcagaagtgggaaagggagatcctccattccttaacacacacccacactggggaaacacttaacacactggggaaacacactggggaaagtctaatttgcaggagaagtttctgactttacctggagctgagtcaatttagagagctgagcaaaatacaggggtagaggaagcagcgggaaaagccccgggagtttgctgggtccccaagcaggcctggaaccacagggaaccttcagaagggtcgccagaggcacaggggaaaatgccacggggaaaaggaagtctccagctgaactttgtaacaatttgaaccagaagagaagcatcctggccagaacttggggtagggcatgaatctggtgtggagactctaaaggagtgggaagaaccaaagcccttttatttcacagctgggaggtgggtaacctggggcaggttctcaagccctactcacccattgcctggaaacagacttgggactgttatgggagcacagtgggagtgagactggccctttggattgcatgggagctgggtgaggcctgtgactgccagctttgacccacttccctgaccacctgcatgactcagcagaagcagccataatcctcctaggtacacaactccatggatctgggaacctcacccccacccacacagcagccacagcaagacctatccaaggagagtctgagctcagacatgcttagctctacccccacctgatgggccttccctacccaccatggtagctgaagacaaagggcatatactcttgggagttctagggccccgtgtactactggttcctctccatactaccaaagctgatgctctctgaaaagcaccacctcctggcaggaggccaaccaccacaaaaatagaacattaaaccaccaaagctaagaactgtcacagagaacatttcatcccttgacacctccaccggaacaggtgctggtatctacagctgatagaccaatagatggttcacatcacaggactctgtgcagacaacccccagtaccagcccaaagccggatagacttggtgggtggctagactcagaagagatataaaaatcactgctgcttggctcacaggaagccacatccataggtaaagggggagagtactacatcaagggaacaccccatgggacaaaagaatctgaacaacagccttcagccctagaccttcccactgacagagcctacgcaaatgagaaagaaccaaaaaaacaactctggtaatatgaaaaaacaaggctctttaacaccccccaaaaatcacactagctcaccagcaatggatccaaaccaagataaaatctctgatttacctgaaaaagaattcaggagattagttattaagcgaatcagggaggcaacagagaaaggtgaagcccaatgcaaggaaatctaaaaaatgatacaagaagtgaagggagaaatattcaaggaaatagataccataaagaaaaaacaataaaaacttcaggaaacaatggacaaacttttagaaatgcaaaatgctctggaaagttcagcaatagaattgaacaaatagaagaaagaaattcacgactcaaagacaaggtcttcaaattaacccaatccaacaaagacaaagaaaaaacagaataagaaaatatgaacaaagactccaagaagtctgggattatattaaacaatgaaacctaagaataatcagtgtttctgaggaagaagagaaatctaaaattttggaaaacatatttgtggcaataacagaaaaacttccctggccttggtagagatctagacatccaaatacaagaagcacaaagaacacctgggaaattcatctcaaaaaaaatcattgcctaggcacattgtcttcaggttatctaaagttaacacaaaggaaagaatcttaagatctgtgagactggaaaggaaaggaagaggagggaaggggaggggaggggaggggagaggaggacaggggacaggaggagaggagaggggaggggaggggagggaaagtgtaaaagcaccaggtaacccaccaaggaaaacccatcagattaacagcaaatttctcagcagaaaccctacaagctggtagaaatttgggccctatattcagcctcctaaaaatatacaactatcagccaggaattttgtatccactgaaagtaagcatcatatatgaaggaaagatacagtcttcttcagacaaacaaatgctgagagaattcaccactaccaaaccaccactacaagaactgctaaaaggagctctaaatcttgaaacaaattctggaaacacataaaaatagaacctctttaaagcataaatcacacaggacctatcaaacaaaaacaaaatttaaaaataacaaaaaagcaagatacacaggcaacaaatagcacaatgaatgcaatggtacctcacatctcaatactaacattgaatgtaaatggcctaaatgctccacttaagaaatacagaactgcagaaaggataaaaactcaccaacaaattatctgctgccttcaggacaatcacccaacacataaggactcacataaccttaaagaaaagggatggaaaaaggcatttcatgcaaatggacaccaaaagtgagcagaggtaactattcttatatcagacaaaacaaactttaaagcaacaacacttaaaagagacaaagagggacattatatcatcatacaagtccttgtccaacaggaaaatatcacaatcctaaacatatatgcaaataataccagagctcccaaatttataaaacaattactaacagacctaagaagtgagacagacagcaacacaataatagtggcgaacttcaatattctactgacagcagagatagacagcaacacaataatagtggtggagttcaatactctactgacagcactagacaggtcatcaagagacaaagtcaacaaagaaacaatagatctaacctataccgtggaataaatggaattaacagatatatacagaacatttcaaccaacaaccgcagaatacacatcctattcaacagtgcatggaactttctccaagataggccgtatgatagggctcaaaatgagcctccataaatttaagaaaactgaaattatatcaagcactctgtcagaccaaaatggaataaaactggaaatcaactcaaaaaggaaccttcaaaaccatgcagatacatggaaattatataacctgctcctgaatgatcactgggtcaaatacaaaatcaagatggaaattaaaaaaattcttagaactgaatgacaataacaacacaacctatcaaaaggacacagcaaaggtggtgctaagaggaaagttcatagccttaaacacctatatggaaatgactaaaagagcacaaactgacattctaaggttgtgcctcaaggaactagagaaacaagaacaaaccaaacccaaacccagcagaagaaaggaaataaccaagatcagagcagaactaaatgaaattgaaacaacaacaaaaaaaaacacacgaaagataaataaaacaaaaagctggttctttgaaaagacaaataaaattgatagaccattagcaagattaaccaagaaaagaagtcagaaaatccaaataacctcattaagaaacaaaatgggagacattaggactgacaccactgaaatacaaaaggtcatttcaggctactatgaacatcattacacacataaagtagaaaacctagaagagatggataaattcctggaaaaatacacccccccagcttaaatcaggaagaattatatatcctgaacagaccaataacaggcagagatactgaaatggtaattaaaacattaccaaaaaaaaaaaaaaatccaggatcagatggattcacaactgatttctagaagacattcaaagaacaattggtaccaatccttttggcactattccacaagatagagaaagagggaagccaccctaattcattctatgaagccagcatcaccctaatacctaaaccaggaaaggacataaccaaaacagaaaactacagactaatatccctgatgaacatagatactaaaatcctaacacaatactagctaactgaattcaacaacatatcaaaaagataatccaccatgatcaagtgggtttcataccagggacgcagggatggtttaacatacacaaggcaataaatgtgatataccccataaacagaatttaaaacaaaaatcacatgatcatctcattagatgaagaaaaagcattcaacaaagtctagcatccctttatgattaaaactctcaacaaaaccagcatacaacagacatacctcaatgtaatgaaagccatctatgacaaacccatagccaacataatactgaatggggaaaagttaaaagcattccctctgaggactggaataagacaagcatgcccactctcaccactcctcttcaacatagtactggaagtcctcgccagagcaaccaggcaagagaaagaaataaagggcatccaaactggtaaagaggaagtcaaactgtcactatttgctgaccatatgatcatttaccttggaaaccctaaagactccctcagaaagctcctagaactgataaaataactcaacgaagtttccagatacaagactaaagtacagaattcagtagctctcctatacaccaacagtgacaaagtggagaatcaaatcaacaactcaaccccttttacaacagttgcaaaaaataattaaatacttaggaatatatctaaccatggacgcaaaaaacctctacaaggaaaactacacaacagtgctgaaagaaatcatagacgatacaaacaaatggaaacatcccatgctcatggatgggtagaaacaatattgtgaaaatgaccatactgccaaaagcaatctagaaattcaacacaattcacatcaaaataccaccatcattcttcacagaattacaaaaaaaaaatctaaaattcatgtggaaccaaaaaagagcccacataaccaaaacaagactatgcaaaaagaacaaatctggaggcatcacactacctgatttcaaactatactataaggccatagtcaccaaaacagcatggtactggtatataaataggcacatagaccaatggaacgaaatcaaaaacccagaaataaccccaaatacttgcagccaactgatctttgacaaagcaaacaaaaacataaagtgggaaaaggacaccattttcaacaaatggtgctgggataattagcaagccacatgtaggagaacgaaactggaatgtcatctctcacattacacacaaatcaattcaagatagattaaggacttaaatctaagacccgaatctataaaagttctagaagataacattgaaaaaacccttcgagacattggcttaggcaatgatttcatgaccaagaacccaaaagcaaatgcaataaaaacaaagataaatagccgggacctaattaaactaaagagcttttgcatggcaaaagaatcagtcagcagagtaaacagacaaaccacagggtgggagaaaatctgcacaatatatacatctgacaaaggactaatatccagaatccacaatgaactcaaaaaaatcaggtagaaaaatcaaacaatcccaccaaaacgtgggctaaggacataaatagacaattttcaaaaaagatatacaaatggccaacaaacatatgaaaaaatgctcaacatctctaatgattggggaaatgcaaatcaaaaccacaatttaatacctcctcactcttgcaaaaatggccataatccaaaaataaataaaaacagtagatgttggtgtggatgtcgtgaacaggcaacacttctacactgctggtggaaatgtaaactagtacagctgctatggaaaacagtgtggatattccttaaagaactaaaaagaatcatatatatatatacacacacacacacacacacacacacacaaacacacgtatatatatatacacacacgtatgtgtatgcatatatacatatatacacacacatgtacatgtgtgtatatacgtacatatatacacgtatgtgtgtatacatacatatatacacgtatgtgtgtatgtacataaaaacacacgtttgtgtgtatatatacatatacacacacatgtgtgtatatgtatatatacacatatatattgatgagattcgagactattattcttagtgaagtaactcatgaatggaaaaccaaacactgtatgttcccactgatatgtgggagctaagctatgaggatgcaaaggcataagaatgacacaatggactttggggacttggagggaaggcagtgaaggggggcgagggataaaatactacaaatagtgtgcagtgtatactgctcaggtgatggatgcaccaaaatctcacaaaacaccactaaataacatatccatgcaaccaaataccacctgtatcccaataacctatggaattttttttaattaatagattaaaaaatactgaggctcagagggaaaatatacaactatctttatttggctagcaaaaagcaaggcagaacccaaaggtcatttagaagctatgagtctggcacacttttcaaggcagtattgaactctaaaatagagaatggaggtcctcccagtcttcactgaaattttttcttcagtgatatttcaggatgggcaaaaaagcattttattaatgttaacctgagtgcattttaaataatggtttgatagggttactgcccaagctttaggagacaagggccaggtcaaaggtggttacaataggaacagagaggaatgatggtgggagatacaaaccttacaaagtgaagacaaacagaatgaccagagttagagattctgggagtttctgcctgggaaaccagaagaatctaagtgccatgagaagcgtgaaaggagcgcagcttggtaaaagaaaagaaaatgcactgtttttcaattattttcagtatagagaagttgaaggggacagaggaacatttcagtggtcatgcccaacaagcatatacaatatgtaaaatataagttgaagttggagatgtgtcaaatgcataaaaacaccagaataacagttcttgcttatggctgcacatcagaatcatatggagcactgaaaaaaaaatcctacgctctagattaattaaataaaaacctctggggttggaataaccactggccgaagtaaatcatggcagaagttaaatcatgggtaaagaagaatggctggatgcagtggctcctgccggtaatcccagcactttgggaggtcgaggcaggtggatcacttgaggtcaggacttcaagaccagtctggccaacatggcgaaaaactgtatctactaaaagtacaaaaattagccaggcgtggtggtgcatgcctgtagtcccagctactcgggaggctgaggcaggagaatcgcttgaaccctggaggcagaggttgcagtgagccgagattgtgccactgtactgcagcctgggtgacagattctcaaacaaagaagaagaagaagaagcaggaggaggaggaggaggagggtgaggaggaggagaagggaagaaggaagaaagaaggaagaaggaaggaagaagaaagaggaagaagaaccaaacattgagggtcactcatacttgaagctggaagaggaggaatacatgacagcaacgaagaaggggaagccagagaagaaaaaaaaaaaaaagaaccttgatagagtagaataggacaaagctttaagaagtaagggatgagtaatgtgtcagctattgatactgggacgtggaggaggccaggactgaggatgtgtcatttttattttatttcatgggcatgtgataaaagtaaattatctttttgtgtttaagtatactaaaatctgtgcctggaatagacataatgtagagaccacaggtgggtactacagtttttaatgggctactttcaacatttccaaagtggctgaagaattttaactgttagtgatagcaacatctggcccagcaatgtcaggaatagtatatcaacagaggagaatgaacctgcgcaaaattaaagaagtctcatctattctcctttgtcttttattctagcgcacagagcaagaggtaaagccccagctggggaagaaaaagaaaaaaaaatccttactaaaagctgttgtcattgtacagacaaaattaataaccaactgaactgggctacttccacttggccaaaagtaaatgctaaccatatgagtcaattgttttgccttcaaaacatgcgtacgtgcacaaagacaacaaacaaagcacaaacctcaaaagacaaatacaacttagcagactgtaaattaaaaatataaatatttggttagtgtttggcaactgctgaaaaataattgttaaacgaatggggaaaagagactgtgtagccaagaatacaaagataccattataaaagaaataggatgaaattaagaacagcaaactctaggctgattttgagggaaaacgttcttctactgactgctaaaatactcttcccaagtgggagcaaaagcacagaaactaccctggattatgttcaagggtaaaatgagataatgtatgtgagagtgctgtggaaactccagattgtgctacgtatgtgaggagttgctatgattgttgttactatcccacccagagctggggaacaaagggtattggagacaagccccaagccagaccggcactcagctaacacctgaaacctcttgctttgctctgctgttatcctagccaaagtgagtcactggtcatgtaccaatcaccacaagattccataaaattacggtataataaaaaaattagttactcaaccagcagtactggaaggggagataagctgacttcccaagaaggcttttggctgagttgtcccagttgggtattgaattcatggtatgatttatttgcaggattgggactggataaaactcagtcaagtactccaatttctgatttctattaagtttgttggtcttgccccacactccctccaccctgtcccatttaccaagcaatctggaatagctgtatctgaagatgtcaacaagaacagtctctttttttttcccatggcaatcaagtactccatcccatcctcataggcctgggaataaaatatcctaaaggagcagagatacaaaccagtgggcatttacaagcccaacccaggtccacatccttaacaaaggactggaagaatacaatgagaactatagaatgaggcatgtctgtacaaaatgaaatgctgctgccaaaatatttcttcattttttctttagatgtccaagaaaagggagaaaggtatagtactttgtgaggttgtggagggaaggtgagactgataacaagaagcctatgacctcatatgtaaatgcacattctttgagaccatttttagactctgacaatcttagagtcaaagggaggtttaaaattaatcttagtcccagtggccttttgcccagtaaagaaataccatccagctctacttgaagtcctttagtaacaggcacctcagtactcataagacagcacattccatcatttgttttttttttcctcctctttggcaaccagttaaaacttcaagctatcagataattgaaaacatatagtcatgggatcctaaaagtattattcaggacaacttaaccccattccctgatgatctaagatgaggaaactaatgctcagaaaagggatagaattttcccaaagtcacacagtggtcaatggtagagctaaaagtagaattcaagtctgcatattcagggcccagtggcttctctacttcccatatacgaagaaaggagttggcccagctttaggaccaattactcagtgactatactaccaaggctccagcttctttttcctaactcccacagcccaataatggctcattttatcctcaacagaaacaattccaaagggtgggctgggtcatggagaggtggatcgtagaagggaagaagtaatgcccactctttttggcttaaccacaacggtgactaacaatctcctggaagtaggacatctcagtgtctgattccaccatatattacatggaaaatcctttatttttgagaatagcatgatgtcttttggtggtgtttggaagatataataactgttgtcatcccaagatagggagaattaatttctggtcactcagcaaccacttgatgagtactttctatgctaggcattctattagaacttagtggcaagagaaaaaaacagaggtgaataaaccatattctccaaatttaggagattgcagtctggtggggaacatagaaaatatatacagtaaactctaatccaagacaaagtatagccatcctcatatctatgttcacaaaataatagtagtcgtattttacatactgatggtgaaacttacccatatctttcctgttaagctcccaagaagagaatacacgggtggagctagtttctagaaagaaagcagtgaaaagcagcttctgcttcaatatgaagcttcagcactgaggaatggctccaaaagatgactcactctctgcaggaagcattcaagtggagaaggtcaagaagacatctaaagaaaggaattctctcaaagagggaataactggtataaggtaattggaggatccctcttttttttgactcattctttagtgccagagttggcgtaattgcccagctatctatcaccttaaaccctaacagctgtggaaaatgaaaagccatactgaacttggagtaagaaaaatgtgtcttgcagttctggcacagatgcttactaactaaatgatctctagcaagtttcattttctctaggcctgtttggccacctgtataatatatataaataaatctgcaattccctcatttggggataaggaatcagtgggatgatggatttgaaagtatttagcacatagtggaaaaaatgatttatattctttaatttttttttgagatagggtctcactttgttgcccaggctggagtgtagtggcatgatcatagctcactgcagcctcaaactcctgggctcaggagattctcctgcctcagcctcccaagtagcgggcactacaagtgcccagcacccagtgcccagctatttaaaaaaatttatatagacagggtctctccatgtttcccaggctaatcttgaactcctgggctcaagccctcctctcgcctatgcctcctaaagtgctgggattacaggaatgagccacccttcctgaccagaaaaaaataatttaaaaaataataaattacaaggaattttgtcacatttacccatcctgttccttttgcagtattcctcatcactatgaagacatactcataccccaatttatatacttcaaaaccacagagtcatatttgacttgataccatgccagataagaaatgatacaattatctgagctgtttgacctgggagcagaagatgcagggggatctgatctctggtcttcagatctctgaaaaactgtcatggaagaaaaagaacagactgctctaggtggcctcagggagaatgactaggatatccaggtacaagctttaggaaaactaagttcagcttagcaaaaggaagaacttttaacagtccaaggctttccctgaagacagtgggctctctcaggaagcagtaaggaacctccctctagaagtgttcaagcagaaactggcaaggatgttttaatgtggaatccattagggtaaaggaaaattacaattcatgaaattctacttgtcaggcactgtgctagacccttggcaggaaatatatcttttaatcctcccaataacaccatgatgtgagtactgttatccctctttttcaggttagaaagctgaggctcaaagaatttgactacttctcattgggcttactactggcatggtgggtgggaggaacaattatttgttgcatctgtttggcattaaatgcagtagtacctcagactgtgtgtaaaacacacacacacacacacacacacacaccccacatacttctaaatgtcttgtggaaataccgatcctagttgggaatgtcaagtacataatatgcttaggatcacaaacagcagataaatagcagacccaggacttgaaaatagctgtgtctagctcagaaggtacatactctttctattgcgttatccacagaagtgagatgggaatgcacaaccttgtaaggtctaagccaacccgaaaagattctgattttctcattcttcctttttcaattccatataatgtatcaactacaaagttctgtagattcaacttttgtgatggcttgttaaattcatcacctcctttctattcccacagccacgacctcagttccagggccttgttccctctctgcccctagtttatccccctcttgtgttttcctattccaatccagctgactaaccttttaccagattactcttcctaaagcagaggatctgacgttttttttaagctcaaaaactttcaatggctttccattgtctgctaaatcaaatcaaaactctagcatccactgtcttttgcagtttaccaccaatctgccttggcaagtttaacttccaattttccgctaatcgtactctaaaatccagctcagctggtgttcttttcatatgccctgagcttccctgccttaaagcagttgttcctattttctctgcttaaactgtcttctctatctccacctgttgaaatcttatctgtgtgccacagtctatcttaaataataatagttaatatttattgagtgtttattttgggccagccactgtgctaagtgtgtgcaagtattttatatggattatctcatctaatcctcacaacagccccatgaggtgggtgctattattatccactttagcctgaagttaacagaaactcagaaagggagaagtaattttatttgtccatggtaacacaagttaaatggtgagcatg[450 bp omitted]ctctggcgggtcccttcttgtcccccagttcttgcagcttgctgggtcttggccagtgtttggagtgaggcaggatcaaaataacactgcccggggctcagcttccaggaatgagagatcaagtgaaaccaagctcggcgggtgagggggtggattgaaagcccccaaacagagccagcatgctctttacacaagccctgacttgccctcaagccacgcgggttagcagttctgctttcctcaggatgctccacaagtctgatccactgtccccgccttcactaacacccagcctccttctcttctttatctcccaaccctagatgctcaaggttgttggacacgtccaggcatgttctcagaggcaatgcaggtccagtaagagcctacaggaaatggctcgccaagatcctagagatgtcagcccagatccctgatacctcagaaagcgctctccggacacaaatggatggactgacagccagccacagggcgccttcccaattgttctgattttgcggtaccctagcaggatcatcctgacctgattctgtacttctgcacctagatgccgcaggtcccagccgccttgccacaccagggggtgttcccacactcacccggtaacggacgagtagatggctcttgctcccaaatgggactccggtacaaatcc

SEQ ID NO: 1417 - DNA, 186935 bp, Homo sapiens
ttgtttgtatgtgtcaatgttttatttaactcattactgaagaaaccagcaggaaaataaaagagctagttccatgaacatttgagaaatagagatgtatatagtcaatgggaaaagaatgccaaaataagattatcaagttaaacataacaggaaataaaaccatatcacctttggggttaactcctctaccgggctataaaacaaaacaacttattcatttctgtaagttagcctctaaactttaagaacttcacagggctataaaccatttgcacctgcatcatttgtggattgtgactatactgtgacagctatgttatagtttccaaagaggtcagataagggtcaagcaggattattagaaaatactccagcatagaaaaaagtagccattcttttgccttttctcagattgggatccatttttctttcatattaggatctcctgttttccatttgccctgggttgcaatctttggatgcttcctccaactgctctataacttatccttgtctccagccccctttactatcaggagattctgtgtagtcatagtgaaggggtcaggcagatggaaggagcagtaaacccttcacaatcttatgggggtggagggcaagaagggggatcctattgtgtggtgatatggcagactggagtgttttttctgttttcaccagtccaattttcttctgacctccttgatatttcaactatgtaagtaggactctagttttcagtcacggtatataatttcccctgttacatttttgttgtgttattttcagcaggaaattagtagagggagagagtaaactgagtgcattattagaattacaaagtttgtatctcctatctcagataaccatggattttcctcatatttccacagaaatattaaatgtatgtcctttagaagcctaatgtcatcatcattttctttcttggccatcacaaatttcaagaagacattgttattttatttcaaagctttcaacaattgcatcctcctgacttatttttttattggtcagaattaagaccaaatggctttatatctatggacactcgtcagaaaaatgcacatttgcatttatacagaatgccttatataatttcaggggacttagggattcttgaaccccatctataattctcagtttaagaatgctagttttggagataagaatgtgcccctcataatgactaaataacataattatatctatgtgtaaggaagcagaaacagactttactgtagtagttattgtattctctccattttgcagattgtccaaatgatttgccttttgactccaagattgtattgatctgatcctgaaacatgctttgttccatgcttgatcaggataataaacaactgagagttttattttaaacgtatgaggcttaacctgaaatgttaacatcataaatatctttttcaaagtttcatcacatagtttttctacaacagaggaagtggtgactctgagaggcctaacttttcagggaagaatgctttcatgcaggtttctcctcacttctttttgcctagttatattggaaggaaggagtaatctgggagcagctgcagaaaataggtaagagttaagttaaattggatgcaccctcctggccccccaccaaagaaatgcaggactgatgatagttaattcaggaggcttcaaggcagtgtctgctaggatttagcacaaaggtagaaggcaagccagggagggacactgccctggagctgaggagggagaggtgacggcagtggcaggtgctgcagtggccaccctcagtagaggtcctgtgcctcgcagcccagaacctccatcctcagggcaatctggtgcacccaactctgggggtgaattcgaaggtagcgagtcagtaacggtgggtctagagagttcaccacaggtgtgaaggagtcttgatttccctgaaaaacctgaaagaggaaagatagcatttattggttgtctgacaggacaatggtcactgcaaagcacagacgcttttctcacttctagttgtttccagtagtccaggattaaaccctggaagatgactagatgactctgtcctacgcatctgggacatctagaattaagagcaccctgctttggaggccttcactctagctaggccttatatctacagtgttctcacccacttcccaaacctcagtgacattaagtgctttgtcctgggtcacacacagcatctgtgttggaccatctggagatgagagtcaggctttggccagcagactcccttgtcaatgcatttgctgtggcaagaggagtacatggcaagagctcagaaaatggtagctatcgttattagataaactggtttcgcacatgttggtgacaactttagaatgataacgaatgcaacacagcaaggcatgcaatttagtgtggctgggcaaccttggcaggaggggatgcagaagagagaaagaagtgggaagagtctaagactcaaggcaccttgctactccaggactttggagcaaaggtcacctataactgggtggatgtttgggaaaatgaagatctgaatgttcaaaacgtgtaattcaaggcaactctgaaaccctgtgggttttgtgtggattccgaggtaatcctacagtagaaagtccagccaaatggtgagaataagcaagagtcttggagaaaaaggaacagaatgaaggcaatgtcctaccataatgcatgctcttgcaaggacagacagacaccatgatatctttaggatctcctgaggcagtttgtgtaaaaggaggcaacttgccaccaaaatgggaaagaagtggttaaacagcaacagtagggctcctgcttcctggagctattgggtgacattttcctctaacaatcctggcatcttcaagtgtggtgtcagttttacttcggattccaaatgggaagagacttttcctggcaaatgcactgtgaagtaacactgtgatcctacagagagtttagctatcagaacaaaagacgtttgggccatcttcattcatctagctacattttccccctaggttcccaaccctggctgcttattggaatcgcctttggagcttttaaaaaatgatgcatgggtaagttccccacccccccacccccccaagagatgccaatttaatcggtctgttcccaccttggcccccttactctggtctccaagttctgcctaatatagcccctgcccaagtctctgatctgttctcccactgcattcctcctattttaccgcatcgcagatgagctgatctttcagtttctcaacaatgtcaactcttgttttatttaacatgagagcctttgtatatgtgattccctctgcttggaaggctcttaccccttctgtttcttcttttatccatgttttttacccttcgggtctcagtttaaataccacctcttaaactaagcatagtggcatgcccctggagtcccagctactcagcaggctgaggcaggaggattgcttgagcccaggagtttgagacaagcctaggcaacatagcgaaattctgcctcaatttttttttttttttttgagacggagtctcgctctgtcgcccaggctggagtgcagtggcaccatctcggctcactgcaagctccgcctcccgggttcacgccattctcctgcctcagcctcccaagtagctgggactacaggtgcccgccaccatgcccggctcattttttgtatttttagtagagatggggtttcactgtgttagccaggatggtcttgatctcctgacctcgtgatccacccgcctcggcctcccaaagtgctgagctacctctttagaaaggtcttcctcattattcctcttgtaaaataggactcttttttgttctaaatctcaacttatttgtttcctttgtagcattcagtatcttttcctttatctctttacatgcttattgactgtttcctctgtctccgccaccaaatgtcagttccacaagggcaaagaccttggtcattgttgtatcttcagcacatagaatatatagcataatgtatatagcatggcaaatataccataaacatctatagaaataaagttctgtatttggaaaaatttttgagaaacattaaggtccctgttctgagattattttacaaatgtttacgctgtatttggaggctttgtacatcttttgttagacttaatccttactgcattaaatcagggggcatgcgatgccagattgtcccattattgatgatgctaagtttgatcacttggttaagatgtccacctaatctctatatttataaaggtaaccctttccctttcctaacaatctgtggagtgagactttgagaccatgcaaatattctgtttcacaacaagcttttatccaatggtattagcaacccttaaagttctttacaagtattcaatagtaagtacattgatggttgcaaactgattttccagttatgatccattaccctcattattccttttgatgctcaaattgtctcaaatctggccaacaggaagcccttcagaccagtttctgtgttcttttcacatgatcccattaatcttctggcacatcaagatcaccaagatcatctaagattgcctggcagtttccttgatccagccttgaaaaagtcatttctctagggagctcagattcttttgactggaaaatggtagttagagaccaagatttgggcatgggatgggctcgttattactgcagtgtaattacttctagattccctcagtgaacagtgctaagaatatgattttttaaattcctaagttctcactgacacttctaattcaactctaacattctttttgttagtattagatttctagggctactgtaacaaattcaccacacacttggtgcctttaaaacaaaagaaatttattcacttatcgttctagaggcttaaagtctggagcctggagcagaggcacaaaagagtgtgtcaaacacaaaatcacatttaaagcttctatttggaagtggtatatatgtcatgtccaatcacattctattgatcaagatgagccgtacggccatgcctaaagttgatgaggttttcaaggaaagagggaataaaaactcaagaacattaataccatctgcttcatatgctattttctgttcatttagaaattccttacattttcttgtttcagcaataagaggtgatttatgcaggcagacatgagggctgggtggcttactaggtttcttagccaggagtaccctctactgttgataaatggaagtgtaatttatttaatagatgtgaccaaagaggtttgtgggtcttgtgatttagtaattcacttttgtttttataggacagttaatttccaacatttgctttcttctttttttttttttttttttttttgagacagggtttctctctggagcaaggttggctagatttatatatttattttctacttgtaaatataaacttatagtactttttgtcttctggttattctatagatgggttatgggtggttttagtcataatttaaaattgtgtgtgtatgtgtatgtatggtttttgaagactgtggagagatttaggcagctgccattatctgacaggaatgtgcaactcctgcttggaatttttaaatgctatttaaaactatttttccaactgtttcaggtatacagaaatacaattaattttggtatttattttgttttcagcaagcttgaaaaattttaaaaattctaataatttatatataaattcctttggattttctatctatgccatcatatcttccacatacaatgagtttgtttcatcatattcaatccttacatattttccttctttttctcatcttattgcactgcttaggacagccaatatgtataatccttcagtctgtcactgtgataaattatatcagttttctaatgtataagccaaacttgcattcctagcataaatccaatttggatccatattgctaatattttgtttgggatttatgtttatgaataaaacgggcctattatcttcctttctaatattgttcttgttcggtttggttgtcaaggttatgctattatcataagataattgaataacattccatctttttccattttctgaaagaatttttgcaaggttaatattatttctcctttgaaaaattggtagaatatagttagtgtagccatctggatctggattttttaaattaataaccttttaacactaagtttggaaaattaggtaaaatggattaatccctggtaaatacaacaagaaagaacatttaatattaataagtatcctcattttttatatttttatattggcagaaatttttgtgggatctttattgatgtccagttttttaaagtttctgatattatttgtgccttcttttcatcttgattgctcttgccagaagtttgtcaattttcaaggaaccaacttttggttttctttattctctctattgtatgtttcttttttacttcatttacttcatatctttattatttccttgcttctacttccttttggtttattttgctgtttcactagcttcttgagacataccttagctcattaattgtcaggctttcttctcttccaatatatgtttttaacgctatacatttctttctaaatattgctttagctgattcccacattttaatatgtcatgccttgttatcattcagtttaaaatattttctaatttatgatttcttatttgacacatgggtttaaaagtatagttcttgattctaacataggaagattttatagttatctttcttatttatatcaactttaattgtattgtgaccagaaaacatgttttatattatctgaaatttgagactactttatttgtagcttatttgtagcttaaaatggaaaattctaacatgtttcctttgtgtgcttacaaagaatgtgtaattttgcaatttctttttttttattatactgtaagttctagggtacatgtgcacaacgtgcaggtttgttacatatgtatacatgtgccatgttggtgtgctgcacccattaactcgtcatttacattaggtatatctcctaatgctatccctcccctgtccacccaccccatgacaggccccggtgtgtgatgttcccctacctgtgtccaagtgttcttattgttcaattcccacctacgagtgagaacatgcggtgtttggttttttgtccttgtgatagtttttgagaatgatggtttccagcttcatccatgtccctacaaaggacatgaacagatcctttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtacatacccagtaatgggatggctgggtcaaatggtatttctagttctagatccttgaggaatcgccacactgtcttccacaattgttgaactagtttacagtcccaccaacagtgtaaaagcgttcctatttctccacatcctctccagcacctgttgtttcctgactttttaatgatcgccattctaactggtgtgagatggtatctcactgtggttttgatttgcatttctctgatggccagtgatgatgagcattttttcatgtatctgttggctgcataaatgtcttcttttgagaagtgtctgtttatatccttcacccactttttgatggggtctttttttcttgtaagtttgtttgagttcttcgtagattctggatattagccctttgtcagatgaatagattgcaaacattttctcccaatttgtagctcgcctgttcactgggatggtagtttcttttgctgtgcggaagctctttagtttcattagatcccatttgtcaattttggcttttgttgccattgcttttggtgttttagacatgaagttcttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattcaatagggaatcctttccccatttcttgtttttgtcaggtttgtcaaagatcagatggttgtagatgtgtggtattacttctgagggctctgttctgttccattggtctatatctctgttttggtaccagtaccatgctgttttggttactgtagccgtgtagtatagtttgaagtcaggtagcgtgatgcctccagctttgttcttttggcttaggattgacttggcaatgcgggctcttttttggttccaaatgaactttaaaatagttttttagaattctgtaaagaaagtcattggtagcatgatggggatggcattgaatctataaaataccttgggcagtatggccattttcacaatattgattcttcctacccatgagcatggaatgttcttccatttgtttgtatccccttttatttcattgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcataaggagattttgggctgagacaatggtgttttctagatatacaatcatgtcgtctgcgaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacgtttattgattttcgtatgttgaaccagccttgcatcccagagatgaagcccacttgatcatggtggataagctttttgatgtgctgctggatttggtttgccagtattttattgaggatttttgcatcaatgttcatcagggatattggtctaaaattctctttttttgttgtttctctgccaggctttggtatcaggatgatgctggcctcataaaatgagttagggaggattccatctttttctattgattggaatagtttcagaaggaatggtaccagctcctccttgtagttctggtagaatttgagtgtgaatccgtctggtcctggactttttttggttggtaagctattaattattgcctcaatttcagagcctgttattggtctattcagggattcaacttcttcctggtttagtcttgggagggtgtatgtgtccaggaatttatccatttcttctagattttctagtttatttacatagaggtgtttatagtattctctgatggtagtttgtatttctgtgggattggtggtgatatcccctttatcattttttattgcgtctatttgattcttctctcttttcttctttattagtcttgctagtgttctatcaattttgttgatcttttcaaaaaaccagttcctggattcattgattttttaaagggttttttgtgtctctatctccttcagttctgctctgatcttagttatttcttgccttctgccagcttttgaatgtgtttgctcttgcttctctagttctttaaattgtgatgttagggtgtcaatttttgatctttcctgctttctcctgtgggcacttagtgctataaattttcctctacacactgctttaaatgtgtcccagagattctggtatattgtgtctttgttctcattggtttcaaagaacatctttatttctgccttcatttcgctatgtacccagtagtcattcaggagcaggttgttcagtttccatgtagttgagcggttttgaatgagtttcttaatcctgagttctagtttgattgcactgtggcctgagagacagtttgttataatttctgttcttttacatttgctgaggagtgctttacttccaactatgtggtcagttttggatgtggtgctgagaagaatgtatattctgttgatttgggatggagagttctgtagatgtctattaggtccgcttgctgcagagctgagttcaattcctggatatccttgttaactttctgtctcgttgaactgtctaatgttgacagtggggtgttaaagtctcccattattattgtgtgggagtctaagtctctttgtaggtctctaaggacttgctttatgaatctgggtgctcctgtattgggtgcatatatattttggatagttagctcttcttgttgaattgatccctttaccattatgtaatggccttgtctcttttgatctttgttggtttaaagtctgttttatcagagactaggattgcaacccctgcttttctttttttgttttccatttgcttggtagatcttcctccatccctttatttcgagcctatgtgagtctctgcatgtgagatgggtctcctgaatacagcacactgatgggtcttgactctttatccaatgtgccagtctgtgtcttttaattggagcagttagcccatttatgtttaaggttaatattgttatgtgtgaatttgatcctgtcattatgatgttagctggttattttgctcattagttgatgcagtttcttcctagcatcgatggtctttacaatttgggatgtttttgcagtggctggtaccggttgttcctttctatgtttagtgcttccttcaggagctcttgtagggcaagcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgcgggtaacccgaactttctgtctggctgcccttaacattttttccttcatttcaactttggtgaatctgacagttatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtacactaatcagacatagatttggtcttttcacatagtcccatatttcttggaggctttgttcatttctttttattcttttttctctaaacttctcttctcgcttcatttcattcatttgatcttcaatcactgataccctttcttccagttgatcgcatcggctactaaagcttatgcattcgtcacatagttctcgtgccatggttttcagctccatcaggtcatttaaggacttctctatactggttattctagttagccattcatctaaccttttttttcaaggtttttagcttctttgtgatgggttcgaacttcctcctttagctcagagaagtttgatcatctgaagccttcttctctcaactcgtcaaagtcattttctgtccagctttgttccgttgctggcgaggagctgcgttcctttggagtaggagaggtactctgatttttagaattttcagcttttctgctctgttttttccccatctttgtggttttatctacctttggtctttgatgatggtgatgtacagatggggttttggtgtggatgtcctttctgtttgttagttttccttctaacagacaggaccctcagctgcaggtctgttggagtttgctggaggtccgctccagaccctgtttgcctgggtatcagcagcagaggctgcagaagagcgaatattgctgaacagcaaatgttgctgcctgatcgttcctctggaagcttggtctcagaggggtacccagctgtgtgaggtgtcagtctgcccctactggggcgtgcctcccagttaggctactcgggggtcagggacccacttgaggaggcagtctgtccgttctcagatcacaaactctgtgctgggagaaccactactctcttcaaagctgtcagacagggacatttaagtctgcagaggttactgctgtctttttgtttgtctttgccctgcccccaaaggtggagcgtacagaggcaggcaggcctccttgagctgcggtgggctccaccaagttcgagcttcctggccgctttgtttacctactcaagcctcagcaatggcgggtgcccctctccctgccttgcagccaccttgcagtttgatctcagactgctgtgctagcaatgagcgaggctccgtgggtgtgggaccctctgagccaggtgcaggatataatctcctggtgtgccgtttgctaagaccattggaaaagcgcagtattaggatgggagtgacccaattttccaggtgccatctgtcacagcttcccttggctaggaaagggaattccctgaccccttgtgcttcccgggtgaggtgataccttaccctgcttcggctcatgctcggtgggctgcacccactgtcctgcacccactgtccgacaagccacagtgagattaacctggtaccttagttggaaatgcagaaatcacctgtcttctgtgtcattcatgctgggagctgtagactggagctgttcctattcggccatgttggaaccacccttgtaattttgcaatttcaaggtgctattttctaaatatgtctataagatcaaacttgtgaatcatgttaattgttctatttctatacattgttccatcaattgacgagagatgtgttaaaatctagcctcccgagttcacgccattctcctgcctcaccctcctgagtaactgggactacaggtgtccgccaccacacccggctaatttttgtatttttttttagtagagacggggtttcaccatgttagccaggatggtctcaatttcctgacctcatgatccacctgcctcggcctcccaaagtgctgggattacaggtgtgagccaccgcgtccagccatgaaatcacattcttaatcttcagcaatactttcttgctttaaagtctatttttctgctatcaatagagctgtaatcgatatcttttagatatttgcataatttcttttcccatttttgtcttgctacttttctgtatctaatgttttagatatgactcataaaatgcacacaatttacttttgctttttttttttttttttaaagagacaagtctcactatcttgtccaggctgaacctcctgggctcaagtgatcctcccacatcagcatcctaagtagctgggactacaggtgtgagccatcacacccagctacttttgcttttttatcaatctgacaatctttgtcttttaactgaaatatttggtccattcatattacatatgattactgttatatttcaatttaaatataccatcttatcttgctatttttcctacctgttttatgtttctttatctctctttgcttgctttcatttaggtttgttgagtatattttatcctttcatattttttcttctaccattttgggagtcttacattgtgtgtatttctattacttactggctatcctataaactacaacattaatcaaattatgaaggtttaatattaacatctttacctcctagataatacatggattttagaatcctttattctatttatccacatgctgacttttttgctgttgtcatatgttctaaattttcacacgcacacctggcttaaacaatagaaatttattttctcacagttctggaggctacaagtccaagatcaaggggtaggcaggcttgttttgtgtgtgtgtgtgtgtgtgtgtgtgtgtgtgtgtgtattttttttttgtctgtttgttttttgagatggagtctccctctgtagtccaggctggaatgtgatggcgcgatctgggctcactgcaacttctgcctcctgggctcaagcaattcttgtgcctcagcctcccgagtagctgggattacaagcgcatgccagcatgtccagctaatttttgtatttttagtagaggggggtttcaccatgttgggcaggctggtcttgaactcctgacctcagatgatcttcctgcctcagccttccaaagtgctgggattacaggcatgagttaccacgcctggccagcaggcttggttctttttttttttcttttccttttcttcttcttctccttctctttatttttttttttagaggcagggtcttgttctgtttcccaggctggagtgcagtggcacaaccctagctcactgcacccttgtaacaagaactacaagtgcacactaccacacctggctaagggttggtttcttgtaaggcctctctcgttggcttgtaggtgtctgtcctctttctatatcttcatgtggtcgtccctctgtgcctgtctgtgtcctaatttcctcttttgctttaacgcataaaagatattttcattaggttttctttttgagagaggggttcacattgtttattttagcattgtgaagacatcattcattattttctgatatttgctattatttagaaatcagctgtcagtttgttactcattatggtaatgtacatgtcttctgacttatctattgcaaaattcgcaaacataaaatttaccattttaacaattttaaagtgtgaagttcagtgccatttagtacattcacaatgttatatagccatcaccactatctagttccagaacatttctataaccccaaaaggagattcaatacttattaagaagccactccacattcactccttctgccagcttctggcaaccactaatctgttttctgtctctatggatttgctattctgggtatttcatataagtggaatgtggccttttgtgcctggctgctttcacttagcataatgctttcaaggagcatccatgttttagcatggatcagtactttgattttttatgaataaataatagtccatatatggatagaccacattttgtttatctgttcatcacttgatgaacatttgaattgttttcacctgtttgctattatgaatagtacttctatatgcatttgtatattagtttttgttagagtgcctgcttttaattcttttgggtccacacccaggagtagaattgctgggtctatgttaattctatgttttccttactgaggaactgccaaaatattttctacagtggctgccctatttcacattctcatcatcaaggaaggttccaatttctttatattcttgctaacacttgttattttcccgcttgacattttgtttttgttttttttttaatttagccatcctagcaggtttgaaatgctatctcattgtggttttgatttgcatttccctaataactaatgatgttgtctatcttttcatgagtttgttggatccttgtatatcttctttggagaagttccattgaagtcctttacccattttaaaatttggttgtctttctgttgttgagttgtaagagttctttttatattctgggatactaggccctttatcagatatatgatttgcaatttttttctcctatactgtagatcatctttttactttcttgatagtgttctttgatgtacaaaagcttttaactttaaagatgcctactatatatatttttatagagttgttgcttgtgattgtggtgtcacatctaagaaaccattgccaaatccagtatcataacaatttacctctttgttttttcttacagttttatggttttagcttttatatttagttttttgatacatttttagttaaatgattttttacagacagggtcttgctctgacacccaggctggagtgcagtggtgcgatcatggctcactgcagcctccacctcctgggctcaagcgatcctcctatcccagcttccctagtagctgggactacaggtgtgtaccatcatgccagctaatttttttttcttgttttgtagatacagagtctcactgtgttgcccaggctggtctcaaactcctgagctcaagtgatccaccagccttagcctcccaaagtgctgggattacagatgtgagccaccacatccagccttgagttaaattttgtatatggtaaagatccaacttcattcttttgcatgtggatatccaattgtcccagcaccatttgttgaagagactattcttttcccacaaaatggtcttggcacttttattgaaaatcaattgaccatagatgtataggcttatttctggactctcaattctattccattgatctatgtgtctatatttatgtaagtactgccctgttttgattcttgtagctttgtagtaagttctgaaattgggaagtatgactcctccaacgttgttctttttcaagattgttttggctattcagggtcccttgaaattccatctgaattttaggatagatttttctattcctcaaaaaaaaaaatgtctttgggattctgatagagaatgctttgaggccggagaatcgcttgagcccaggaagcagaggttatggtgagtggagattgcaccaccacactgcagcctgagcgacagagtgagactccgtctcaaatcaaaaaacaaacaaacaaacaaaaaaacccagaatgcttgctttgaatctgcaaatggtttgtggtaatattcttatcttaagaatattatgtcttcaaatccataaatccaggatgccttttcatttatttagttatttaatttctcttttaatttttaatttttaatttttttctagttgctaattttccatatttgctgtcttcagaccagacagttctttagtttctttcaactgggtttttttgtttttagtggacaagacttgcacctccttcgttaaatttattcctaaatattgtattatctttgatgctattgtaaatagacttttctgttttccttttcatatttgtaattgttagtatataaaaatacaattgatttttgcatgttgactttgtaacctgcaatggtttttttcaactgcctaataatgttggataatttgtcttttattttcatgtttccatatgttattactttaaagattttatacataattatttcatattatgtatccgataatgtcaatatctggtgttcttcaagttttaaatctgaattgattgtttctgttcacttgtactcaagttgtcttgttgtcttgcatgtttgctgatctatgtctgtgatcttataattttaatatgtaggaatcctggaggcctaaactggaggtgctttttttctagagtaggttgagaatggttcttccaggtgccagaggataatatttatctgcaacttctctagcttccttctgggattcatgacaatgcagaattctcacactgagttctccttgcattttgctcaaggcttagtcttccagtaacaacattaatatgggcattctgtctgaggaaaggtcttcctttttatatttgctcattattcacctctccgctatgatttcagctcattattttaaaatagaagtttgtgggggtttttgttgatggggaggctggagattcccctttctttgctaaatacaacaatgcattgtcagtgatatagccttttttattgttgtacaatatacataaaatttaccattttaatcatttttaagtgtacaatttagtggtattaagtatactcacaatattgtgcacccattaccactatccatttccagaactttttcatcaccccaaacagaaactctgtactcattaaaaataactctccatttcttccccattccaagaccctggtaacctcttttctactttctgtctttatgaatttgcctgctctagatacctcattatggtggttaattttatgtgtcaacttgactgggccatggggtgcccatatatttgattaaactttattttatgtgtgtctgtgagagtgttttttggtgagattaacatttgaattggtagactaagtaaagcagattgttctccccagtgtgggtagaacttatccaatcagttgaaggcctaaatataacaaaaaggcttactgtcctcttagtaagagacagttccttctatttgactacctttaaactgggacttcagtttttttcctgcctttgggctcgaactaaaacattttaactctttctgggtctgtagcctgctggtctttgaactggaactacgaatcagctctctggggtctctaggctgccaactcaccctgcagatcttgagacttggcagactccataatcacatgagctaattccttgtgtgtgtgtgtgtgtgtgtgtgtgtgtatgtatctcctcttggttctggttttgtttctttgggaaccatgactaatacagattttcacaccaagagtgattctaaaggaacagaattttaaggataaattttataaatttgttattggatttctggaattggttctgtaacctgatgaaatttaaagacactaatgactattttcagtagtaaaaattgtccatggcatgatctggcaatagaaatatgtaggccaggctgggcgcggtggctcacgcctgtaatcccagcactttgggaggccgaggtggatggatcacctgaggtcaggagttcgagaccagcctggccaacatgatgaaaccctgtctctactaaaaacacaaaaattaggcaggtgcctgtaatcccaactactcgggaggctgaggcatgataatcgcttgaacctgggagatggaggttgcagtgagctgagatcatgccactgcactccggcctgggtgacagagcgagactccatctcaaaaaatatgtatatgcaaaatatctccattggatactcctaatcaactacttttaagaagcaagggtcttggtgactatgtatattgacacttgtgaacatatttgtcaaactaatgaatatgatgggattagtcggttgctcctaatgttgctggaaaaagtgatgaaagaaaaggaggagctcaggaatttgaattcccagctcaagagctgcataaatgacttgacagattctatgtatgccctgaaggagacccttatctactgtagccacagagctgagattgctgaaaatcaaatgccaaatctcatcctgtgactaactgaattacaaagcaagccaaactcccagctttgcagggtgtctactgttaaagcaagggcagtgattgggaaagaatggggcactacaagttggattaggtatgtgtggaagaccctgattaagctggggacattgagctcctaaatattgatgagtcttctttgtcagtgaaagttttctctccagccctgtggtggcagtatctctactccagtctaagtggattaaccctgcactgcctgaggaaactgtaatggcttcccctgaggcaactgccatgcaagataatgctgattccttcaggacccaccctaccacccctctttgttattagatctataactacactcaagtcccagcaggcgaggtgaggtatgaaggtgacccatgacaaggtgcactacactccaaaatcatgacttgagttttctaatttacacaagcaggaatccagagaatatgtataggaatgggtactaaggatgtgagataacggtggaaggcacgtaaagttggattaggccaaatttattgacatgggcccactaagcagagattctggacttaatgttgcatctcagggaattaggaaggcctctaacagtttaattggttggctgaaacacagaccaaaagatggcccacagtgagcaaactagaaatttcagacttgccctggtttaatgtagaagaaaggagattgaaatgctagagtgaatttgtcatttaagacatactcaccaacactgggagagttcagaagacacagatctcactattactttgaggaataaatttgtgaggggaacctcagcatccttgaagggctctgtgatcactcttctctgtaggtgacaccttacagcaggacctgcagtcactgaattagaaaacctaaatacaatgggaataattggatcctggggtggaaggggccaatgggcagcactcaactgccaaaggcaaggtaagtgtggttaccataagggacagcagagtcaaagcagcagttagaatagtatgacttgcacagacctatggtgttggctagtagattatagtgttcctagatgtgatatagatagaatgcctaccaaattcttgaactgcataagtggaaaagttctaggtcaagtgaacaaaagtctaacctgaataataaaaacagagtcacggcctctcaatcaattcccagacttgagcaggtttacagacccagcactccttgaatgaaggggaggctcagtctccttgaggaaggactctggtacactgccaagaatactgccactctttctctcagccttccccaaagggacatatggcctttctatcagaataaatgtgcactgaagaaaaataattaatcagacctttcagggactactggacaatggctctgaactggcactaatttcaggagacccaaaatgtcactgtggtccaccagtcagagtatgggcttatggagggtcaaatgatcaatggaattttagctcaagtccatctcaaagtggatgcagaggatctgtgagactatcttgtggttatttccccagtcctggaatgcgtaattggaacagatatattgagcagctagcaggatcttcacattggttccctgacctatggagcaggggctactgtagtgagaaatcctcctgtaatcctctgtgaataactgttctccttttgtgagatagctcttggcctactactgggccttagtagatactgaatgcttagccacagaccaccaagttgccatgtgacctgaactgcccatcatgaactaggtgttatctgacccaccaagccataaagttgggtatgaacaatggcactccatcatcaaatggaagtggtatatacatgatcatgtctgagcaggtactgaaaacacatgtaaattacatgaagaagtagcccaaatgtccatggtgcctgtttctgctaccctgccttctctctcccagcctgcacttatggccccattgggagttccctatgatcagtttacagaggaagaggagtcttgggcctggtttacagacggttctgcacgatatgcaggtactacacaaaagtggacagtcccgatctgagatacccatgaaggacagtgggcagaattttaggcagtgtacctggttgtggactttgcttagaaggagaaatggccaggtgtgcaattatatgtcaagtaatgggctgtagtcagtgctttgtccagatagggacttggaaggaacatgattagaaaacaggtgacaaagaaatttggggaagaggtatgtggacagatctctctgaatgggcaaaggatgtgaatatatttatgtcccatgtgagtgctcaacgaagggtgacctcagcagataaggatttcaataatcaagtaaatatgatgggccgggtgcagtggctcacgcctgtaatcccagcactttgggaagccaaggcgggaggatcacctgaagtcaggagttcaagaccagcctggccaacatggtgaaaccctgtctctactaaaaatacaaaaattagccaggcatggtgatgcgtgcctgtagtcccagctactcgggaggctgaggcacgagaaatgcttgaacctgggaggcagaggttgcagtgagctgagattgtgccactgcactccagcctgggcaacagagcaagactccatctcaaaaaaaaagtagatatgatgacctgttctgtggataccagtcatcctttttactcagccacctatgtcactgcctgatgggctcatgaacaaagtagccatggtggcagggatagaggctatgcatgggctcagcaacatggacttctattcaacaaggctgacctggctatggccactgctaagtgcccaatctgccagcagtagagacaaacacagagtcctcagtatggcagtatttcccaggatgatcagccagctatctggcagcaggttgattacattggaatatgttcatcatggaaggggcagcgttttgtccttcctggaaggaaactgaactactgcttcacaatggaggtatggaagagtgtgtctggaatacaatagatcccttagagtgtctcttagtattaccaggccctatgattctggtcaatgggaaactacagcaacccaatccatgcaggactactagtggcccaggctcttcaggaataaaggtttgggtcacctcatcaggtaaagaaccacaatcagctgagatgcttgctgaaggcaaagtcaatacagaatgggtagtagaagaaggtagttatcaataccagccaagttttgttatatcatgttaggtggaattatgacctcatttttgtctctacttagagataaaggagatgtgtatgatgggtgctacattgacaaggggtggacttgtcatggttaattttatgtatctactttacttggtcataaggtgcccagatatttactcaaacattattctggttatttctgtgaaggtgtttttgaatgggattaacatcgaagtcagtagactgagtaaagcagattgctctccctaatgtgggaggcatcatccaattagttgaaggcctgaatagaacaaaaagactgagtcttccccaagtaagaaagtattcttgctgcctgtctgcctttggactggaacatcagctttttcctgctttcagtcttgaactaaaacagtttagctcatccagagagacagagagagagagacagacagacagaatctcctattggttctatttctttggatatccctgactaacacactcatataagtagaatcatataatatctatccttttatgtctggcctattcacttagcgtattttcttttttttttttttttgagatggagtctcactctgttgcccaggttggaatgcagtggtgcgatctcggctcactgcaagctctgcctcccgggttcatgccattctcctgtctcagcctcccgagtagctgggactacaggcacccgccaccacgcttggctaattttttgtatttttagtagagatggggtttcactgtgttagccaggatggtctcaatttaccgacctcgtgatctgcctgcctcagcctcccaaagtgctgggattacaggcatcagccaccgcgcccggccttcacttagcatattttgaaagttcatcatgttgtggcactaatcagagatataaccttttttaaatgggaatttttcttctagaatatccaatgtctagacttcagttcaccaaactgccagtttggtgaagtctttcatccagccttgatggataagggaattcttcttggacatgatgtttacctgagacttaacgaatgagtcaggtgaaagtggcagtagagggtagctagaaaaatgttccaggtagaagaaatagtatctatttaaaagcctggtatgagatataatggctgtatttagtgacctgagaatttcttagtatggatggagcttaaagagccaagtggcaagagactgtattagagagattggtaaggaccacatcatggttaattcttggtgaaaaaagaatataaaaaataccaaagagaggaactattccttcccccattactcatggggtgataagactttatgtcatgtcttttaatcaggacaatttgttgaattatccagcaaacccagattaagaatgaagacttcctggaccactaaacttaaaggtcaaaaaggcttgggaatcaaggtgctgatgaggagaattaactcttggatctactctgcccttttctcagtattttacctttttcttaaagtcactgtgttctctcagaatgccttttacaatgtcttgctaccataggtacttaataaattttgctctgaaaatttggtcatatatcaacctttttatgttatgttaagctctaggagaggtggtattttttttctttctttctttctttccaaggagaccagcttacctttactttgccattctgaaaaaagagagtccactgatggccatcttgactgctggagatgaggaactccttcacatacatgctggtaagcagagattttactccctgagtagttactcctgtgactttcattgtcttctggaagtccacttgcagccactcttttggattattcacctgagggcaatagagttggactagtagcctcttggtcaccatttactcccagaaattcccaaatccctcttaaccataccacagcacttctcactctactttcttttttgagacggagtcttgctctgtcacccaggctgtagtgcaatggcatgatctcagctcactgaacctctgcctcccgagttcaaccgattctcctgcctcagcttcccgagtagctgtggttacaggtgcccaccaccatgtccagataattttatatttttagtagagatgaggtttcaccaggttggccaggctggtcttgaactcctgacttcaggtgatctgccacctaggcctcccaaagtgctaggattacaggcgtgagccactctgcccggcctccttccttccttcctttctttctttttcttccttccttctttcctttctttctctctctctctctctctgcctctttcagacagagtcaggcactgttgcctgggctggagtgcaatagcatgatctcagctcactgcaacctccgcctcccaggttcatgcgattatcctgcctcagcaaaagagtgatctagaactcctgaccttgtgatcggcccgcctcagcctcccaaagtgctgggattacaggcatgagccaccgcacccagcctccactttctattggctagtcagtctctcttattcaactctaagcaacttcagggccaaaatttttcacaattcacctttgtatccctaggctcatcctagggatactaagatgtgcagtaaatgtttacttttcattgatgtaatgagaaacctggaaagaaagctaattgttgatatttatctgtaaaatggactttagcttctacaattctttgacagatattagctcagtactagatatagagattcttcttccaggaggttcaattagagatcatttcccccaaatgcctgtgtggttgtctgcccataaccaaacttccttgacacactttttagaactaacagttgacagaaatacctcagaagaaacagtcaaggccttccccgattttttccccaaccactgctctgagtcagttaaacagtaaatctgttgcctcttacctgaggtctccaggcattactcctcccttggaggtgaagtcgagcttttgaaggagaccaggtggcaaacatattggtaaagtaggatgaagcagtaatctgtgcatctgatattgctttactctccattcccaatggcatgctgcaacctcaaagaaaagaaaaaagaaggttatcacaaggacatgcttcagcctcagttatactgagcagcttccactgatattctagggctactgtcatcataatatcatttctcaggttttaacttttgcacagattctgttattggttttttgttttgttttgttttgtttttgtttttttgagatggagtctcgctttgtcacccaggctggagtgtagtggcatgatctcagctcactgcaacctctgcctcccgagttcaagcgattctcttgcctcagcctcccgagtagctgggactacaggcgcacaccaccacacccggctaattttttgtatttttagtagagttggggtttcactatgttagccaggatggtcttgatctcctgacctcgtgatccacccgccttggcctcacaaagtgctgggattacaggtgtgagccaccacgcccggccaattctgttattgctatctgttttccagccagctcttcccactttgtgtgactctttaattttctttgtttcttttcttcttctacttttattttagattctaggggtacatgggtaggtttgttgcatgggtaaattgcatgtcactgaggcttggtgtatgaatgatcccctcactcaggtagtgagtgcagtacacaatacataaccttctaacccacacccccctcccaacctctcccctcctgagtgtccatcattgtgtccatgtgcatttaatgtttagctcccacttatgagaacacatgatatttggttttctgttcctgcattagttcatttatgataatggcctctagctgcatctatgttgctgaaaaggacatgatctcattcttttttatggctgcatagtattccatggtatgtatgtaccacattttctttatccaatctgttgttgatgggcatttaggttgactccatgcctttgctattgtgaatagtgctgaaatgaacatatgcgtgcatgtgtctttatgacagaatgatttatattcctttgattatatacccagtgatgggactgctgggttgaatggtatttctgggtttgcccaggactatgctggttttagcactgacaattttgtgtcctgataccgggaacccctcccccagtctcaggataactagaacagttagtcaccctacccatggttgagggaagaaggatatgggatgacttggcacttactatttaaatcacagcccatcaactccatgcgaagagtgctgcgaatgctataatgagttgggtgcaaacggatgtatcgagcaataattggagggttaaaaatattgtgttttatcccagatgaatccacattgccaaagaagacctgtatggagagattagcacaaatacatggaaagtgaatacagagtaaaaagcaatttctgtcaatcatatcttccttctaatttgctttgtgcgtttctcaacagcatccaacatctacataagacaactatggttagatggatgttacgatggtagacacaaaggaggaaagcaccaagaagaagtgggaacaaaggaaattattaggtctggggcaagtgaagttattttctactttgagttcctgtaaaaggctcataaaagttgaggaagccatttgggctctgctactccagcatggtccacagaccaggagtagcagcatcacctgagggcaattcaaaatgcagcatcaggagaacggtatcagtgagttgatgggataggaggtccctagctcttgttcccccacaggaacaataatttgacaatgatctatggacaaaagtgtctttgtgggagccttgggattcaggtaggaggttgagaaaccctggtagagctcaagaacaaagatgaatactttaataaggcaggcccacattctagcggcaggcctgtcaactgtagttctggttgtggacccagaagcagcccaccaccctggggacttagctccagagttgtttgtatgtggtcctaccactatccctatctgcccaggaatctgggaggagcaactcccattggcaaccccagtaacagggctcccaactgtggactctgaagcagccctgtacctaaagcagcttcagtaccacactaccatggtcttggggaagttttgcctacttaggaaacaggtgggagtcatgccagtccacctctggaagcaggcccaccaactagacctgactgtggactcagaagtaaccctgtgagccaactccagtcttgctgtaccatgttctggagacagtcctgcctgaatccacacttacctgtgcccccataacaggcccactgactgtgggcccaagtggggaccctgaagcagccctttgacccagctccaggcccactgcatcatggtctgcaggcagtcctgcccactcaaggacccagtgagagctacacctatccaaagccctggtaatgggcccattgtctgagtacccaacttcagaccagaagaggtgtcagctcactccaatgcacagataccaatgctaggctatgtggatcatgaagaatcaggcaaatatgacatcaccaaagggaactaataaagctccagtaaccaaccctgaagaaatggagattcatgaaatttttgacaaagaattcaaaataatcatttaaagaagctcaattagctacaagaggatacaggaagacgactaacaaaatgaggaaaacaatacatgaacaacattagaagtttaataaagaaataaaaaccataaaaaagaaccaaataaaaatcctgtagctaaagaatattgctgaatatagctgaagaatgactgaactaaaaaatttaatagcgatctttaatagcagactcaatcattcagaagaaagaatttgtaaacttgaagacaagtcatttgaaattatctagttagcggaataaaaagaacaatgagaaagagtgaaggaagaacagaggacttatgggacatcatcaagcaaaatgatagatgcattatagaaatcttaaaaggagaagagagagagaaaggaaacttatttaaagaaataataggtgagaactccccaaatctatggaggggaagtgccatctggattcattaagcccaaagataaccaaatacattaaacccacagaagtctacagtgagatgcattataattaaattttcaacaaagacaaaagagaattttggggtagtaagaagaaagtgaattgtcacctataggggagctccataagactatgagtggatatctcagcagaaaccttgcaggtcaggaaagagtgggatgatatattcaaagtactgagagaaaaaaatccaatcaacaatactttatctggaaaaactgtcctttaagaatgaacacaaagataaagcctttctcaaacaaaaactgagggggtttgtcaccatgagacctgccttataagaagtgctaatagttcttcaagttgaaataaaaaaaaaacagtaacacaaaagcatatgaatcctttcactgctaaaggtaaatataaagagaaacatagactattgtaacactataatgattgttataaatcactattaatattaatttataaattaaaagacaaaaatagtaatagtaactatagtgacagaaatttgtcaatggaaacacaatatagaaggaagtaaaatatgacgtcgattacataaagttgtggcggggggaatgagtaaagtatagagtttctgtatgtgattgaaggtgttgtcagcttaaaacagactgccataactataaagtgttcaatttgatccctgtggtaacccccccgaccgcccccccacacagtagatatacagaagataaagagaaaagaatcaaaacacatccaagcaaaaatcatcaaaccacaaagaaagaaaaagaggaaaggaacaagaaaactacaaaacagaaaactattaacagaatggcaacagaaagtcctaacctatcaataattactttaagtgtaaattgactaaactccccagtcaaaagacacagagtaactgaatgggctttttaaaaagccaacaattcagagatgggaagtaagaaacaaaaataaacaggacccaactacatgttgttgataacagactcacttttgatttaaggacatacataggctgaaagtgaaggggtggagaaagttatgccatgcaaactgtaaccaaaagagagcaggggtggctatacttgtatgagaaaaaatagtctttaagtaaaaaactgtgacatgagacatagaaggtcattatataataaaagggtcacttgaacaggaagatgtaataattataaatatatatgtacccaacacgaaagtacctaaatatataaagcaaacattgacagacatggaaggagaaatagataacaatataatatagttgacttcaatactccactctctataatgaatagatcatcccaacagaaaatcaataaggacaaaacagaactgaagaataaaatagacccaatggacctaaaatgtatatacagaactttccacccaacagtagaattatcaagcacacacaaaacattcttcaggacagatcacctttcaggtcacaaaacaagtcataataaatttaagaagattaatatcataccaagtatattttctgaccacaatggattgaaactacaaatcaataacaataagaaaacacgaaaattcacaaatatgtggaaactaaacaacacattcttgaacgaccattgggtcacagaagaaaccaaaatcttgataatataccaaaacttaaaggatgcagtaaaagcatactaatagggaaatttatagcaataaatgcctatatttaaaaagaagaaacatatgaaataaacaacccaacttatcacctccaggaactacaaaaagaagaaaaaaaaaactaagcccaaaggtagcagaacaaaggagataataaatgctagagcagaaataaataaaaaagagaataaaaaaacaattggaaataactgacaaaactaagagttgatttttttgaaaaaataaacaaaattgacaagtccttatctagactacgaaaaaaagagagaagactcatataaataaaatataaatgaaagaggagacactacaactgatgtcacagaaacagacagaaccataagggactattataagtgtcaacaaattggttaacctagaggaaatggataaattcctagaaacatataacataccaaaactgaataacaaagaaatagaaagccttaacagactaacaacaaatagggatattaaatctagtaatcaaaaaccttccaacaaagaaaagcccaggaccaatggcttcatggatgaattccatcaaacattcaacgaagtattaataccagtatttcttaaactcttccaaaaaatacaagagagaacacttcaaaatacaatttattagccaacatcaccctgataccatatccaggcaaaaacaacactagaaaagaaaactacaggccaggccaggtgtggtggctcaagcctgtaatcccaacactttgggaggctgaagcaggcaaatcacttgaggtcaggaattcgagaccagcctggccaacaaggtgaaaactcatctctactaaaaaaatacaaaaattagctgggtgtgatggcatgttccagtagtcccagctactcaggaggctgaggcaggagaatcgcttgaatccaggaggtggaggttgtagtgagccaagatcataccaccactgcactccagcctgggtgacagagcaagactctgtctcaaaaaaaaaaaaaaaaaaaaagaaagaaaaagaaaatgaaaagaaaagaaagaaaactacaggccaatatccctgatgaacacggatacaaaaatcctcaacaaaacaccagccaaccaaattcaacagcacattaaaaggatcattcatcatgaacaagtggtatttatccctaggatgcaaggatggttcaacatgggcaaatcaatcaatgtgatataccacattatcagaatgaaagatgaaaaacacatgattatttcgatcaatacagaaaaagaatttgacaaaactagatatccattcataataaaaactttcagcaagatagatacagaaggaacttaacacaataaagaccatataggaaaagctcacagctgatatcataaccaaatgtggaaaaactgaaggtttttccttttagatactgatatggtttggctctatgttcccactcaaatctcaccttgaatcgtaatccccataatgcccacatgtcaagggagggacctagtgggaggtgattggatcatggggatggtttcccccacgctgttctcctgatagtgagttcttatgagagctgatggttttataagtgtttgacagttcctccttcacacactctctcttgcctgctgccatgtaagatgtgcctatttccctttctgctatgactgtaggtttcctgaggaaagaacatgggacttatgggacagccatgcagaactgtgagtcaattaaacctcttaaagcttcataagtgaaggagaaatgaaattctttacagacaaccgaatgctgagggattttgtcaccatcagacctgccttacaagagctcctgaaagaagcactaaacatggaaaggaacaactggtactagccactgcaaaaacataccaaattgtaaagaacattgacactatgaagaaactgcattaactaatgggcaaaacaaccagctagcatcataatgacaggatcaaattcacacataacaatattaaccttaaatgtaaatgggctaaataccccaattaaaagacacagactggcaaattggataaagagtcaagacccatcagtatgctgtattcaggagactcatctcacttgcaaagacacacataggctcaaaataaagggatggaggaatatttaccaagcaaatggaaagcaaaaaaaaaagcaagagttgcaatcctaatctctgataaaacagactttaaaccaacaaagaccaaaagagacaaagaagagcatcacataatggtaaagggaaaaatgcagcaagaagagctaactatcctaaatacatatgcacccaatacaggagcacccagattcataaagcaagttcttagagacatacaaagagacgtagactcccacacaataatagtgggatactttaacaccccactgtcaatattagattaatgagacagaaaattaacaaggatattcaggacttgaactcagctctggaccaagcagacctaatagagatctacagaactctccaccccaaatcaacagattatacattcttctcagcaccacattacacttattctaaaactgattacataattcgaagtaaaacactcctcagcaaatacaaaagaatggaaatcataacaaacagtctctcagaccacagtgcaatcaaattagaactcaggattaagaaacacactcaaaaccacaaaaatacatggaaactgaacaacctgctcctgaatgactactgggtaaataatgaaatgaaggcagatataaagatgttctttgaaaccaatgagaatgaagacacagcgtaccagaatttctgggacacacttaaagcagtgtttagagggaaatttacagcactaaatgcccacaagagaaagcaagaaaaattgaaaattgacaccctaacatcaaaattaaagaattagagaagcaacagcaaacaaattcaaaagctagcagaagacaggaaataactaagatcagagcagaactgaaggagatagagacacaaaaaaaccttcaaaaaatcattgaatccaggagctggtttttttgaaaaaatcaacaaaatagatagacttctagccacactaataaagaggaaaagagagaagaatcaaatagatgcaataaaaaatgatattggggatatcaccactgatcccacagaaatacaaactaccatcagagaatactataaacacgtctatgcagataaactagaaaatctagaagaaatagataaattcctggacacatacaccctcccaagtctaagccaggaagaagttgaatccctgaatagacctataacaagttctgaaattgaggcagtaattaatagcctaccaaccaaaaaaagtacaggaccagacggattcacagacaaattctaccagaggcacaaagaggagctggtaccattccttctgaaactattccaaacaatagaaaaagagggaatcctccctaactcattttatgaagccagcatcatcctgataccaaaacctgacagagacacaacaaaaaaagaaaatttcaggccaatatccctgatgaacatcgatacaaaaatcctcaataaaacactggcaaaccaaatccagcagcacatcaaaaagcttatctaccacaatcaagttggcttcatccctgggatgcaaggctggttcaacatatgcaaatcaataaacataatccatcacataaacagaaccaatgacaaaaaccacatgattatctcaatagatgcagaaaaggccttcgataaaattcaacaccccttcatgctaaaaactctcaataaactatgtatcggtggaacatatctcaaaataataagagctatttatgacaaacgcacagccaatatcatactgaatgggcaaaaactggaagcattccctttgaaaactggcacaagacagggatgccctctctcaccactcctattcaacatagtattggaagttctggccagggcaatcaggcaagagaaagcaataaagggtattcaaataggaaaagaggaagtcaaattgtctctctttgcagatgacatgattgtatatttagaaaaccccatcatctcagcccaaaacctccttaagctgataagcaacttcagtaaagtctcagggtacaaaatcaatgtacaaaaatcacaagcattcctatacaccaataacagacaaacagagagccaaatcatgagtgaactcccattcacaattgctactaagaaaataaaatacctacgaatacaacttataagagatgtgaaggacctcttcaaggaaaactataaaccactgatcaaggaaataagagaggacacaaacaaatggaaaaacattccatgctcatggataggaagaatcattatcatgaaaatggccatactgcccaaagtaatttatagattcaatgccatctccatcaagctaccactgactttcttcacagaattggaaaacactactttaaacttcatatggaaccaacaaagagccctcatagccaagacaatcctggacaagaaggacaaagctggaggcatcatgctacctgacttgaaactatactacaaggctacagtaaccaaaacagcatggtactggggccaaacagatatgcagaccaatggaacagaatggaggcctcagaaataacaccacacagttacaaccatatgatctttgacaaacctgacacaaacaagcaatggggaaaagattccctatttaataaatggtgttgggaaaactggctagccatatgcagaaaactgaaactggatcccttccttacaccttttacaaaaatcaactcaagatggatcaaatacttaaacgtaagacctaggaccataaaaatcctagaagaaaacctgggcaataccattcaggagataggcatgggcaaagacttcatgtctaaaacaccaaaagcaatggcaacaaaagccaaaattgacaaaggagatctaattaaactaaagagcttctgcacagcaaaagaaactatcatcagggtgagcaggcaacctacaggatgggagaaaatttttgcaatctatccatctgagaaagggctaatatccagaatctacaaagaacttaaacaaatttacaagaaaaaaacaaacaaccccatcaaaaaatgggcaaaggatatgaacagacacttctcaaaagaagacatttatgcagccaacagacatttgaaaaaatgctgatcatcactggtcattaaagaaatgcaaatcaaaaccacaatgagataccaactcacgccagttagaacggtgatcattaaaaagtcaggaaacaacagatgctggagaggttgtggaaaaataggaacgcttttacactgttgatgggagtgtaaattaattcaaccattgtggaagacagtatggcgattcctcaaggatctagaactagaaataccatttgacccagcaaatcccactactgggcatatacccaaaggattataaatcattctacaataaagacacatgcacatgtatgtttactgtggcactattcacaatagcgaagacttggaaccaacccaaatgtccatcaatgatagactggattaagaaaatgtagcacatatacaccatggaatactatacagccataaaaaaggatgagttcctgtcctttgcagggacatggatgaagctggaaaccatcattctcaaaaactatcacaagatcagaaaaccaaacactgcatgttctcactcataagtgggagctgaacaatgagaacacatggaaacagggagtggaacatcacacgctggggcctgttggggggtggggggctaggggagggataacattaggagaaatacctaatgtaggtgacgggttgatgggtgcagcaaaccaccagggcacgtgtatacctatgtaacaaaactgcatgttctgctcatgtaacccagaacttaaaatataatttaaaaaataaataaaataaaaagcatccaaatagaagagaatagtaaaattatctctttttgcagatgacatgatcatacatgtagaaaactctaaagactcaaaaaaaaattgttagaactaatacatgaattctgtaaagttgcaggatacaaaatcaacatacagaaatcagtggtgtttctatacactataaaatatcccaaaggaaattagaaaataatcttatttacaatagcaacaaaagaataaaatacttaggaatagacttaaccaaagaaatgaaagacttgtacaatgaaaatatagaaaacatttatgaaggaaattaaagaagacacagataaataaaagatattccatattcctagattggaagaattagtattgttaaaatgtccacactacccaaagtaatctatagatttgatgtgatccctatcaaaatctcaatggtgttcttcacagaaataaaaaaaaaattttaattaatatgaaatcacaaaagaccccaaggaggcaaagcaatcttttttttttttttttgagacagagtcttgctctgttgcccaggctggagtgcagtggtgcgatcttggctcactacaacctctgcctcccaggtttaagtgattctccacctcagcctccagattagctgggatcacaggggcctgctaccacacctggctaatttttgtattttttcagtagagacggggtttcaccatgttggccaggctgctcttaaacttctgacctcaagtgatccacccacctcagcctcccaaagtgctgggattacaggcgtgggccaccacatgcagcctggcaaagcaatcttaagcaagaagaacaaagctagaggcatcatacttcctgatttcaaaatatactacaagtctccagtaatcaaaatagtatggtactggcataaaaatagacacatcaaccaagggaacagaatagaaaagcccagaaataagttcacacatttacagtcaacagatttttgacaagggtgccaagaacacacaacggggaaaagagagtctcttcaataaatgatattgggaaaactgaatatccacatgcagaagaaagaaattgggcccttttctcacactatacataaaattcaactcaaaattgattaaacacttgtatataagacctgaaactataaaactcctagaagaaaacaggaaaaaagctacctgatattgatttgggcaataatttttttatatgacaccaaaagcacaggcaacaaaaacaaaaatagaaactgggattgcattaaactaaaaactttctgcacagcaaaagaaataatcaacagagtgaaaagacaacctatggaatggatgaaaatatttgcaaactgtatatctgataatgggtaagaaactcaaacaactcattagtaagaaacaacccaattaaaaatgggcaaagaacccaaatagaatttttcaaaagaagaaatataaaaggccaacagataaatgatgctcagcatcactaacccacagggaaatgcaaatcaaaacacaatgagatattccctcacatctattagaatagtgtcttagtctgttatggactataacttattatggactctaatttattatgctgctatgacagaataccacagactgagtaatttgtagtgaacagaaatgtatttggctcacagttctggaggctgggcagtccaagatcaagaggccagcatctggcaaaggccttctttctatatcataacatggcagaagggcaaaaagagggcaagagagagcaattcaaattcacagccttaggtgcttttgtaatcggcattaatccattcatgagggtggagtcctcataacctaaacatctcccattcggccctacctcccaacactgtcgcattgggaattaagtttccaacacatgttttttggggaaaacactcaaaccatagcaaatagctattatcaaaaagacaaaagatgacaaatgttggtggtaatgtggagaaaaggaaacctttgtacactgttgctgcaaaaataaattggtacagccattatgaaaaacagcatagaggttcctcaaaaaaactaaaaatgaataccatgtgatctggcaatctcacttctgttatatatccaaaggatacaaaatcagtatgttgaatatctgcactcccatgttcactgtaacagtattcacaatagtcaagatatggaaacaacctaagtgtgtccattgatggatggagggataaagacaatctgatatatatatatctgatggaatattcccacaattataaaatattatttggccttaaaatagaagaaaatcctcccacttgtgataacatggatgaacctggaaaatattatgctaagtgtaataagccagacactgaaagaaaaatacttcatgacctcatatgtggaatctaagatggtcaaactcataaaagcagacagtagaatcttaggtgctagggactgtggtgtgggggaaacagggagatgttgatcaaagggtacaaaatttcaattatgcaagataaattagttctggagatctaatgtacgatatagtaactatagtaaacaatattgtatacttgaaatttgctaaaagagtaggtcataaatgttctcaccacaaaaaaaggtagctaggcaaagagatagatatatcttaattagcttgcttgtggtgaccatttcacaatgtatcaaacatcatatatgaaaaacaaaatatatcaaaacatcaagttgtacctcttaaatatatgcaacttttgtcaattatacctaaataaagattttttaaaagagatgcagttccttgggcaccatgtcagttctactgaatcagaatctaaattttaataagacccttagctgtttcataagcagtaaagtttgaaaacactggcagaggacacagtcagctgtgaaagagtactgggaatgcacagcctatcctccaccctggtctcagaatgatcttctaagaatgtagtgtgtgtgtgtgtgtgtgtgtgtgtgtgtgtgtgtgtagagagagagagagtctataatgtgggcattaatgaatgatcccactgtatgaattaatgagacacgttagtatccaaaacgtgggatttgacaccttgacatgtctgggttctggacaaaattacataacatattcaagagaaagggaatacagtttgagaaatatggtagtaatgccaattcgaaaggcctagatttaaaccatggcatacagcataagaaatactgaaaatgatatcactcatagaacacctgggattttttatctgcttgaatacactaaaataggtatcagtgtaagtctattatatgatcacacatcagtttagtatcatgggaattttttttttttttttttttttgagacggagtctcgctctgtcgcccaggctggagtgccgtggcgcgatctcggctcactgcaagctccgcctcccgggttcacgccattctcttgcctcagcctcccgagtagctgggactacaggcgcccaccaccacacccagctaatgttttgtatttttagtagagacggtgtttcaccgtgttagccaggatggtctcaatctcctgaccttgtgatccgcccacctcggcctcccaaagtgctgggattacaggcataagccaccgtgcccggctggaaattttaaaaaattattctgccatgtagcatttttttcttcccagggaatagaaaatattaataaatttgtggctttgttcctaaacaagttataccagaaatcacaatattcttttttataaatatatctgtattggggggttaaaatagaatgaataacatattcaaaccatataactttgtttaaagatttaccaaggattttgttttctctgctgctctcctttctatataggagaaaatttgaccttctatttatggcctttagatttggcttttgcaagagctagtataattaaatcccaggtaataagtaaacactccaaaccacctctctggggtgggatggtgcaaaatcatttgtagaaagctacctgtttcgtctagctacctcctgcgtaagtgggtactggcagctcttgggggcctgaattttatgtctcattttgactaaaataatgaatgtgtagtctgactccaaaaggggatagtcatctttgatttgagataggtctcgttatgtttccaaatttctgatttaaaagaaatttgttgctacagaataatcattgagaagtagaagaagttttgaaatgaagtatatatcaatgtaaaatgccattccgttttatcagcatccaaaaagtttatgttgaacttaagagtattatatagctaataaatgttgatcattaacttgtgactaaaccgtatgtgctaggaagaatatgatctctcagtgatgtccacattttaatccccagaacatttgactgtgttatgttgcatggcaagagggatttaaggttgcagatggaattaagtttgccaattagctgatgtcaaaatagggagaatatcctggattatccaggtcggcccaatgtaatcacaagaggccttgaaagtgagagagagaggcagaagaggagagtcaaagggagacgtgactacttaagaatagtcacaaaggtgcaatgttactggcttcgaagatggaggaaggaagccatgagttaatgaatgtgtgtggcctctagaagctggaaaagaaaggaaaaaggatccttttctttttctttttttttgagagggagtctcactctgtcgcccaggctggagtgcagtggcgccatctccgctcactgcaagctccgcctcccgggttcacgccattctcctgcctcagcctcccgagtagctgggactacaggcgaccgaaaaaggatccttttctagagcttccagaaagaaatgcagccctgatgacaccttgattttagcccagtaagacttgggtcagtcttctgccctatcgaactgtaagataataaacttgtgttgttttaagccatattaagtttgtggtaatttgccaccccagcattagaaaactaataccctgtatacattggctttgccttcattcgttactcaatctttgtgccttgattagaaacctgcttggggagacaatttattaattcaacaaatagttaatgactgactatacaaatcctagattccatatattatgtgccaggcattgtgctagaaggcctcactggtaaattctactaaatgtttaaggaaggattaacattaatccttcttaaactcttccaagagacagaaaaggagagtaaactttacaactcatactatgaggccaccatatcttgatatcaaagccagacaaatatatcacaagaaaagaaaattacaaattgcatgtaattgaatatgtgagtataatattcccttatgcatctaggtgcaaaaatcttcaacaaaatattagcaaaccaaatccagcagcatgttataaaggttatagcccatgctcaagtggaaattatcccaataatgcaagactggttcaacataagacaatcaatcccccagtcaactccacattaataaaatatagggaaaaaaacccctgcaagttcattctggttgatgcagaaaaatcacttgataaagctgagcaccttttcatgaccaaaaaaaaaaaaaaaaaaaaaaaccactaagcaaactagaaatggaagagaaaatccacaacatgataaagagcattcataaaatacccaaaactaacatcacactcaatggtagaagactgaaagatatttccctaacattagaaacgagacaagaatgcctgcttttactgcttctattcaaaattgtattggaagtcttagccagagcaattaggaaaaaaagaaataaaaggcatccaaattgaaaaggaataagtaaagctatcttattctcagatgaacatgagcttatgtatggaaaaccccgaagaatccacaaaacactatagagctaataaacgaattcagcaaagttgcaagatataagatcaacgtgcaaaaatcagttgtatttctacacactagcaatgaacaatctgagatgaaattaacaaaataaaaaataattctatttaaaatagcatcaaaaagaataaaatacttaggaataaattcagctaaggaggtaaaagacttgtacactgaaaactacaaaacattgctgaaagatattagagacagcataaagaagtgaaaatatatcctgtgttcatgaattggaagacaatattattaagatgatagtactacccaaagtgatctacagatttaatacaatctgcatcaaaatcccaatggccattttttttttggcagaaatggaaaagccaatcttaaaattcatgtgtaattgtgcaagacctcaaatagccaaaataatcctaaaaaataacaaagctggataactcacatttcccaaattcaaaacttcgtataaagctacagttatcaatgctttgtggtactggcataaggacagacatatatataaatggaatagaattaagaagcaagaaataaacccataaatatattcatgggtatgtacctcaaatatggatggttcccagcttataatggttggacttacaatattttgactttatgatggtatgaaagcaacatgcattcagtagaatccatatgcataaaagtacttaaagtacacatacaaccattctgcctttcactttcagtgcaatattgaataaattacgtgagatagtcaacacttcattataaatttggctttacgttatatgattttgcccaactgtagcctaattgtaagtgttctgagcatgtttaaggtaggcctggctaaattatgatgattggtaggttagccgctgatatggtttggctctgtatccccacccaaatctcacatcgaattgtaatccccgtgtgtcagaggagaggcctggtgggaggtgattggatcatgggggtggatttccccttgctgttcttgagacagtgagtgagttctcatgagatctgatggtttaaaagtgtatgacatttccgtccttcactctctgtctctcctgctccaccatggtaaggcgtgcttgcttcccctttacctgctgctgggactgtaagtttcctgaggcctcacagtcatgcttcctgttaagcctgcagaactgtgagtccattaaacctcttttcttcataaattaccaagtctcaggtagttctttatagcagtgtgagaatggactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatcgtactcaaagttctagtcagggcaattagtcaagaaaaagaaataaaaggcatccagatcggaaaggaacaagtaaaaccatctctattcatagatgcatagatggcatgttcttatatagaggacactaaagagtccaacaaaagaaaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcccggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtctagaaatgcgcagacatggaattagggtcacgagtttcgtttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtcgctgcaggtggagatgtggccactgttgactgctgagcagaaccacctccttcacctcgttctgcaagaaaccatctccccctcaggacagggagtctgatccatcccattcacccagtgacttctttttgcccaggcctggactttttgcatcagtcacgttaaccagatgactttgcctgttaccaaacctcatgcatccacgtttgcgtctggggaggaataaaaagacatcgttcccgcttctgcgttttgttattcctactgccgccataggaattatttcgttggctgaacgttaccagcaccccgagaacacattttgatagaatcagagtagaggacatggctgtcttctaaaaagccacgacatgaaaatgacaatccctttcgtctccttcctccgctgcttccacctaacgcagcctcctgcctccgcctttgtttcatagtgaggattttattttgcacggcgccctccctctaaatacctaccctagatgatttcatcctgcccctcacttcttaacatattcctgtgtctttgtaatggccaaatttctccttccactcgtccgcacggtacgtcttcatgggagtcattttattccttacagcttccttgtaaccacagccctaaatccatgataaagctactcttgtactcctcatgtgtggttttggtgtccgtcgtctataaaatgtgactctcttacctacttgtcaggaggccagcagcagaaccagatagctgtttgggctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagaggtatatgcagtctggatcacaacagcttttatttgtaatagggattttttttttttttttttttttttttccccccgagatggagtctcactctgtcgcccaggcaggagcgcagtggcgtgatctcggctcactgcaacctccgcctcctgggttcaagcgattctcctacctcaacctccagggtgcctgggattacaggcgtgcaccaccacgctgggctaatttttgtatttttaatagagatggggtctcaccatgttggccaagctggtctccaactcctgacctcaaatgatccaccctcctcggcctcccaaagtgctgggattacaggcatgagccaccacgcctggcctgtaatagggattttgctgcaacttttagttaagtaggtgaaatcagagtgcgtggccctttggtgttgtgcgatcacgtgactgcaaggcagcctccgtgttcccccaaagcaggatggcgttccgtttgagaacacttaagtttccaaggctttctggctcaaatggagcatgccccccaactacgctgttttcttatttattgcgtctttttaatccttttgatggtgacaacaagaactcttcagaatatagcctctttctcaaactttcaaccctggggaaatgcatcctttgggccgaagttgcacacaatcctgatcttcggggctgagatgtaaggacacagtttggagtaggtgtttttgttttgcgtctttttgcaggggagaggtgtggagggttgtcactgtgagttgagtgcctccaaatgggtgggacttgtagggtgttcttttctgcttctatttctatttcgacagtgtggaagtaatgggaagcacaggagaggcccattccaccatcattcctctttctctcacttggctgccaggaagggtcctacggagccctgaacgcctagcccaaattattgtaaaagcggttgaagggctcatgctcctttgctctttggctctttcctggtatgctcctcttaacccgggctgcagacctggccggctggcttcttgtcaggttcaggagttacggagcatgactggtgaccagtttgggatttgggcttcaggagaagcctccttaggcctctggtccaaactccttgcgtcagggaggtgaggggaaggataaccagacggtcaggtagtgggtatctgagcataattctaggaaacactaaaactcctcgttttccatttgccgtgggctcattcatgtatctccctcagaagcttaagagcagtgataactgggccgaggccagatttcagcagttttgagaattccctcgtaatgtatcacatcagtatcaaaagtcaacactgatttctagcatgccaaaagcaaatactttcagaggacatgattagtttgctttttaacttgaaaacaattccaaattcacacttaaaacagtgtaaaccgtcggaaatggtggcagcgaagcagtgaacccttaaaggctgttggggttccccttctccccattgtgaggtattcccaaaaggataaatgttgcttatgaaagaatattttatacgtgaatagtacaaagacaaagacgtttgagaaccgctacgccggaggaaggtggtcaagactgaaattagcgtgttaggcaagatctggttcctaggtgctgaggattctggtgccaaggattaatgttaaccgtgcaggcatctctaccaccgttagaggagaccagcagcccacagactctttctgtcaagggcgggatagaaatgtgttagtctttacagaccacaggtggtctctgttgcacagtcttctttgtttctttgtatgtttgtctttgcaatcctttcaacgtgtaaaaactattcttaactcacagtccgtacaaaagcaggctatgggccaaattctggggctatagtttgcccacccctgaattagaacccaggacatagtagttgctcagtgactgttcaaggaatgaacctcatgagagtagttaataactgtaagtaatttatccttatcgttaaaatacaaagattgaagaataagtgaactaagcattcacctccagattgtaggaaacaaaccaaaagaaaggaaaatagaatttttaaagttttgaacagagattgatgaactagaaacagctctttcaaaaccacgtttgggtttaaaactgagctgattctttgaaaaattaatagaatagacaaacacttgccaactcttgatacagaagggaaaaaaggagaaaagacatatgtgtgtatacagatatagatgtatggcacaggaagggatatatgactctaatgtgcacatttgcagacattaactcaaggcaacacaaatgagaatagcaataatcatataacgattggaaaatatagcctagtatctctcactaaataaagcacatggctcatatggctttttcatttactctcattaaatactggattcctacattaaataagctattctagagcaatagtcttcatggaaaaaaatggaagctttcccactttattttcaagtttaatataaccctcatgccaaaacctggtaagtagagctactgaaaaagctaaacccatttcattcatgaatatagatatagaaattataaatgaaatgttggcaaattggatccagctaagttttaaataactaacacactatgactgacgaaagttttcccagaaatggagcacagtagtgctcttgcactggtctgtgagagccaattgtaagtaagcatctcttcccatccctggggccaggcatgatgggagtagtatttatgtcagggaaatctgccaatgctataaatcaaggcctttacttcttaacctcttctcactttgctcccctgtgggttgttaatttcttgtcagcacactattgaatgttaagtataatttgacaacacaaaagagaaatgtgaccatgtcaaagatgctggaaaagcatttgataaaattcagttgccattgcaaataaaatagggataggagaaaactttttaaacatcataaaaagtatttgaaactaacagtgaacattatattaaacagtgaaacacaggttacattctcattaaagtcaagagcaagacaggcttatttgttatgtgtttaccagatcctgtcagcataatgtcatcagtgtaatggacaggcattgtgcttgtgggatgtaaagatgtttgaggtcccttgagtctatattatgatagaaaacaagagagctaacattgccctgatgcatgggcagtaaacttaatactcttgttcctacttggtaaattcaaatgtattctgattttactaatgtatggaaatgaagaaaaaacattctctaggtcaatacttccatatcaggtgcctggggctgtgtaaatttgcttcaacagagatatgatatctggaattgcaattgttttttggcatcaccacctgattaaatttgtgatctgctgtcattttctgtgactcgcctggctttcgtagtgtccaaacagggtctctaaggagaatagtcactggtttgtgaggcacctatctcagttatagccactgaaaggcttttacacaaaagagggatgactgcttcagagactggggagtggttgcctcctcaggcaaaggaggttcaggggaatttggaggtttgcaattctcagcctcatccatgtctgcctaaatgcctccatctcaggcctcagagtttcactccttcccaccggtactcttaccacagcataatagatctggtggagttaagcatttaattgtcactgcagctctgcaacttatgctcagcccctaagtcgtatctgcctacaaccacaggatacggagtattcctcaaaagctctatgcatgcatcctgattttccatgtatgttcatcagtgttcttattttgtatatattcataacatttcatttctttttccatgtgtatgccctctagggctgtaagaagacagaccactctacaatcaggtaatgctacgtttgttgccacagtgactaaatgccactgtcatttaatctccccagtgtcttacttgccatctgcaactcatcccatagtatcactggtgataatctgagaaactataatactaacacatgtcatggattccctaactgctcattttcttccttggcaaatatgttatctctgtgtttcttgaatatattagcaacataaccttagaattgcattttgaaaatctgtttcctggggtttcttctagcaccaattactgtatgaaacaagggatccagcaaggaacagaaaacatggaaattaggataatttgtggaaggtttaataaagatactagttaggagggtgggaacagagtattaccatcctgtaaacccaaaataaaattctaatcccccctcctttcggcaaagggccttccaaagttaacctgaaaaacgttcaggccatgatgggaaagtggggatcaaatatgccttattatacccgcctcccttttggaattcagaaaaatctgaccagcattaacatcaacacagaccttcagactgatagaacagactctttaagtctgataagaaacatttacaatctattctctctgaagcctgctacctggaggcttcatctgcatgacagaaccttggtcttcacaaccccttatcttaaccccgatgttcctctctattgattctaagtctttacacaataacttaactctttcaaccaattgccaatcagaaaatctttgaatctacctacgacctggaagccccgcctcgcttccagttgtcctgcctttccaaactcaatgaatgtacatcttccatctattgatttcggtcttatgtctccctaaaatgcgtaaaaccaagttgtagccagaccaccttgagcacatgttctcaggatctcctgagggctgtgtcacaggccattggtctctcatatttggctcataataaatctcttcaagtattttacagggtttaactttttgtttgttgacaatccctaaacctgaaaggatcagaagagagaaacatcctgaaagagagaattggatagattattgtagtggctttaaaaaatgaccaccaattatttaacatttctcccattaaaaattagggtctatgtctcttccccttgaatctgggtggatatgcgatttgcttataaccaatagaatgtattgaaagtgaggactaaactctgatttttttttatcttgcccaaattcctatctaaggggtctggggagtcatgccctacaaatcataaattctcatcagatgggttttatttaaccttatatgtcatgatttactttccaaccttactctggcataacattatgagacaaggaagaaaatcaaaatattttaccccaaaacatgtttttttgccatattttgaaatggccctgcaaagctgttctttgtggagggaaatttgcaactgtaaagaatctctattaacatagctagatctttttctcccagcccctcccaatcctaaagagattaactaagatctgaatacaaaacatttgtcatctattgtctctaaggggagccactataagacttcaaaagaactttggtctccacaatgtttatcttaacctgaacattccctttctatcaatcccaggtcttcagacaaactcaaccaattgtcaaccagaaaatgtttaaattcacctatagcccggaagcccccaggttgagttgtcccgcctttctggaccaaatcagtgtatttcttaaatgtatttgattgatgtctcaagcctctctaaaatgtataaaaccaagctgtgccctgaccatcttgggcacatgttctcaggacctcctgagggctgtgtcatgggccatactcactcatatttggctcagaataaatctcttcaaatattttatagagttcaacactttttgtcaacaaaagtgatgctacataacttagaagactcggtcagaaaaggttatgtagtcttcaccttgttaactgtaacactcacacttggaggccctaaaatgacgtgtaagaagtccaactacaggccgggtgcctgtaatcccagcactttgggaggctgaggtgggcggatcacctgaggtcaggagttcaagaccagcctggtcaacatggcaaaaccctgtctctactaaaaatacaaaaattagctgggtgtggtggcatgagcccgtagtcccagctactcagcaggctgaggcaggagaatcacttgagcccgggaggcagaggttgcagtgagccgagatcacaccagtgcactccagcctgggcaacagagtgagactctgtcctccccccaccttcctaccccccctcaaaaagaagtccaactaccttgaaacatgctgtaaggaaggccaggcctcagggataatccatgtaaagttacatcagtcaacaaccccagattctgtcctagctgacagtcagtaccaaccaccagaaaagcaagagaaggaacttccagatgattccagcacccagctgttaaataatcctaactgaggctccagaaaccacccatccccactgtgtcccagtcttgatctacagaatctgtgagcaaaacataatggttattgttatgacagcaagttttgaagtggcttggtacacagcaatagtagctagtacaggtagaaaaagccactctgagggaaacagtgaccttaagtggggagatacagtgaactcctctgcaaggagaaagtcagaagaataaatatgccaatcttttgccagtgctccctgttggtgaaatccaaccaaaagctggaggacaaggtaacctgttgatgtattctatacaagctcacctcacagaacaagaagcagggtagagaagcaggaaaatggatctaaaggggcaaacaaaagttatcttgcttggggtcatttgaagactttgaactttattctaaagacaatgggaagacattgaaaagttttaggcaggcgactgatgattatcctgaaaatgatgtgcagcttttatcggagaacagattagaaacgggggaagactagttaggaatgtaatacaatagatcaagtgtgaggtgatgggaccctgggctgtggcaacagcggtataaatggaaacagaagaaagagatgtgagaggcattgcaaataaaggattgaccagatttgtgggcataaaaatgagggaagagtagacaataacgctgaggttttaagcctttaagggtcttgagctcacctctagagaattcatcaattcccaaagtttcacccatccttttatgtggaagtcatgaatcttcatctccatccatggttttgccccctaaacttgtctttcacctactgcctgctggacatttcaacctgattgtcctactataacctcaaacctaggatatccataagcaagctcacaatcatcaatccacacagtcctgaatcacatatttctatcaatacagcatctcttcatttctatcatctatgagccttgacactactacatttttgctgatatgtccgtaataactctattgctcataagtgaaaaattattttttggaattaagtttgtggaagctaagagtgtttgtccaatatctgaaatctgccaaaattctttaaagtattcaggcattccctttaaatgactaattacataccattaaggttccagtggaatttcctcgataagtctgccacttcttcccatcaagactatacatgatgataaactgagagatgtagaggctggagaacttctgacgggcaccctgggtcttgatgccgtgaataatcattggtgccaacagatccacctaccaattaaaataacactttattttaacctatttttaaatgtatgtgctacctcctgaaactaattattagcttaggaagaatctacattgctacaggtgtgtccatcattaccttaggtgtgcaagtgaagcagtcaccaatgttgaaatgtgcatgtgtgtgtgaagctgtgggatacacagtagaaatgaatggaaagatgcttattgagttcccagcctgcttcttgacaaaccaaaccactaccaaatcattgagcccccatttcgtacacacacacacacacacacacacacacacatacacacaaacacacacacaccttttgtggactcacataagctaatggacccacataagctaatgctttgcccacacctcagcctcagaccaaagccaatttcctcccctctcctgaaaccagacccaccccaacatcactgtcagtgatgaactgctacacctccttcaagtgttagttcagaaactatttttcctggttagccttctctgactcacccagacaaatttagtgctgcttcttctatgcttctacttcactttgtatataacttcattatagcaaattattgcaccatattataaggttgctttgcttttctgctttccttattagactgagatccttaaggcagtgaacccatttgagtcacctaactttctgtgtctcaacttatctgtaaagtgaagataatattagtttttatctcaaagggctgccataggggttaaagagttaatacatgtaatgtgctgagttcagggcctggcgcatactaaacactcaatcaatgttagcttttatattctctctagccccagcacctaatatggtatctggtataatactgctgtatagcaaatgctttggaatgaatgagtgaataatgggaaagtagtacagaatggacacttcttaaagaagaggtcatgggctgcaagaacattagaagtatcagttactgtcctaataagcaagtcaaatttagcacgttttcacacatgcctgacacacacaattggactggtcatcactcttatgcttaataactgtctccttcagctgactgtaagttccattcatacactcattcaaagaatattttttagcacttgctatgtgccaagcactgttttagatacagggaatagagtagtaaacaagaaagaaagccctgccctcatggaacttacagttgagtaggagaaatagaccttatatcatatatgtttttatttgtttatagcatcaagtagtgataagcgcaggagaaaaatgaagcagggtaacaggacagagtgtcaaggtcttcagaagttgcagccctgtcttttcccagatagatggtattcccaatcaaagacacttcattttaacctcttggtattgtggcataaaaaagtgaaagcaccaggcacaaaaatcatgatttctactgaattgacttttactgtttcttcatatagatagagtataagagttctttcttggaccagtgattattgtattttccagcagccttgctagaataaagctgcaatagaaccaggctacaataaagccttggcagcctacctacattctgcaactgacaaatgcttgacaactgatgaatgcttgacaaactgccaggcttatccacttcatcttcttgtgcctcttctacattataattggcacctgggagcagtttgacaattacagactcaacagcttcacctatgtgcccagccaggtgtttcagtgtaactacaagacacatctctctactaggaagtaagcaaggtggtaatgagtttcactgtataaaagtacaaacactgcagctgcgtatctccatggggcctgctgacttccccctgtgcattgcctggtcttggtcacctggtgctcctcaagccagcccagtgctcttgtgtcttggggccaggctgttgtgcactcttcaggccttctcacgagaatagatgccttctccaactcccttccttgtcagcaccccctttcaactccatctccatggtttattttataaagttacgagatctataaaaagtctagctggaccttagtaggacagatggcaaaaccaccttgaagataaggcgattcaatagtggtagatgataacataactaggtggatttgtaactggtttaattaccacaagtgaacagtgacagttaatagatggttatcaacttaaagggagcattccggaaacagtgtagtacaacgattaccagttagggttctggagcccaactatcagaatttgaattttggctcagtcacttattagccatgtgacttgggccacaataacctctctatgcttcaatttcattatctgaaatgaagatgatagtaacatctacctcacaaggttgtagtaaggacttaacagcttgatttgtattgtgcacatactaaggaagtcttgtctacttcaatattttgatcatgactttgctgcagtattagaaagtttactgatcaaatcagtaactggaaaaactaggaaatactttgggacactgaagatcggcaagctgaaacaatgggccaaatctagtaagtggaaacaacagagtatatcattcagggttcattggctaggcacagacaggacactctatttactagtcttatcaggttgtatctagtgaggaagatataattccgccctcccaaataagaatgttattacaaaaaattaaatagcacagacagacacagggtggccaaatagataaacatgttctctatatagggatacacttaaggttgaaaataaccatagaaatacaaggtgaagaacataacatgttgtttggcagaagcacaaaccaacaaaaaatacttagggattagtgaacagcagctcagattgagtcaaaattggcagtgtctacaaaacaatgctgtggcattaatagacatgctatttgcaaagatggaaaccaaaatgttttctccatttcctgtttgggcttctagaaggcatctagccttatgtttaggtggagaggctgagcaggcacttccaagctgccctcagcttttgtgaggcatggaagagacccaagagtttccatctgtctgtctttgaaggggcctcattgatcatatgttgaaatgatagtattttcagatatgttgagttaaataaaatgtattattaaagtgaatttcacatttttgaaaacgtggctacagaaaatgtaaaagtacacatgtggtttgcatttgtgaaccatttgttttatgttaaaataaaggggattggagtacttaaggacacgtgggcagttggaagcatctaataataacatatactgtcttgagagatgacgagttcaatattatagaaaatattcagatgttctaatcccagtagaaggactaaaatacagaaacaggacatatcaatatactcaattctatccccatatctctttgttcatgactgcttttgtacaaatcattaaggcattctgttctttagttttctcatattcatagaatcctttgagcttgcaagaggaataagtaatgcaattgattgaatgtgatacatttcccatcattgattacattttctaaccttgatccaagaaaagggctccttggtgctccaggcattgattgatccggaataatgaagtctggccagctttggggcccactgtcctttgcccaagtaaagaaacagagattaaattcagctgggttagtcctagacacttgagaataaaattattgtcttgagaaaggttaatctaagctgtggtgaaaatagagaaaaacataaaggctttatggcataccagtatcaattactatctaaggatattgcttatccttgttgtccattttattttctaaaatttataattttgttaattgttagcacctctaactagctgatactgcaatttgttaccaacactaccaaataataatattatttcttcttttctttctttttttgagatggagtcttgctttgtcacccaggctggagtgcaatggcatgatcttggctcactgcaacctccacctcctgagttcaagcaattctcctgcctcagtctcctaggtagctgggactacaatcgcgtaccaccatgcccgactaatttttgtatttttagtagagacggagtttcaccatgttggccaggctggtcttgaactcctgacctcaggtgatctgcttgcctcagccttgcaaagtgctgggaggcatgagccaacgtgccccgcctattatttattacgcaatgtatgttcattgtagaaaaatcagaaaatgaaaagtaaaaattagtaaaaatacaaataaaagacattttaaaatgtaacccttccacctagtgaaaaatgttactattttggtgtaaaactctcacgcctccttttcaagaggatttttttttacctcacaacaacataggttggcaaactttttctgtaaagggccagatagtaaatcatttaggctttgcatattatatggtctctgttgcaactatgttactgctgctgtagccatagatgatatgtaaattaatggacgtggctgtgttccaaaataaggctttattacggatgctgaaatttgaattttataatttcacatgtcatgaaatagtcttcatctttttgacaattatttaaaaatggaaaatctgttcatagctcacatgccatacaaaaacaggcagtgtgctgcatttagcctgtgggcagtagtgctctaaaacaatttctgagaattctctatagaccctagtcaaactttaccattactgctcataggaaagtatagcttcctgctgcactgaaaagaattgactcaaggaagaaatactgaaggtagggaggatatttaaggaggcagtgtcattgcccaggtaagaaatgatggtgacctgagttaagatggccacagtgggaagtggagaggaggagatgtatttgagaggcacttatggaatagaactaatagaagcatggagatggattcattatctgagattctccaccagattattaaaaaaagatataatcagcccaggttcttggagcaaaaataatagtatttaccatattgtcctgaagctgtaatctgaaaatctctaatgtgtccagaagccattcccaggggagtctgacactctgaaatgaaacgggtggaacacagtaactagaagtgcacaaaattcagcttctcaaatgtaagtcaatgaaaatgggagaacgtcaacaaatgctattttttagtgtttaaatgtgccaagaactgtactcaacgttttactgtattagttcatttaattaatcctaacaggtgctagaatgattcacattttacagctgaagaaactggggtccgtacataaatagaccagtggctctcttacttgtttagggttaaatctccaaactcttccaagtagtatttctaagttatctggtaactaaatcaacattaaattccaaaatctgctactggagatcttcgagctttaccaagttgtgaaaatgaggtggtattttttttttgtcaattatttagagcttcaggtacaaagtgttcaaagcttcaagtatatctgccctactctgagaactctgatgatttctaccagcaatattcattttaaatttgataatgatgtaaacttgtatttatttcctgacacaagcaaccattccagaaaggaagaaagctgtaaagaagtaggctgagtaggtagggaacctctgcccacattgctactcactattgctgtacaccagaaaaagtgtgctcatcccagcatgtagatgctcgccaataaggcattccacccgccaaattccagctttggatggtaacatttccactgtctcaaaaacaccttataaaaaccaacaggaacagaaattatttcttttcactaaaaaatgagcatgagatacattggtttatgcgaaatatcagagtagacctaccaaatttggtagttccactacttttggacccctcaaatgcaaagtgcttgctacgtgacccttacagttgggggttgtggagattgagttctgaccactcccctccccccaggagatgagaaacagggtgactgaattctttgatggttgggacaggagaatgctactgcattatgattgacctacattcccagggtctttctgagcaaaaggtgtgtttcccattggccagatgtggactctgtgaaacagataagtcagggtgagttccctctggatccagtccactagagctgcctacaagggtaaagttaccccagcaacaagaagctgcaggtgaacactgagggctgagaaatgagtcacaagtgaccacccagagtaaaggtggaagaaatcatgtcaaggggatttcatgacagtcacgtaagggagtctctaaagagttccctgaaagtgccctgcaggagaaagagtcaacaagtattgccaggcacaaacagtgttaagctagtttacaacaatggtgccagctgtaaataggtaagaactatcttatccccttacctttaacctatccatgttggagttcaaaacagcagctataaaggggttgtggggaagcacgatcatcacaaggtacagaaacagaggactcaaccatgtctcccttttccaatgcagacttccagcctgatgcaggctcaagttggaggaggggagattgaagttaaatcaagtttacaattttgattaatatcttgggatggacattgtaatttctgatttgaactgtatttgtgacataaagtgactttagtcctgtttattacttaagggtgagcagaaaagttacagggcttatcagaatttttacgaagaaataaggaaagtttacccccgctattaaactggatggttttttttttttagagacagggtcttgctctgttgtccaagtttgagtgcagtggcactttcatagctcactgcagcatcaacctcctgggctcaagcaatccttccacttcagccacccaagtaggtgaagtagctgggactacaggtatataccacatgtctggctaattattttttgtagagatgggggtcttgctttgtcacccaggctggtcttgaactcctggcctcaagcaatcctccaaccttggcctcccaaagtgctgggattacaagtgtgagccatcgcacctggccaaatctattttaaagggacagtgaagaaccaaaataaaattgtgttgtgatcaacattatgagtagtgcttaatcaatatactggttacatacataaacaaatgactctttggatgactactggtgccctatgggatttgagatggtaaatgataaaggaataaattccttttccctaggaaagtactgtgacattaattatccatttattctgttctatttcctttttagcaatttttctatatctgaaattatcttgttcatttgctttgaacaaatggtttaaaaagcatttgaaaaagtattacttaagagcatggagcttgtctgctttgatcactgattgtgttcccagtgcctagaccatttaaagtaagtactcaacaaatagagtaggtagaagaaagagcacaaacaagctcatacctggatagagattgtacagtgccattttatactcctctttttttcgtacagtgaacacatgtccactgaaatgaatagaatggatgttttcattgctgcccatgctgagcagataccatcgaatcctttgatcctgagccattactaagccaggtagtgtatccattatgtagccattgattgctggagaaggacacagagaagcctgttaaaatctattatataagtttctttctctccactccaccaaaaaaactgacatctatgaggattccactcccacagatatactctaaataaatacaatgttcaagtccctggatcaagtctcatttgtcaaagtgcaatctgcatttcacagtgataatgtttggatgtggaatatattaccatggaagcgataattctctttaaaagtgggatcttccatctggatattgcagggagccctgcagtttctttccatattttcagtgaagtaccagcttttggtctcatcaaagatggtgaaaaacagagcaaattcctgtactgtcacttgtctcccatgagcagggttcagtgtgttagtgtggcagaccagaaggggtccaatcaggcctgagtgcacatctttttcctagggagggaagacatcaatcctatgagtataagctctctcacctatgaaccagagtggatttctcatcaatttttatgccagtccaacctgcctcccaccttccaaaaatataatccatcctcttcagtagattccagaatgacatttctaaaacacaaatataatgatcaactctcctatttaaagcttcttattgcacgtaggataaatatcaaaattcttagtacacaaagaccatttcttttaaaccaaaaagtggtcagcacaatagacacctgcttaccaggtcaacatcagagaaataagcccaggctttgcagtcaaactcatctttagtgggtgccatatgatgttgcactttccaaaagtaagttttggtttcattaggcttgacaaagttttttctaggttctgctccttgcctctgatcttcctcataagaaataaggctagaatagaaggaatagggacgagaggcctgatttctgaaagttacctgtagaacaataacgacaaaaaaaaaaaagcaagaataatcttctaggatcttaaggtccttagggtttacatccctaaaagaaatacctgtcttttggtctttatcaaagtttttaataccctggaagaagtggtacagaagatggatgctgttagaactcaaacctaatcctgaggaggttttgtattctaaatttaaggtatgaactcaaagttgcaaaggagaaaattcctaaacacataaaagccattccagagtaaaagggaaaatgttactgcaggggttataagagaccataacgccaggagttgatatgtaagttaaggttcttcatgacaaattctagaatgaatgcatattatcttttaaaaaaggcttactttccagattaaaaattatacatatttatcatagaatataatggaaagtaaaataaaatgtaaggcaaaaattgcccacaattccataattttagatccttctacatccttaatatacaccatcaattaattgaaacaacgaatagatattttcagaaaaaaataaaactactttgatctttggttcacacaatgcaccaaaataacttttagtctacaggaagtattaaaaagttaaatgtaaaaaattaaactgtaagagaaaaactgaggaaagtataggtgttttttaaaaaatctctggataggcaggaatttttataaacataaaagcaatgaaagtgtcaaaaagtaaagattgatgggttactacctaaaaattaaaacctgttttatttcaaaaaccatcatttataaaattaagagaaaacaaaaacttgaaaaagtacctctcattaaaatgttcagtggtttactatctaatatataaggtaacataatcaataagaaaagcacttcctccatgaaagacaaatgtgcaagggacattaccaaataattaataagaaaaactcttaagatgctcaaatacattgcacttctggaattttatcttagaaaaactgttgtgattacagcgttatttatatagtgaaaaaagaaactgtctaaaagcttgttcaaaataaatggttacataaactatggttccataaattcatataatagactattatgcagtattttaaaaacatacataggaagtgtttttaatgacgtaagaaatgtttatgatgtgatatttagtaaaaaaacaagaatcagaattctgcatggtataatttgaatacataaggagaaaaatacataggaaaaatagaacgtacacaaagataattatggaattatttttctatactttaaaaatttccaaaagtgggaatacattatagtcagcaagaaaataaatatataaaattaattttcttgtaattccactgtccttaactcaccatgatattatcttcaacttctgctcttatatatggccccaggagtcccaaatgttcatttagttctccacggtataagggctgagtaaaggagccatcagtaaattcctggaaaacaactttcttgaactgagggacactgccactctgagccctggagaaaaaaagcagaggaaaagcaataattttatgtaccaagtgggtagaaatgcctcacatcctcattttcctaggtgcctgagaagcattttgcatagttaaccacttcatcttccttgaaatactcttgccaagctttattagcatgtaagttccatgaaagctggggttttgtctgttttgttccctgttgtattcccagcacctgtaacggtgcttggcacaaagtaggtgctcaaaaaatatttgtcgaatgttgaatgaatgtaaagtttataaacatactccaaatataagagagtcccatggtcaagcccttggatctcttttctttttactttttaaagccctattaaaattgtgaactaaaaaaattgtgaactaaaacatatacaataaagtgcataaaacacaaatgcctttggtacataaatgcaatcatcacccagatcagtaacattgccaacaacccacaagactcactggatgtcccttttcaatcatactttctcccttcccactgaaggtaaccaccattctgatctttatgataatcatttctttgcttttctttataattttaccagttacgtatacatcctttaaaaatatagtttagttttgcctgttttgaagtgtgtaaataaaacatactacatatattcttttgtttcttctttcacttagcattctggttgtgagattcatctatattatcatatgtagctatagtttgttcattcccattgttgtatagtattatatgaatataccctaatcacggacatttgagttgttataatctttggcactttcatatggacctgctataaccttctggtgcatatcttttggtgaacatatatgtgcatttctgttgggcggaattactaggtatgcatgtgtttggctttggtaggtattgccacactgttttccaaagcagctggaccattttccattttcattagcaatgtatgagagttccatttgctccaaattattacaaatatctggtattgactgtgtttttacatttttggatgttctatgaggttgagcatcttttcttatgagtagcagtcatttggatgtcctcttttgtggagcacctatccaagcttttttctgccaagttttctcttggataatctgcttttttcttgttgaatcaaaagagtaccctatatatccttgatatgcttttttatatattccttgattgctggagaagaaggacacagagaagcctgttaaaatctattatataagtttcctttgtgtgtcctttgtgttatgtattgcaaacatttaccattccgtggctaatcttttcattgtttttatgttatcttttgatgagcataagtttgtaattttaatgtgtggaatttataaaaaaaaaccttattggctagggctttttgtatcttgatgtcaattctctttctttccctaccctgtggttattgatatattcttttacattttctttctaaaatgtttatgattttatatttcacttttagacttgtaatgcaatgtgaatggatttttgtgtatggtgtgagttaggaatccaatgtaatgttttatctatatagataccaacattttccagcattttattgaaactctacttctgtgacacctttgtcataaatcaagtttctatatgtgttagactagttttggattttctattctatttcatttacctgtttgattatccctataccaactgctacattgttttaattattatagctttaaaataagtctcaatatattagacagcaattactctcatcttattcttcctcttcaagaaggacttggctattcataaacctttacattttcatattaattttagaatcagcttgttgagctctacaaaaggaacgtcttgggattttcattcaggttgcactgaatctataaatcagtttgggaataaccgacattttcaaatatcatgttttccaattcatgtacgtggtatatcttgaaagttatttaggtactctttaaagtttctcagtaaatttccatagtttttttttccatagacattttgcaaatttttagctagacttatttctaggtacttgttagtattctattccactatttattttgtttttacttcctcattgtgtctcaccaagctgacacactcaaacttaactttccccctggtcaggactctcctagaaagtggctctcttggcttatgaccattctcaagggagagacctcaagactaaattagaaagaaaccatagcaataaaaatcacaatgggggtcatcttccagcttctaaccagaaggaaatcaaccaccttcagctcagcaaacctgcaagcaatgtgagctgtgtgacaatccaacagaggtggagagccagcactgatttgggctggatggttcaggaagccagctgcttccgttggcgagtcattttcgctgtcacaagccatattgccatgataaacatctttgacagacacattcttgacactgaagcccacattgtccccaagaagagcttcatttaaagcttcatggtgcaattcaaaagactttatttcagttgtaatgttaactggagcaaagctgaccaatcatgctgggtttgagggcaccagtcaccactaggcccacaaagacattaccaatactaccaattttgtagacttcctggagaggtaggcacaagccttgtcagttggatgagctggtggtatgatataatccagagcttcaagcggtgtgctacactggtattgccatctctgcaggtgactctccaccctttaaccaaggcatgttagcaagttgtcagcattccaaccagaaattggcataaatactactgtgttgcggttgtagccagtattcttaatgtagggctgacttccttattgatttccacatagctctgttggcgatggcatagttcagtgaaatccattttttaacaccaacaattagttgtttcacttccagtgtgtaaaccagaagggcatgctcatgggtctgcccgttcttaaagatactagcttcaaatttgttaacaccactagcaataatcaggacagtacagtcaacctgagaggtgcctatcatgatgtatttttaaattgatacacgataattgtacatgttttggggatacatgtgatattttgatacatgaatacaatgtgtaataatcaaatgatggtaattggaatatcaatcacttcaaccatttgtcatttatttgtgttgggaacattcccagtcttctcttctagctattttgaaacatacaataaatcattgttaactatagtcaccctactgtaatatcgaacactacaacttatcccttctatttaagtgtaattttactgtggggaaaagaaagagagatcagactgttactgtgtctatgtagaaagaagtagacataagagactccattttggtctgtactaagaaaaattcttctgccttgagatgctgttaatctgtaaccctagccccaaccctgtgctcgcagagacatgtgcggtgttgagtcaaggtttaatggatttagggctatgcaggatgtgctttgttaaaaaagtgcttgaaggcagtatgcttgtccatggaatactatgcagccataaaaaaggatgagttcatgtcctttgcagggacatggatgaatctggaaaccatcattctcagcaaactatcacaaggacaaaaaaccaaacaccgcatgttcttagtcataggtgggaattgaacaatgagaacacttggacacaggagggggaacatcacacaccggggcctgtcatggggtggggggagggatagcattgggagatatacctaatgtaaatgacgagttagtgggtgcagcacaccaacatggtgcatgtatacacgtgtaacaaacctgcacgttgtgcacatgtaccctagaacttaaagtataataataataataaaaaaagtcatcaccattctctaatctcaagtacccagggacacaatacactgcggaaggccgcagggacctctgccctggaaagccaggtattgtccaaggtttctccccatgtgatagcctgagatatggcctcgtgggaagggaaagacctgaccgtcccccagcccgacacccgtaaagggtctgtgctgaggaggattagtgaaagaggaagtcctctttgcagttgagataagaggaaggcatctgtctcctgctcgtccctgggcaatggagtgtctcggtgtaaaacccgattgtatgttctatttactgagaaaagagaaaaccgccttaaggctggaggtgagacaggctagtggcaatactgctctttaatgcaccaagatgtttgtatacgtgcacatcagggcacagcacatttccttaaacttatttatgacacagagacctttgttcacatgttttcctgctgaccctctctccactattaccctattgttctgccacatccccctctccgagatggtagagataatgatcaataaatactgagggaactgagagaccagtgccggcgcgggtcctccgtatgctgagcgccggtcccctgggcccacttttctttcctgtgctttgtctctgtgtcttatttcttttctcagtctctcgtcccacctgacgagaaacacccacagtgtttctcgtcactgtgggtgacgaggggcaggccaccccttcattttacacctattaatcaacctctcttcattccatcccacccccccataccattcccaaactcctttaagcaccattctactctctatctccgtgagatccactttttaagctctcacatgtaagtgaaaacgtgatatttgtctttctatgcctggcttatttcacttaacacagtgacatccaggctcatcgatgttgccacaaatgacaggatttcattctttttaatggctgagtaatagtctattgtgtatatataccacacagtctttatccattcatctgttgatgtatacttaggttgattttatatcctagctattgtgaatggtgctgtaataaatgttggtgtgcaactatctctttgatacactgatttcctgtctttggatatatatccagcagtgggattgctggatcacatggtcgttctatttttagtttcttgaggaacatacatactcttttccatagtatctgtactaattcacactcccaccaatagtgtacaagcattccccttttgccacatcctcatcagcattcattattttttgtctttttgataaaagtcatttaactggagtgaaatatccattgtgcttttggtttgcatttatctggtaattagtgatgttgagcagtttttcatatacctgttggccatttgtatgttttcttttgagaaatgtttattcagatctttgttcatttttaataggatcctttgcttttttgccattgacttgtttgagttccttatatattctggttattaataccctctcagttgtatagtttgcaaatatttcatcccatcctgtaggttgtcccttcactttgttaattgattcctttgttgtgcggaagctttatagcttgatataatcccgtttgtctacttttgctttagttgtctgtgcttttgatatttcccaggccataaaatatttcccagaccaatgtcctggagcatttccccaatgttttcttccagtagcttcatactttcaggttgtatatttaagtctctaatccattttgatttaatttttgtatacagtgagagataggggtttagtttaattcttctgcatgtggatatccagttttcccaacatcatttattgaagagactattctttcaccaatgcatattcttggcactttgtcaaaaatgagttggctctaaatgtgtggattcatttctgggttctctgttgtgttccactggcatatgtttctgtctttatgccagtaccatgctgttttggttactacagctttgtagtatagtttgaaataaagtagcatcatgcctccagctttgttctctttgctcaggactgctttggatatttagggtctgtattagtctgttttcctgctggtataaagaactgcctgagactgcataatttataaaggaaagaggtttaattgacttacagttccacatggctggagaggcctcaggaaacttacaatcatggtggaaggtgaaggggaagcaaggcacctttttcacaaggtggcaggagggagaggtgacagaaggggaaatgccagatgcttataaaaccatcagatctcatgaaaacttactcactgtcatgagaacagcatgggggaacctgcccccatgatccaatcacttcctactgggtccctcccatgacacatggggattattttgccttacatgaaatgtaaggcaaaaattgcccttgcccacaattccataattttagatcctcctagatccttaatataaacaatcaattaattgaaaaaatgaatagatgttttcagaaaaaaataaaactactttgatctttggttcacacaatgcaccaaaataacttttagtctacaggaagtattaaaaagttaaatgtaaaaaattaaattgtaagagaaaattgaagaaagtattgtttttttttaaaaaatctctggataggcaggaatttttacaaacaatatactacaattcaagatgagatttgggtggggacacagagccaaaccatatgtttccacccatggcccctcccaaatctcatgtcctcacatttaaaaacagaatcatgcctttccaacagtcccccaaagtgttagctcattccagccttaacccaaaagtccaagtccaaagtctcatctgagacaaggaaaatcccttctgtttatgagcctgtaaaatcaaaagcaagttagttccttcctagatacaataggggtacaggcattgggtaaatacactcattccaaatgggagaaattggccaaaacaaaggggctacaggccccatgcaagtctgaaatccaatagggcagtcattaaacctgaaagttccaaaatgttctcctttgactccgtgtctcacatttaggtcaccctgatacaaaaggcaggctcccacagccttgggaagctccacccccatagctttgcagggtacagccctgctcctggctgctttcatgggctggcattgagtgcctgtggcttttccaggcccacggtgcaagctctcagtggatctaccattctggggtctggaggacagtggccctcttctcacagctccactaggcagtgccccagtggtgactgtgtgggggctcccaccccacatttcttttcctcactgccctagcagaggttctccacgagggctctgcctctgcagcacacctccgcctggacatccaggcatttccatacatcctctgaaatctaggtggacattcccaaacctcaatttttgtcttctgtgcacccacagaacaaaggctgggggcttgcaccctctgaagctatagcccaagctgtactttggcctcttatagctggagtggctgggacacagggcaccaagtcccaggctgaacactgcaggggagccctggacccaggccacgaaagcatttttccctcctaggcctccaggcctgtgatgggaggggctgctgcgaaggtctctaacatgccctggacacattttccccattatcttggtgattaacatttggctccttgttaattatataaatttctgtagctgggttgaatttctccccagaaaatgggtttgtcttttctactgcatcatcaggctgcaaacttttcaaacttttatgctctgtcactctggaatgctttgttgcttagaaatttcttctgccagataccccaaatcatctctctcaagttcaaagttccacagatctctagggcaggggcaaaatgctgccaatctctttgctaaagcatagcaagagccacctttattcctattcctaacaagttcgtcatctccatctgataccacctcagtctgaacttcattgtccatatcactatcagcattttggtgaaagctattcaatgattctctaggaagttccaaactttcccagattttcctgtcttcttctgagccctccaggtctctaggaagttccaaacattgccacattttcctgtcttcttctgagccctccaaactgttccatcctctgcctgttacacagttccaaagttgcttccacattttcaggtatccttatagcagtgccccccctacctcggtaccaatttactgtattagtctgttctcatactgctataaagaactgctggagactgggtaatctataaaggaaagaggtataattgactcacagttccgcattgctggggaggtctcaggaaacttgcaatcatggtggaaggcgtaggggaagcaaggcatcttcttcacaaggtggcagtgggaataagtgccagcaggggaaatgccaaacacttagaaaaccatcagatttcatgagaactcactcactatcacgagaacagcatgggggaaaactgcccccatgacccaatcacttcccactgggtccctcccacgacatgtggggattatgggaactacaattcaagatgagatttgggtggggacacagccaaaccatatctgggtcttttgtggttctgtacaaattttaagactgctttttctatttctgtgaaaaatgttattggtattttgataggtaatacatgaaatctagtagtattgatattttaacaatatgaattcttccattctatgaacatgggatagataccttttcattttttgtgtgtcttcttcaattcctttcatcagggttttacagttgtcagtatagagatctttcacctctttggttaaatttgttcctagatatttatttttattatagctattgaaaatgaaaatgcttttatgatttctctctcggattgttagctcttggtatatagaaatgctactgatttttgtatgttggttttgcttcttgcaactctactgaatttgttgatcagttctaacagttttttggtggagtgtttaggtttttctaaatataacattatatcgtctacaaacaaggggaatttgatttctttttttctaatttgaaggccctttgcttaattgctccatcttggacttccaggactgcatttaatagaattgatgaaagtgggcatgcttgtcttgttccagatcttagaggaaaggctttcaattttttcccatttggtgtaatgttagctgtgggcttgtcatatataacatttactgttttgaggtatgctcctttaaaccaaatttgttgagagtttttatcatgaagggatgttgaattttattcaatgctttcttgacatttattgaaataaatatatggtttttgtctttccttctgttaatgtggtgtatcacatttattgatttccatatgttgaactatctttgtgttcctaggatgaatcccccttgggcatgacaaatactcattttaatgtgttgttgaatttagtttgctagtactttgttgaggatttttgcatctatattcatcagcgaagttggcctgtagttttctttttgctgttgttgtgtctttgtctggtttgggtattgggataatgctggtcttgtagaatgagtttggaaacattcttttctcttcaattttttgcaatattaaatagtttcagtataattggtgtaagtttttcttcagcagtgaagtcatcaggtcctggacttttatttaatgccagactttttactactgcttcaatctcattactagttattggtctgctcaagttttctatttcctcatagttcaatcttggtaagttgtatgtgtccagaaatttatccatttcttctagtttttccagtttgttggcatatagttgatcataatagtttctagtgaaactttgtatttttgtgttatcagttttaatgactcttttcatctttgatttcaattatttgggtcttctctcattttttttccttagtctagctaaagattttaaattttatctttcaaaaagccattttaaaaatttcattggtctttcatattgttttctttttctcaatattatttatttctatgattattattattattttccttctactaattttgggtttggtttgctcttgtttttctatgtccttgagttacatcattaccaggtttatttgagtctttcttttttgatgtaggcatttatagctataaacttctctcttagtaccgcttttgttgtatcccattcattttggtatgttgtttccattttcatttgtttcaataaatttccttcttaatttcttcattgacttattggttgttcaggagcatgttgtttaatttccatgtatttgtatagtttcaaacgttcctcttgtcattgatttctagttttattctactgtagtcagaaaagatacttaatataattttatttttttaaatgttgagacttgttttctggcctaatatatagtctatcctggagaatgttccatgtgctgataagaagaatgtatattctgtagtagttggataaaatgttctgtaaaatgtcaggtaggttcatctggtccagagtatattcccggatgaactggagctcctttatatgttatttgcttcttttttcttgctctttttaggatcccctctttgtctttgacctttgagagtttaattattgtatgccttggggtagtcttatttgggttgaatctgtttggtgatcttcagccttcctataactggatacttacatctctctgtaggtttggaaatattttctgttatttctttgagctttttattcattgctctttctctcttgaaggcccatgactcttagatttgttctactgaggcagtcctctagatcttgcaagtgttcttcattccttttaattattttttgtcctttgactgtgtattttcaaatagcctgtctttgagctcattgattgttcgttttgcttgatcagttccgctgtttagactttccagtgcattttttttttccgttcagttgtatttctcagctccagcatttctggttttttaaattattattttgatttctctgttaaatttatctcataaatttctcagttgcttttttgtgttctttgagtttcctcagaacttttattttgaattattgatttgagagctacaatttgccatctcattagggttggtcactggctccatgctgtttccatttggagaggtcatagctccctatttgctcttgttttttatgcacatatatctatgtctttgtatgaatgctaagttatttattccagtctttgtgtctggcttagtttggtttttcaggagtatgcctgtctaaaggttatgtatgaattagagcttccttactctgagattactgcctcttttttggcactagatggtgctgtaagcccagatttgctgcagctcttgcaacggcttggattactgcctattcccgatttgggggaggtcccaaactggatatcctggttgggtgagacatctggttaggattttgtgtccagaggaaccacgggctgaacattctctctcatttggtgtcttctttggcttagatgaagagcagccaatgtgttttgcatgctggggttgctagccccgcctccatcctttgtctctagctgccctcaggatttttttaccctagaggcaatcaggctgcttcccacggattgaggcaggaatgatttttctgcaaaggaacccaagatggtgggaaagctggctcttcatctagatgtcactttttctgatgtacatactgtcagtctgggggaacttttctgcatggtgcctggcagcttgggaaggggatgctgcagttaaacaggcccatttttgttatcttctgcttgcagtttttctcttctatgtggccactcagatcctcacagcctctgttttgagttatgggatattcctggtgataagctagacactgaatagttgtttttggtttttctggaggagagtgaagccagattgcttctatccaccattttggtgatatcactctaatcatgtttttttttttttttttttttttaataaagcccctgtgtgctggggcatcaatgatggtcacaggatatttttggcctcaggtttctttaggagatatcaatggtgatattccattcatgttcagtttatagttatccaagacccaagcatactcaaatgagccctttcccatctcagcaggttctttctcaaatttttcaatggttcctttgttgatcacatcacatttatagatcagatgaccagtagtgttgaactttcctgagtctacatgtccaacgttgatgatagtgacatgaaccttttcctttcccaattttggcttagatttagcagtgattttcatgatacttgtgttatgacagcaaaccaactgtgaataaagcaattctatatatcttaacgctcataaaacatttgaccatgttttatgatacttatctctatttatccacatatttaactttgtttgctctttatcccatcttgtctctcatgccttccattctgtatcacttttttattgtctcaagtataacattagaatattttagtggacttttgctaatggtgaagtttctctgtttatgcttgtctgaaaatgtatttctttcaccttcattcttcaataaaatattttttagattttcatttttattattatgttagagcaagtgaagtagcagcaaaagtgtccatcatacaatctggctttccctggtcctcagggcaaggaggaaacttgggcagcagacaatcactcaatcctggcagactctcagaatctcacttggaccctaaagtgcatctgcttggtggcattgttcttcatttctgtcttcagcatccattttgacttcatcctttggatataatgcatgtctcactttcatgtaacagctgctcctgtgttgccagtctatcccagggctctctattactgaagcactcggcccatggcctcacaatatttagcaactaccacagctcttgacaagccaaatcactgtttgtagtatctcatcaaggagtgatgacccactctggcatcagaaggcagaatcagttccatgctttcatcatcatattctaagtcctttcctaagggcgactcctcagcctcattagggtcctccccttccttgtgatctgggtagctactcctaaactcatacaagtctgcaaattccaaagcagcatcaccatctgtaaaaagcttacaccagcttttgtcatatgtgcctgtacagcttctgttgagtagaacttccccttctcattgcaacacaagcaaatcttctcaacacaaactttctctcccaagtaattaatcagtcccttaagatctgaaagatattctatatcagtaataaagaagcagtggactttggtcatacttgtgtcattttgttaattgctttctttctttttttttttttagatcctttgatcctttcttcttctgttgcattcttcctttatagtttgatggctttctgtagtggtatgctttggacctttttaaaatgttttgtgtatctactataggcttttgctctgtggttactatgaggcttacacaaaattagcaggctattttaaactgataacaacttaatttttattgcatccacaaactctacacttttattcccttcctcctacatattattattttttttgagacagggtcttgctctgttgcccaggctggagtgtagtggtgtgatcattgcttactgtagccttgacccccccaggctcaagcagtcctcccacctccacctcctgagtagctgggactacaggcatgcaccaccatgctttactaatttttaaattttttatagagatgagatctcactatcctgcccaagttagtctcaaatgcctgggctcaagtgatcctcccaccttggcccccacaaagtgttgggattacagccatgagccactgtgcccagcctattttatgtttttgatgtgacagtttacatattttaataatttgcattccttaacacattattatagctttagtttttaaaatagctttctttgtcttttatcttttatactaaagatataattaatttacccactgccattacactactagagtgttttggatttgacaatgtacttatttttactagtgagttttatcctttcatatgttttcatattactaataagcatcctctttcttcagcttgaagaactcctactagcatttcttataaagcagatctagcttttgtctttctgagaaaatctttatcaccccttcatttctgaaagataaaattactggatatagtatttttcattgctagtttttatttcctttcaggattttaaatctatattttcactcccttctggtctacaatatttcttctgagaaatccactaataatcttatacaaaggatatgaacagacacttctcaaaagaagacatttatgcagccaaaagacacatgaaaatatgctcatcatcactggccatcagagaaatgcaaatcaaaaccacagtgagataccatctcacaccagttagaatggcgatcattaaaaagtcaggaaacaacacgtgctggagaggatgtggagaaataggaacacttttacactgttggtgggactgtaaactagttcaaccattgtggaagtcagtgtggcaattcctcagggatctagaactagaaatgccatttgacccagccatcccattactgggtatatacccaaaggactataaatcatgctgctataaagacacatgcacacgtatatttattgcggcactattcacaatagcaaagacttggaaccaacccaaatgtccatcaatgatagactggattaagaaaatgtggcacatatacaccatggaatactatgcagccctaaaaaaggatgagttcatgtcctttgtagggacatggatgaagctggaaaccatcattctcagcaaactatcgcaaggacaaaaaaccaaacactgtatgttctcactcataggtgggaattgaacaatgagaacacttggacacaggtaggggaacatcacacaccggggcctgttggggggtggggggaagagggagggatagcattaggagatatacctaatgtaaatgatgagttaatgggcgcagcacaccaacatggcacatgtatacatatgtaacaaacctgcaggttgtgcacacgtaccctagaacttaaagtataataaaaagaaacaaaaacaaaacaaaacaaacaaacaaaaagaaatgttctttacatcctctctcctcattcttcccatactcaattaacagccagtcttatatgcttatctttaattatacccaacatccttccatttctttccatttctgtcaccaccacactggtctaaataactgtcttcttttatctgtatgactgcaatagcatcttaactggtatctctgcctccactcttgcccatggatgctgtgtgacacgattccatataatcagtctttcctagagtcctagagtttggatataaatgggagacctgcttttgtctccctacatttatcattttctaattcattcaacatacatttatttgaacatctgccacgtgccaggcactgttcaaagttctggggacacaacattgaacaatacctccaaagtttgtgttcttaatgagcttaacttatagtcagagaagatagacaataaagaaataaatatataatatttcaggcactgttaagtgcattgaaaaaaaatggtgggagcaatatttacatacagtgttcagggaaagcctcactgataaaatgaaatttgagcagcgtcctgaaggaagtaagagaacttgcattagagtatcagggacataattttaagtagagagaacagaaactgtaatggtctagagataggcacacatctagtccatttgagaagaacaaggaggtcagtgtggctgaggcaggattaacaggagacaatggtaacagatgaaggcagagaggttgcagagggtcaaatttcgtagggtcttgaaggccatggtgaaggctttggaatttactgagtgagatgaaaatccactggaggatctgaagcagagaacagtgatcagaattgcaatttgaaaaattactttagatgcaatgttgggaaaagactatatgagggtaaggttggaaacaggaaggctttgtatcaactctcatctgaattattgcaatggcttcttgcaataattcagatgagaaatgatgataatttagatgtggttggtagtcactgaggtgtagagaagaggctggggtgtgtgtgtgtgatttatagacttgattttattattttaatacccttttattattacagaagcagtgcatatgcagtgcagataatttgaaaatatagccaaataacattcaaaaaataaaaacatcacttttatagcatctgaagtgacactgtatcctctcttggcttgtaacctgctttccctggtcaattatcttcatcgttccatttcagtacattttcatcttattcaatactaagtccataatcaaccctgactattttttgaaatgatagccaagaggatccccacccaaatctcatcgtgaattcccatgtgttgtgggagggacctggtgggaggtaattgaatcatgggggcagatctttcctatgctgttcttgtgatagtgaataagtctcatgagaactgatggttttaaaaagaagagtttttggctgggcatggtggctcacacctgtaatcccagtgctttgggaggccaaggcgggcggatcataaggtcaggagttagagaccagtctggccaatatggtgaaaccccatctctactaaaaatactgtggacttttgagttaatgctgaaatgagttatgactttgggggactgttgggaaggcatgattggttttgaaatgtgaggacatgagatttgggaggggacagggggaatgatatggtttggctgtgtccctaccaaaatctcatctcatgtggtggcacatgcctgtagtaccagctacttggaaggctgaggcaggagaatcacttgaacccgggaggtggaggttgcagtgagccaagatcacgccactgactccagcctgcgtgacagagcaagactctgtctaaaaagaagaaaagaaaaaaaagagttttcctgcacaagctttctttctttgcctgctgccatccatgtaagacaagacttgctcctccttgccttctgccatgattttgaggcctccccagccatgtggaacagtaagtccataaaacctctttcctttgtaaatttcccagtctcaggtatatctttatcagcagtgtgagaacagactaatacagtaagttggtaccagtagagtggggtgctgctgaaaagatacccaaaaatgtggaagcgactttggaactgggtaacaggcagaggttggaacagtttggagggctcagaagacgacaggaaaatgtggaaagtttggaactctctagagacttgttgaatggctttgaccaaaaggctgataatgatatggacaatgaaatccaggctgaggtggtctcagatagagatgaggaacttgttgggaactggagcaaaggtaactcttgttatgttttagcaaagatactggtggcattttgctcctgtcctagagatttgtggaacttcgaatttgaaagagatgatttagggtatctaccattctggggcctggaggacggtggtcctcttctcacagctccactaggtggtaccccagcagggactctgtgtgtgtgctctgagcccacatttcccttctgcactgccctagcagaggttctccatgagggcccacccccgcagcaaacttctgcctaggcatccaggtgttttcatacatcttctgaaatctaggcggaagttcccaaaccccagttcttgacttctgtgcactcgcaggctcaacatcatgtggaagctgccaaggcttgggacttgtaccctatgaagccacagcctgagctctacattgacccctttcagccatggctgtagcggctgggacacaaggcaccgactccctaggctgcacacagcatggggatcctgggcccagcccatgaaacaactttttcctcttaggcctctgggccggtgatgggaggggctggtgtgaagacctctgacatgccctggagacattttccccattgtcttggggattaacattcggctcctcattacttatgcaaatttctgcagcctgcttgaatttctcctcagaaaatgggatttgcttttctctaacattatcaggctgcaaattttccaaacttttatgctctgcttcccttatgaaactgaatgcccttaatagcacccaagtcgcctcttgaatgctttgttgtttagaaattaatggaagtgcctggatgcccaggcagaagtttgctgcgggggtgggccttcatgtagaaactctgctagggcagtgcagaagggaaatgtgggctcagggcacccacacagagtccctactggggtaccacctagtggagctgtgagaagagggccaccgtcctccagaccccggaatggtagatccatcagaaacttgcaccagcatctggaaaagctacagaaaatgccagcccatgaaggcagacacaagggaggctgtaccctgcaaagccacaggggtggagctgcccaagaccatgggcacccacctcttgcatcagcatgactcagatgcaagacatggagtcaaaggagatcactttagagatttaagatttgactgccccgtagaatttcagacttgcatggggcctgtaggccctttgttttggccaatttctcccatttggaatggctgtatttacccaatgcctataccccattgtatctaggaagtaactaacttgcttttgactttacatgctcataggtggaagggacttgccttgtcttagatgagacattggactgtggacttttgagttaatgctgaaatgtgttatgactttgggggactgttgggaaggcatgattggttttgaaatgtgaggacacgagatttgggaggggatggggtggaatgatatggtttggctgtgtccctacccaaatctcatcttgaattcccatgttctgtgggagggacctgataggaggtaactgaatcatggcagtaggtccttcccttgctgttctcatgatagtgaataagtctcacaagatctgatggttttaaaaagaggagtttccctgcacaagctctctctctttgcctgtgccatccatgtgagatataacttgctcctccctgccttctgccatgattgtgaggcctccccagccatgtggaactgtgagtccattaaacttctttcttttgtaaattgcccagtctcaggtatgtctttattagcagtgtgaaaatggactaatacaggatcctttacagattagatgttaatgtaagaaaaaaagagttggaaaacttcaagatctgtgactgaataactgaaatagggaatggttttacttatttatttttttgagatcaagtctgactctgttgcccaggctggagtgcagtgaggccatctcagctcactgcaacctccgtctccccagttcaagcgattctcgtgcctcagcctcctgagtagctgggactgcaggtgtgcaccaccacgcctggctaatttttgtatttttaatagagatgaggttttgccatgttgcccaggctgatcttgaactctggggctcaaccaatccacctgcctcagcttccccaagtgctggggttacaggagtgagccaccatgcccggccaggaatggtttttgattgccatggagaaggctgagcaatcagcaggttttgggaaggggcaggaattaagagtctaattgtgtgcatgttaaggtagggagttgatatgtaaattttgacttcaggagagagatctgagaatatctccagatattcaactggaattatctgcagatagatagtacttaaaatcatgaggctaaacaatgtcgtcacagagtgagtataaatagaataaagaagaagttggagaactaatccctggagcactctaacctttaaagattagggggatgaagaaggactcgcaaagttgacaaagattggcagtaagtttagtagaaaagtgaagaaaagtggtgttagagaaaccaagtgagaacctgtatcaacgatggagtaatcacctctcaaatactactgagaattcaaataagatgagggctagtaatcagtaatgtaaagatcaataatgaccttgaaaatgtagttcttatgaaataatagagataaaagcttctttggagtgggttaaagaggagagaatggcaggaaaagatgcaaaggctgcaagcagggacaattattttaagacggtttctgtaaagataggggaggaaataatagcatgattgatgttgatgagattaatctagtggagagataaattgatgatgtaagggagaaaaggagaaattgctggagcaacattttttatgaagggagaagagatgggaatcaagtacaaaactggagaggttggccttaggagcacagacactctatttattgtaataagtgtgcaggcagagtatatgggtacaaatgccagtaaatgtgatgttgggagtctgtggaggttcattgcacagcatcagctaagagtgaaaatgggcattggagaatggaaaaaaggtgctcgagatttaaggaaaacacagaaaatctaagatagaggtccaggagaatgagaaagtcagtggactagggaaatagtctatggttgcaatgcagcaataagggcttacttgagctagaaagcaaggtgggaaagtgacaagtcatgcttgtcccttcttgttcctcaaacatggtaaactttttccattctcagggcctttgcattttctcttccctctgtctggaaacatcttctctcagagctccatcagctggcctgttatcatcatttaggtctcaactcctcaaagatgatttctatgaccaccacagctaatgtaacactctaccgtattactctatcatattattctctctaccatattattctattctatcttctgaacaacacaattgagattgccttatttagttttgtactaacttgtctcttgctctttccaatagaatataagctcctgctgtgctgcactccaatgtgtacaaaagtgtctggcatgtagtaggtgttccataaatatttgtgactgactgactctccttatgtttatattccacatttctctgtactacttgactgctcaacctccctctactcacctaaaaataaaatcatcctactttgccctctggatccccagtatcatgaaaaccaatcctccccaagtccttaacctctttaacacgaacttgcttcttccttctgccttgcttaaagttctctgatgagactaagatttcccctgcagctcataaggttgataggtgaggttgactttcttcctgctccccattgctccttcttgtccctgattcctctaccctcttgtaaacctctcttctctctatctcaccagagtaagagtttcaagacaccttgatttttcatcctctaactctcattgttggtgtcatcatctggtaaagtcaaatgtcacaagagcagagcaaaggaataaccaatgcattcatacctgtttcttagaacatgtggggagctactcatcccataatcccagagcctctccactgcagcaataaaatagtgtcgtgttttcttttgaaagctgcgggggctctgattttcatcctcatcataaatgtcaaaatcttccttcttcatttcaactgatatggtatcatcatagtcaatttcctcttgatctgactgaagagtagtacgagttatttcccgttgatggcgtttcaagactggtgggttttgagagcacagcctttcagtcctaccttgctttgcccaggtgacttctatttcgggcttattttgtccctcatttattgctgctattgcatgattgctttcacaagcgttcagggacaaaatggtatcctttttcttaaaagctgttttttctggtgacttctcttgggatttccactcttcttttggtatctgagtaccatagtggttatcccaagcaagaggatccaatagcttggagggagtctttgcagagctttctgttgctactctcagaaagggaacttttccaggtctgtttgcttcattccacttaatcgctccctctgttccctgaagaaggctcccttccacgagatccagatggccaggagacccattgctagtttccgtagggaataggtccttctgataaatgtgaacttttggaagcaattcaactttgccagatgttttgggcaagtctggtttcgggagaacagtgttctcaactttcttgtatgtgactgaatttgtggcacttgtccccagggagccaacctctctttgatcaccagtcatctccaaggttagaatggctaaagaaaggttattttttttggctccttgtaagaaatgactgctttcttggaccccagaatctttctttctataagatgctgctggaagatgagaagagttgtcttggaataggaccctggtcagatatataggtctaatagatggaaatgatgatacctttgcaatgggtaatggagatctatttgcttgagggatgctatgactcctcgtaaggcaatctgataagggagactgagtaatggcccctttctccttctcattgtagtctatctgtgtgagggtgctcggggtcaaatgtttcatgtttttggaccactgggttgaggtgtcatccacaattatccttttttcaagttctgtttcttctagtgggagtctgaattgtttcaaagctctcttactacgttgcgtgacaaaattctgctggcttgtattaggagatatccttgtggtgcatgcatatttctctacaatttgcttggtttgatttcccaagccttccaagttttcttcctcccctttttttgagaaatgagctgtgtgtttctttgttctatttgttgaatcatttaatgacctaaaatcttgaagtactggagcatatgccccgtcatatgaaccttctacattttgcctagtgctcagtaagaaaaggttcttcatgaaattcttagtgccagtcactgtatgtatctgaggcaaaactacattctcttggattaatgtttccttcttttctatttcttcctgaatttttttttcttgattgtgtgtattattttcatgtaaattatccaagttagtaagaaataggtttctgctgcttggaaaaaccatctctttgagtcctacgtcctttgtaaattcaccctttcctactaccactttgtttttctcagacaagaaattctgaccttccacagatttttctggtcctaaggatactaattgctttggactggggccttgcccagagttcagagagttctttccatgagtcctttgtatccaccttgctgattctggcaagaatagcatcttaaagaacgacatatctggattttgtgcatctggtggaatggggccctcttttttctgttggaccatttccatgttttttgatgaagtagttttatttgacatatgatttagcctcaaagctgtagcatttttgtccataagcattctgtcatgaatcaaaggtgtcacttttttaaactcagtgtcactttctaatatattttgccagactgatggactattctcaattaataatgatgggccatcaatgtgagtctttctattagttgctgaattattggaagttttgtttgtctttaacaaagagatgctaactttgaataaggcattatctttagtcaacaaagcaggtccatgagctcttttccctttaaataacctaccactctctgttgacgatacattttttccccatgaactttcttggctattcattaaacctgattctaacaactttgaatcattattttcttcactcaagctcagaggtccaccagactcagtaaggggagatgactttttgccaaatagagtggtatctaattgactatcataatgaactggcatacttgggggtcctaaggaacttgtattatcagtacctgctgccaaattgtctgatggaattgttgaaatcagattatttgatgtactagaaactttgaaatcaagtttcttcaactctgttgctgcagttgtccccagtttctcatttaatcttaattggaggcctgactcaggggtaaataccatgtccccactgtgatggagctgtggcctgaagtgtgtcatttcagacaggctgttattactgtctattgctccaggtgatggatcatcagaaaaagtctcatatttggcttcttggagatcagataaggatagcccatgtggagtaggactctgtcgcaagagcatcaacaaatcactagaggagacattttgtattttaggcataggtgttctgtgtgcaaaccaagggtcagtcttctctatgtcattttctggaattgtggtggcattaaattgcttttgcctagtgctagggtgtcttgaattctgggagaagcttcttggttcaatggcattgtttttactcagcaagtatgctgaaatatcttcataactgtcctcgtaataatcaccagtgttcttgtcacaactagaaaccttcagtaaggcggtcatgcctctgttccgaaagtctgagttgtggcaccccagaatccatagacctggagatgaggaagaataagactctggttactcataacacagattctaaaacgttctgttagaggttctctcccattcccagataaatgaaaaaatactagtcagtatcattatatcacaggtcattgggttaaatccctggaacatgtaatataaaagtggtttttgcattgctgctgttgtactatgcctgtttgtgaccataagaaaggactgtgataaaaatgaatagatattgggattaaaatagggaaatgtaattaatatacacaataatggagggtcttaatagtgacacagaactctctgaatatgacagtgatttaattcaggaaagtatttatattggctagatgttattgctatatcacatagtggcacaggttcctcttaaatccatcagattgcctggattcaaatcccagttctaccatttaccagctgtgtgactttgagaaagtcacttaaactttctgaacaataggtttctaattttcaaatgaggctaatagtatctaccccatcatataatacattgaaatcacataacacaatacctagcatccactgtcacccacttgcagaatatgtaagcacaaggaaggagcatttaggtctaggatccagctaatataaaattctaccatggtactagcaatattaatttctaccatgaacaagattagctgagtgaaggaatgcaacaagttataataggctaattacatggtggtaaagtagatgcataaacataagagacaagatacacctttaccaagctacccgttgggtacctcaatagccttgtcatttcacacagtcttttcagggaagatcttaactgcatccaccttcttctcaagggaagctgctcccaaaagccctgtgaatgcttacattctatgtgcagccaaattatcaatcaagtggcaaaggagaataaaaacatattctaacatataaagactcagaaaatctacctcaaatgtcaccattatcaggaagtgattatggaatgtttgccaccaaaataaaggagtatctcaaacaagagtaagacctggtatccaagaaccaggtacctatcctgagggagggtaaataaaagtcccaagttgataactgagcctcaggcctagagagaaccagctcagactggagcagggggatgcatgcctctaggaggtcaatctgtaagcaaaaaggaatacattatatgatggaactcttgaaaaaaagaggataattcaaaggcagacattataagaaaaacagggaaacaattagagattctcgtcaaactagttaccaaaatggacttttatttaccctcccctctgagaggggcctggtattaggaatggtgaccaagctggagtttagttttaatggcttgggttaaaattttgtaatgaaaatatctttttgtattgtatgtgtgactaatggtaaatttaaaacattataattaattcataaatttcaatccaagaacttagagttggttgtttgatgaaaaagtcaataaaataaataaccaaataaaaattaagaaatttcacatatacaaaatttgaagtaagaaaagagacataattacagacacaaagaaaatgaaaataattgtaattcccttggagacacctcagctgtcaatctcctcctccaacttctgacataggtataagctatctggccaagttggggtctagtcagcactacaaatatatagatcagtctcctgcctctgtgatcaaaccagggctttcactgaactaattaattctgtaagctattatccgatcttggaactagttactagctgttgagttgagaagggaattcgacatccattaagtagacagagagttaggctaagagcaagccacttatcctctcggctagcaaaccttgatcagaacatatttgtaccttgtttaaggacgagaaaacatgcaatctataaatatactacagaacagggagaaggaaacagaagtcaggaaacttagaggcaatacctacttctgaaagtaatccactgcagattctagaggaaaagtaagaacaaatatcttgccatactaaaacacaagaaggcacagcttccataatttaaaaccacaaagacatagcttctataatttaagactggaaagggcatacacaaggtgaaatggtaattcagctggatgaaatagaaaagaataattataagaaaacttaacacataacaagagatgatcagtttgtgtgtgtatgggttccaataaaaccttacaaaaacggacagagaccagactacccaagggccatagtttgcccactcctgatgtagatggtcacccactgtgcctttcatggggtttcaaaagatgaccagtttttaaggtagtgaagaaagggctggcctttcttcttgctcctttcagaaattgctgcaaataattaaagacagagtacaattaagctggaagatatctgaagccatgaaaccacaaaatagaagtatagttaatataaaacaggtatcaaaagataaaaagagtggatgctcatggctggcagatttcagaaaagtccaagaagacatacttcctcatatcttataccgccatatcttccccatttttaatatcaaagtctaattattcctcctacttcagcctcccaaagtgctgggattacaggcatgaaccactgtgcctggccttgtttctttcttctatcaaggtgcaagtattatactttgatatgaaaaacagtcagtcattcattataacaatgggatcagggtatacaagctagcatcggtggttttactggactcctttcaacacaagtctcaaaaggtaggaaagatgggaccagaagaaagaatcacattgacaagtcatttttgcactgtaagtctgttttgcaaggtggggaggggaggaaagaaattctgaaatgtaaacaactctgcagctttgatcttgatgggctggagagaagtaaaggctgaaaactcacacatacaatcaatacctttcataagagaattcctgctaatctaaaactcactcctaatgcctcattgatattaatatatctacataaactttctgcgaaaagtttatttagaacaaactcacctcaatgataaataataagcaaaaaggatcaagatactacaagataaaaggaagaaaggaacaacaaggccaggtgcagtggctcatactggtaatcccagcactttgggaagctgaggttggaggattgcttgagcttggagttcaagaccagcctgggcaacaaagcaagaccctgtctctacaaaaaataaaaaagttagcctggcatgatggtgcatgcctgtagtcccactacttgggaggctgaggtgggaggattgcttgagcccaggaggttgaggctgcagtgagccatgatcacaccacttactccaccctgggcaacagagtgagaccctgtctcacaaaaagagaaaggaacaacaaaaacgaataaaagaagagcagtaataaaaaaaatgttgccaaggagaagataaaacttgtaaccaaacatatcaccataatctaatgagatgaccacatctgaaaaaccaaagtctaatgtagaattagctataagaatttatagaagacgtatgggtcaatggaacagaatggagagttcagaaataaactctcacatttatggtcaattgattttcaacaagggtgtcaagatgacttaatgggaaaagaatcatattttcaacaaatggtgccgggacaactggatgtttacatgcaaaaaataaaaaagaggttagacctcttcttcacaccatacacaaaaatttattcaaactagatcatagacatatatgtaacagctacaactatcaaactcttagaagaaaatatggaagtaaatgtggccttgggctagacaaagccttcctagatgtgacatcaaaagcacaagtgacacaagaataaaaagataaattgtatgtcatctatgagttcatcaattaactcaacaacccaggaaacaattactgaagtaaaaataggtcaataaatgtcaacaaaactgaacaactagaaggaaaaatagttagaaaacaaactagaacagcatattcaagagctgtgtgacaaaattgaacagtataatatatgtaaatgcaataccagaagaagagaaagaattagaagcaatatttgaagacacagatgataaatatttttcaaaattaatgataccaaattacagattgaataagcctagagaatgccaaagtaacacacacacacacacacacacacacacacacacacacacacaaaaatcaaagtaaagagcttgaagccatccagatttttttaaaaagatacattatgtacagttgaatgcaaatgggaattacaacaaacttattgtgaaaaactatgcaagtagaaacaatggagcggcatttttaaagtgctgagggaaaaaccaataaaacaaaatgtaataaaacaaaaacaacaaccacaaacccagaattctatacacagtgaagatataattcaaaaacagaaataaagacttttcagagaagcaaaaactgacaaaattaattaaccaacagacttgcactacagaaaatgttaaaaaagacacactgtaaatataaggatagagataggttgaaaagaaaagaatgggaaatatataccacacaaacattaagcaaaataaatatgatagtgcaggtgtataaattttagacaatgcagacgtttaaggcaacaagtactacttcagacaaaaaggacatttcacaaagatgaaagaattgatttaataagaatacaaccttaaagttgtaagcacctgattttatattgcctcatttattttgaaacattcttactaacaaatacaaaaatcaaaataacaaactcaacaatcacagagatgtcacagtttcctccatgtctgtaagaaacagataaaatatcaggaagtttataaggattttaaaaacatgataaagcaacttgacataataggcaaatatatgacactctacccaataacagcaaagacatatttgtttcaaatgcagtgggccattaatcaaattaaattattcactgggcatatagcaagtctcaacaaatttcaaatgattgaaataatatagagtatgttatgtgatcacagtaaaacaaataaatcagcaacagagagagagccagaaaatcgccatatattgggaaattaagtaaaacactgtaaaataactatgaataaaacaagaaataacgtaaaatttataaaatattttaaactcaatgataataaaaatatgactcatcaaaatttgtgatatggggttaaagcagtatataaagggaaatttatgctttgtatgaacttttaaaaagtaagaaatgttgaaaatcaatgaaccaagttttaatctcaagaagtcaagaagaaaaagaaaactgaatccagagaaagtattggaataataacaaaagaccagaaataaatgaaatgcaaagcaaaataaaaataaaaattcaacatagaaaataaacaaaacaaaaaaatttttttaattccatgacctgatgaacaaagcaaaaatttgatcctatggtaggattagtaaatttgatgaacctataacaaaggcgacaaactttttttttttattatactttaagttttagggtacatgtgcactagggggaggggcgagggatatcattgggagatatacctaatgctagatgacgagttagtgggtgcaggcgataaacttaaaatagataaaatataaataacaatatcaggtatgaaaacggagacatcagtacagacattataaggatgataaaagaacattacaaataacttacttcaagtaaattaaacaacttagatgaaagggacatatttctagaaaaacacaattgacaaaaactgataccataaaaaatattataatagcattaaataccaaagaatacactttacaaaaatgtgcaagacctgtacactaaaattttacaaaaacattgccaagagaaaatttaaaagatgtaaataaataactaaaccatgctcatggacaggaatactcaatattgtcaagaggtatgctcccccaaattgatctgcagaatcaatgtaatccctatcaaaacctcagaagatatttttattgataaaattgacaagatgattctaaaatttatataaaaatcaaagagagcaaagttggaggaattatactaacaaatattaaaacttactataagatagtatgttactggtacaaagatagaccaataagtcaatggaatataagagatcaggggttggcaaactttttctgtaaaaagcaacatagtaaatattttaggtttgtagacacatatggtccatgatacatatccttatttgtttttttgctttttttttgttttgtgtgacaattctttaaaaatgtaaaaaaattcttagctcaatgccatataaaaacaagctgcaaatttggcttgtggatcataacctacccctgaaatagagtacagaaacaaagctacagtgatacagtcatcagattcatggcaaagacaacagtgcaattcagtgaggaaattatttttttccaacaattggtgctagagcaattaaatatccatatggaaaaatgaacttttatctgcatcactccatcaaaattaattaaaaatgaatcataaacttaattgtgaacaacacagcaatcagacttctagaagaaaatatttaaaatatgtagaaagaaaatatagaaggatggcatcatgttcttaggataggcaaaaatttctgaaacagaatacaaaaggcattaaccataaaaaactgaaaaataagaattaattaaatgtaagaacttctattaaccataatgcacccttaaaggagtgaaaagacaaaccacagactgggagaaaacattcacaatatgtaaatccaaccaaggacttgtatctaggcaaaataaagacccattctgaccaaaaactgacagagaactttttactagccaacacacactgaaggaagttccaaagaagtttcttcagacaaaaagaaaatgatcatagatggaagcaagaaatgcagaaaagaatgaaagaaatgaaaggtgtaaatatatatatatatataaatgatattgattatataaaacaataataatgtcttatggggtttaaaatatatgtagaattcaaataaatgacaagagcacaaaaggtaggagtgagaaaatgaagtcacgttgtttgaaggtctttgcattgggagccaagatggccgaataggaacagctccagtctacagctcccagcataagtgatgcagaagacgggtgatttctgcatttccaactgaggtaccgggttcatcttactggggagtgccggacagtgggtgcaggacagtgggtgcagtgcactgtgcgtgagccgaagcagggcgaggcatcgcctcacccaggaagcacaaggggtcagggaattccctttcctagtcaaagaaaggggtgacagatggcacctggaaaatcgggtcactcccaccctaatactgcgctcttccaacgggcttaacaaacggcacaccaggagattatatcctgcacctggctcagagggtcctacgcccatggagccttgctcattgctagcacagcagtctgagatcaaactgcaaggtggcagcaaggctgggggatgggtgcccgccattgctcaggcttgagtaggtaaacaaagcggccgggaagctcgaactgggtggagccccccacagctcaaggaggcctgcctgcctctgtaggctccacctctgcgggcagggcacagacaaacaaaagacagcaataacctctgcagacttaaatgtccctgtctgacagctttgaagagagtagtggttctcccagcacgcagcttgagatctgagaacgggcagactgcctcctcaagtgggtccctgaatcctgagtagcctaactgggaggcaccccccagtaggggcagactgacacctcacatggccagctactcctctgagacaaaacttccagaggaatgatcaggcagcagcatttgcagttcaccaatatctgctgttctgcagcctctgctgctgatacccaggcaaacagggtctggagtggacctccagcaaactccaacagacctgcagctgagggtcctgactgttagaaggaaaactaacaaacagaaaggacatccacaccgaaaacccatctgtacgtcaccatcatcaaagaccaaaggtagataaaaccacaaagatggggaaaaaacagagcagaaaaaccaaaaactctaagaatcagagcacctcccctcctccaaaggaatgcagctcctcaccagcaatggaacaaagctggatggagaatgactttgatgagttgagagaggaaggcttcagaagatcaaactactccgagctaaaggaagaagttcgaaccaatggcaaagaagttataaactttgaaaaaaaattagacgaatggacaactagaataaccaatgcagagaagtggttaaaggacctgatggagctgaaaaccacggcacgagaactatgtgatgaatgcacaagcctcagtaaccaatgcgatcaactggaagaaagggtatcagcaatggaagatgaaatgaataaaatgaagtgtgaagataagtttagagaaaaaagaataaaaagaaacaaacgaagcctccaagaaatacgggactatgtgaaaagaccaaatctacaactgattggtgtacctgaaagtgatggggagaatggaaccaagttggaaaacactctgcagggtattatccaagagaacttgccaaatctagcaaggcaggccaacattcaaattcaggaaatacagagaatgccacaaagatactccttgagaagagcaactccaagacatataattgtcagattcaccaaagttgaaatgaaggaaaaaatgttaaggacagccagacagaaaggtcgggttacccacaaagggaagcccatcagactaacagctgatctttcggcagaaactctacaagccagaagagagtgggggccaacattcaacattcttaaagaaaagaattttcaacccagaatttcatatccagccaaactaagcttcataagtgaaggagaaataaaatcctttacagacaagcaaatgctgagagattttgtcaccaccaggcctgacctaagagagcttctgaaggaagcactaaacatggaaaggagcaaccagtaccagccactgcaaaatcatgccaaattgtaaagaccatcaatgctaggaagaaactgaatcaactaacgagcaaaataaccagctaacatcaaaatgacaagatcaaattcacacataacaatattaactttaaatgtaaatggactaaatgctccaattaaaagacacagactggcaaattggataaagagtcaagacccatcagtgtgctgtattcaggaaacccatctcacgtgcagaaacacacatagcctcaaaataaaaggatggaggaagatctaccaagcaagtggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattagacagatcaacgagacagaaagttaacaaggatactcaggaattgaactcagctctgcaccaagcggacctaatagacatccacagaactctccaccccaaatcaacagaatatacatttttttcagcaccacaccacacctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagatggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacagaattgatagaccgctagcaagactaataaagaagaaaagagagaagaatcaaatagatgcaataaaaaatgataaaggggatatcaccaccaatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccgaaaagagtccaggaccagatggattcacagccaaattctaccagaggtagaaggaggaattggtaccattccttctgaaactattccaatcaatagaaaaagagggaatcctcctgaactcattttatgaggccagcatcatcctgataccaaagccgggcagagacaaaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaatttggtattgatgggacgtatctcaaaataataagagctatctatggcaaacccacagccaatatcatactgaatgggcaaaaactggaagcattccctttgaaaactggcacaagacagggatgccttctctcacctttcctattcaacatagtgttggaagttctggccagggcaattaggcaggagaaggaaataaagtgtattcaattaggaaaagaggaagtcaaattgtccctgtttgcagatgtcaggattgtatatctagaaaaccccattgtctcagcccaaaatctccttaagctgataagcaacttcagcaaagcctcaggatacaaaatcaatgtacaaaaatcacaagcattcttatacaccaataacaggcaaacagagagccaaatcataagcgaactcccattcacaattgcttcaaagagaataaaatacctaggaatacaacttacaacggatgtgaaggacctcttcaaggagaactacaaaccactgctcaaggaaataaaagaggatacaaacaaatggaagactattccatgctcatgggtaggaagaatcaatatcatgaaaatggccatactgcccaatgtaatttatagattcaatgccatccccatcaagctaccaatgactttcttcacagaattggaaaaaactactttaaagttcatatgaaaccaaaaaagagcccgcatcgccaagtcaatcctaagcctaatgaacaaagctggaggcatcacgctccctgacttcaaactatgctacaaggctacagtaaccaaaacagcatggtactggtaccaaaacagagatatagaccaatggaacagaacagagccctcagaaataacgccacgcatctacaactacctgatctttgacaagcctgagaaaaataagcagtggggaaaggattccctatttaataaatggtgctgggaaaactggctagccatatgtagaaagctgaaactggaacccttccttacaccttatactaaaattaattcaagatggattaaagacttaaacgttagacctaaaaccataaaaaccctagaagaaaacctaggcaataccattcaggacataggcatgtgcaaggacttcatgtctaaaacaccaaaagcaatggcaacaaaagccaaaattgacaaatgggaactaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttcacaaaagaagacatttatgcagccaaaaaacacatgaaaaaatgctcaccatcactggccatcagagaaatgcaaatcaaaaccacagtgagataccatctcacaccagttagaatggcgatcattaaaaagtcaggaaacaacaggtgctggagaggatgtggagaaataggaacacttttacaatgttggtgggactgtaaactagttcaaccattgtggaagtcagtgtggcgattcctcagggatctagaactagaaataccatttgacccagccatcccattactgggtatatacccaaaggactataaatcatgctgctatagagacacatgcacacgtatgtttatagcggcagtattcacaatagcaaagacttggaaccaacccaaatgtccaacaatgatagactggagtaagaaaatgtggcacatatacaccatggaatactatgccgccataaaaatgatgagttcatgtcctttgtagggacatggatgaaattggaaatcatcattctcagtaaacgatcgcaagaacaaaaaaccaaacactgcatattctcactcataggtgggaattgaacaatgagaacacatggacacaggaaggggaacatcacactctggggactgttgtggggtgggggaaggggagagggatagcattaggcgatatacctaatgctaaatgacgagttaatgggtacagcacaccagcatggcacatgtatacatatgtaactaacctgcacattgtgcacatgtaccctaaaacttaatgtataataataaaaaaaaagaactaataccagctcttcacaaactatcccaaaaatcaagggggaaaaatacttccaaactgattccacaaggccagtattaccctgaaaccaaaccagacaaagacacacacatacacaaaaagaaactacaggccaatatctctgatgaacattgatgcaaaaatcctcaacgaactactagcaaaccaaattcaacaacacagtaaaagatcattcatcatgatcaagggggattcatcccagggatgcaaggatggttcaacatatggaaatgaatcaatgtgatacatcatatcaacagaatgaaggacaaaaacaaatgatcatttcaattgatgccaaaaagattaaattcaacatcccttcatgagaaaactctaaacaaactgggtatagaaagcttacctcaaaacaataaatgccatatatgacaaactacggctaatatcataccaaatgtggaaaaccaaaagcctttcctttaagatctgaaacaagataaggatgcccactttcaccaattctataaaatgtagtcctggaagtccaagccagaacaagtaagcaagagaaagaaataaagggtacccaaattggaaaggaagaagtcaaattctccttgtttatagatgacataatcttatatttcacaaaaaactaaagactccatcaaaaaactattagaactgataaacaaattcagtaaagttgcaggatacaaaaccaacatgcaaaaatcagtagcatttctatataccaagagctaacaacctaaaaagaaattttttaaaaatcatttacaatagctataataaaaataaatatattggaataaattaaaccaaagagctgagatatctctataatgaaaactaaaatactgataaagggaattgaagaacacacaaaaaactgaaaaggtatctatcccattttaatgggctggaaaaactaatattgttaaaatatcaatgctaccagatttaatgtaatacctatccaaatgccagtgaagtttttcacagaaatagaaaaaagaatcttaaaatttgtgtggaaccacaaaagactccaaacagctaaataatctggagcaaaatgaacaaagctggaggcatgacactacttgacttgaaactatactacaaagctgtagtaacaaaaacagcacggtactggcataaaaccagaaatatatgccagtggaacacgacagaaaacccagaaataaatccacacatttatagccaactcacctttgacaaagtgccaagaacacgcactggtgaaagaatagtctcttcaataaatggtgtgggaaaactggatatccacatgcagaagaatgaaactatacccctatctctcactatatacaaaaatcaaatcaaaatggattagagactaaaatatacaacctgaaagtatgaaactactggaagaaaacattgggggaatgcgccaggacattggtctgggaaagattttgcaggtaagacctcaaaagcacaggggactaaagcaaaagtagacaaatgggattatatcaagccataaagcttctggacagcaaaggaaacaattaacaaagtgaagagacaatttataggatgggatgaaatatttgcaaactatacaactgagagggcattaataaccagaatatataagaaactctagtcaatagcaaaaaaaacaaagaaccctattaaaaatggacaaagatctgaatagacatttctcaaaagaagacattcaggctgggcacggtggctcacgcctgtaatcccagcactttgggaggccgaggcgggtggatcacgaggtcaggaaatcgagaccatcctggctaacacggtgaaaccctgtctctactaaaaatacaaaaaattagctgggtgtggtggcgggcacctgtagtcccagctactcgggaggctgaggcaggagaatggcgtgaacccgggtggcggagcttgcagtgagccgagatcgtgccaccgcactccagcctgggctacagagcgagactccgtctgaaaaaaaaaaaaaaaaaaaaaaaaagaagacatacaaatggccaacaagtatatgaaaaactgctcaacatcactaattaccagagaaatgcaaaccaaaagcacaatgagatatttcactccagttaaatggcttttatcaaaaagacaaaataattaaaaaatgctggtgaggatgtggcaaaaggggaatgcttgtacactgttggtgggagtgtaaataagtacaaatactgtggaaaagagtaaggaggttcctcaaaaaactaaaaatagaactactacgtgatccttcaaactgtttattagttgcaagggtgaaaataataactactcagaggagaaactagatccctgtacctcaaggaagaaaatgctataaatgacagcatgtgagctagtgggcaaaagagcatacgaatggctagtgaagcattcacagctgttggtacaagaaaaatataataactaacctgggttttccatcgacatgaagacagtttctcctgagaatgggaatagggtgagtgtgtcttcatagaccattttgtgtttgaaggtatatccagagaagaagacagaaaggaagtcagtctgtgctccaatgcttagaatgtaccagtatgccacctcatgcaaacaaactgacaactgcaaactatcaaaaacatagccattgatgcctgcaaaaacaatggggaaaagagatttagacacatcacagatttagtattttggattgtgattgtcatgatacaattaggaattattatatgttatgcccattatcttattcccaggaagagatattatatcttccaaaaaagtagattgttaataatcagttgggccccaatcccaatgtgaggagacagtcataaaccatcatgataaagattaatttggatgttatatggggggcattttgatgagtagcaagatgtttgcatggtcttaaactacacagaggagaaaccagaaaaaaacctttgggtgcttaaagttaccatctgatgaaggtccagattcaaggaaatgaaagaagcaggacaagtagttacttgtactagatccctgtacttcaaagaagaaaatgctataaatgacagcattggttgatacaactggaataccagttgtaaattatggaaatgtgctttatcaatttgaagtgtctgttatgtaaaagatatctttattcacaggaaatgtgtactaaagtattgagaggtaaagggatgtgatgtctgcaactaattttcaaatagaaaataagtaacagaagtgtgtatataaagaaaagaaaatgaaaaacaaaattgcaaaatgttaaacatttgtgaatctgggtaaagggtgtgtgcaagttccatgtattattcttgtaacttttctgtacattttaaattatttcaaactaaagagctaagcaaaagtaacattggccttagtctatgaagggaattgtttctgaaagcctcttccacacatccattcatccatccattcaataaacacttgtctactctgttactaggtactgtgtaagatggttgcccacaaaccactaagcaatacttagacattggcttagtataactaattaataattgaagtttttttcctatacaacattgagatattataaagctattataattaaaaatgcagtcttaatgcagaatagataaatatatcaaacaaaatatggagtccagaaactgacaagatgtaagcggaaacttaatatataataagttgaaacttaatatataataaaggcagcatctccaaccagtacaggaaaaaaatcagctagttggtaaatgataatagaaaatatgactatccacttggaaaaaatagattccacttcatttcacataactaacaaaagtaaagtccttttaaattaatctgaattttgcctaagggtacctttgcacttgagtccttgcacaacaaagttgcagcctggcttagttgatgaactaactgaaagcctaatttaggaatatgcttttataacaaacagctcagtctcagccgattatagcagctgaacttccatcaattgcaggcgactaacagcttcaaataaggcaaaaatgcccaactgtaatcaattaagctgtctctaaacctcacttccaatttctatccatactatgttgctggctgctgttctgtatttggttctgagggctatctgattctagaatcatgtataaaagccaattacaatctttaaaatacatttgttgtatttttgccttttgacactccacatggattaaatagttacatgtcttttgtgaaatatgtacacactacttttgggtgctgtactagtggctagggttgccataacaatataccacagactgggaggtgtaaataacaggaatgtgttttctcacagttttgaacactaaaattccaagatcaaggtattggcaggtttggtttttactgacacctctccttggcttggtctttcctctgtgaatatgcatccctggtgtctctgtgtgtacacatttcctcttctttttttttttcaaatggagtctcggtctgtctgccagtctggagtgcagtggcgtgatctctgctcactgcaacctccacctcctgggttcaagcaatcttctgcctcagtctcccgagtagctgggactacaggagctcgccaccatgtccagctaatttttgtattttcagtagagatggggtttcaccatgttggccaggatggtctcgatctcttgacctcgtgatccgcccgccttggcctcccaaaatgctgggattacaggcgtgagccactgtgcctggcccacatttcctcttcttataaggacactagtcatattggattagggcccattgtaacaacctcattttaacttaataaaccccttaaagaccctatctccaaatacagtcacattctgaaatactagtgttagggcttcagcatattaattctaggggacatgattcaggacataacaggtgtatactaggagtggatttcctgagtcaatagggtatgccgatgtttggctttcgatgtttggatttcctgaccagaaatttatgagagttctcattactctacatctttaccaatacttggtatggacagcctttttaattttagccattctggtgtatctcattggtggttttgtttttttaatatcatcctatccagtttattccttaacttgcataatggttatctgaaatcactggaatgtaagcttcctcaggcttaattactagaatggctgattcttctctatccaatctttttaaatttattttttaattgacagggaaaaatagaatatattatgatgtacatcacaatgtttatatatgtatatattggaatgggtaatttattaactgtagtcaccatagtgtacaatagatgtctttaatttatttctcttgtctaactggaattgtgtggcaaagtctttatctctctgcatttctgaaggaaacattttctaggtaaagttttcccagtactcggaatatatcatcccaccctcttctgacctgtaaagtttctgccttattggaatttccttgtatgtggtttgcttcttttttgttgttgctttcaggattctctctttgtctttgatatttgacagtttgattgtaacgtgtcttcatatagtcttgtttgaatctaatctgactagagatctttgagcttcttgtacgtggatatttacatctttctccagatttggaaagtttttgctatcatttctttaaatacactttcttccattttgtctcactcttcttctagttacccatatcagaaatttggtaatcatctttgaatcctcttagtcctttaccaaacatagctaattatttacaaaatcatgtgccttctatcttctaaacaaatcctgtacatgttccttcctcttcattcctactgcaatttccctatcatttgtaggatccatctacgaaataaatcataaatcctacaattttttaaaacacaaaattataaaacaaacatctaggtcatgaaatacaatattgctgctatccccacaaaacacatgtgtttattctcaaatgaactctttctaagaggtagccactatcttgtcttttattataatcatgtccttactaacctttatacttttcttcctctgtatccctaaactatataagttaattttgcccatttttgaactttatgtaaataatataatactgtatatattcttttgacacttaccattttactaaaaattgtctttgtgatacttattcatattgttgtgtatagctttatttttgtgaatcttcattgtcacatggtatttcattgtatgaaaatagattatcaattttactgctaatggaaataggagtgatttatggtttgggtctctctcctcctggtccttttttttcttcttttcttatccctctgtcttagcatctttctccctggactcttcctctgaagatccttcccctgtgtctcttggtctctgcctttgtgtctctccctgtgctttctcagactctttttctcaattccaatctcttctttctcaattccagactcttatctccaccaaaagctatattagaaatcccagaggaaaaaaaatatatatcatcttcagtgaaattgttttctggctctgcttatgtcactatatctctctagttttcatcaccgtctccaagaaaatgagacagtttaactgtccagatactgtggcaagtgcacatcctacttggaaaaagatgtggtgggaaagggagaaattatgaatagaaaaaaatagaagaacaaatatctagtaaatagcacaataaggaaattataaaatacaatattctatcaggctgaaggaattctaaaccaaagccatgaggctggagagaagagggagaaaagaaaaagctctgtgccactagaattaaatactaagcattagactcttgcacaaatgtgaaatctgaatccttcagaaggaaagcaataccctgaactatgtaaaaaataaaaatgcaactcaaaggactaaacaaccttaaaatttttagaataatggatagtaaaggactttaactctggagaataatatatcactattactagaaattcaagctaaatatgaggctcaacccaaagttaaagggctaaagctttgagaggaggggcatagaattgtaacatatgccacattctggtaggtgagtataactcacattataacttttcaaggttcccatgcatttcgttcaggattttttttttttttttttgaaacggagtctcactctgtcgccggcctggagtgcagtggcacgatcttggctcactgcagtctccgccttccgggttcacgccattctcctgcctcagcctcctgagtagctgggactacaggcggccgccaccatgcccggctaattttttgtatttttagtagagacggggtttcactatgttagccaggatggtctcgatctcctgacctcgtgatccgcctgcctcggcctcccaaagtgctgggattacaggcgtgagccactgtgcccggcctgttcaggatttttagttgcatccagtgggacacacagggaaatgtggctcactccatcttaaacatcttaataatcagaatttcaaaaggcatatattggttttgaaaagactatactacttatccactaatatagcatgagaacactcttttatccacaagcccactagtaattataattttggcagtttgatgggtataaagtgctatcctattgttattctatttcgcatttccctgtaggatagtgcaattggaattttttaccatatttttgaccattcagatttgtggtatatataaatatatacacatgtgtatgtatgcaatgggctgaattgtgttcccccatcccaaatttataccttgcagtcctaaaccccagtacctcagcatgtgactatacctggagatagtgtttttaaataggtagttagttaaaataaggtcattacggtgggccctagcccaacaatactggtatctttattagaagaggagattaggacaaagatatataaaggagaaaccatgtgaagacaagggagaaagccatctacaagacaaggagagaagcctcagaagaaaccaacgttgcccacatcctgatctcaagcctccagagttgtaagacaatagatatctgctggttaagccacccagtctgcagtactttgttatggcagcactagaagactaatacaatgtatgtatgtgtttatatatgattatataattatagagaaaatatgtcttaaaatatgttacctgggcatggaatggttggtgaaaagatgtaatatagaaggagatagggaattaaaagggagagggaaatcaagtaaatattgaaaggaaaaaatggtgactggatttttaaaatatgggttatatgatcacgtgtgtttgagtaaaaattatacatttataggtaacataattgttaaatttatgtgcacatacaattcattcattatctggacatcactttgattacatcaatttttctttattcaccacccactggacttaagtgctgctttactcactgtgcatgatgttggaggcttggaactctggatcctcaagctgcactccagctggattggggagaaagcgttgtatattctctgtgaggtaccagcttcggttctcatcaaatacagaaaacaggatgacattcctcttgtctgacattatctgttaattacatatattgaaaggggtaaagaaatgctactgatgttgtcaggtaggagctagcagtctatgatgaaagcgatggcatgcatgtgatatatctaatccattggtttaattccatttcctcttaggcatgtaccagggcttgggagttgagggtgggtgctatgagcagtgagtatatgcttacaacaaatgtgtccccaggacaagagggtgactgatcccactgaacttagttttttctgcacccaaggccatatgctagctgatttatttggtacagtctgtagccttattctcttcatgttcagattagaagatttaactccttaaagaaccaagtggttattcagtgcctttcttaagttagttaagtcaaatgagatactgactttcctaaacttccatctagcaactgaccttccacaaggctataaaaaattaaaaatagaaaaacagaaatcaaataagaaagataaggtgaaccacaaaaatgtcaaacaacactaataccttaaattttctgtttaaaacattcaaatttttttcagaagagcattttgtatatgaaccagatttatgaattagtcgcttgctaattggatctgctaagatttcatatgtaaacctcactaatatgtataaacctcattttttataacctatagctatataaaccaaaatactgaagagaggagattggagaatatagaataatatttcagttctcttcccaaaagtgacgaaaaaactatagttaggaaaaatcggtcaggacaagtacttggcaaaatttatacttctctgagtttatgtgccatgtgttttattggcaccaaagttcatatactttactctctaaacatatgaaatgttttcagactagtagggatcttatgtatcataaatataatcaaatggacatgtagtcaagcctcagcaatatggcactgagttattctggggccgagcaatgagtttttgtgaagaactaagcttttcttgttcagagaatttagctttattttttaaagcagtagaaatggtccaaattctagccatattttgaaatattttatatctttccctatgttttgcccaaaagtatttattaagcttttttttttttttttttttttttttttgagacagggtgtcgctttgtcatccaggctcactgcagcctcgacctcctgggctcaagctatcttcccacctcagcctcctgagtaggtgggactacaggcacacaccaccatgcccagctaattttttttttttttttttttttttgtagacaaggtcttactattttgcccaggatggtcttgaaatcctgagctcaagcaatcctcctgtctcggcctcccaaagtgctgagattacaggcgtgagccaccgcacgtagcctattaagctcttactaagtgagatgcactgtgctatattgtgggaactagcccccaatatttcaacataggttcttttctattttacctaagtgtcggccggtctgggaaataaagagaaagagtacaaaagagagaaattttacagctgggtctccaggggtgacatcacatgtcggcaggttctgtgatgcccccaagccgcaaaaccagcaagtttttattagtgattttcaaaggggagggagtgtacgaatagggtgtgggtcacaaagatcacatgattcaaaggcaataaaatatcacaaggcaaatagggacagagcaagatcacaaggtagggcgaaattagaattactaatgaggttccatgtcctgctgtgcatgcattgtcattgataaacatcttaacaggaaacagggttcaagagcagagaactggtctgactagaattcaccaggctggaatttcctaatcctagcaagcctgggggcactgcaggagaccagggcatattttatcccttatcttcaactgcataagataaacactcccagagcggccattttagaggcctccccctgggaatgcattcttttcccagggctgttccttgctgagaaaaagaattcagtgatatttctcctattcgcttttgcaagaagagaaatatgactctgttctgcctggccctgcaggcagtcagactttatggttatctcccttgttccctggaaatcgctgttatcctgttcttttcaaggtgcccagatttcatattgttcaaacacacaagctttacaaacaatttgtgcagataacgcaatcatcacagggtcttgaggcaacatacatcctcagcttatgaagatgacaggattaagagattaaagtaaagacaggcataggaaattataagagtattggttggggaagtgataaatgtccatgaaatcttcacaatttatgttcagagatcgcagtaaagacaggcgtaagaaattataaaagtattaatttggggaactaataaatgtccacgaaatcttcacaatttatgttcttctgccgtggcttcagccagtccctctgttcggggtccctgacttcctgcaacagtgctacatgctgcagacatgttaattttgaggtacttttgagtcacccataatgagatgtccatggaagaaatctaggctgtagatataaatctgtgggtcatctgaaaataggtggtaattggacatataaaaatggggaggatcagctagagagagctaaatcccagactgggaatgagtactataggaaaaatctagggcctacattctatggcctatccatccagcaggcacgtttactacgtgaaactcaaatttagtaaaagctaagctcatttcttttactgacctatattgcaaaccattatattttcttcaggttataaggggacatacactgagaatgaaacccagcacttggaaaggcaagaactcacctggtttcctctttgatctacagattctttgtagcagatgaggagagggccaatgagtcctgaagctagatctctctccatattaacgaaactagagtaatagcgggtcaggcaccgaggatctgatttagttggcccatcttctacagtcactgtccatttatatttgaatatttctcctggcagaattggaaaatccttcaaatgttttacacctacccacaagcaaaaccataaatagctcaattagagtacaacaagccacatattgataatcatgttgttgttgcaagggttctacaaatctgtatgtacatatgaagtttctgagcaagtggaagctaaagtcgcacctattataattttaagattcaaacaatttttttaaaaagtaaaaagctgtaattgattatccggttgactgtgaaagtgtcaggcctgaatatatgccaaagagcttggcattggagttttaaggtgtagtctctgacttctgtgaggaaagggagcaagaactgagatctgccctcagggtaatgggtcctcaggacaagaactgattttagtaattaagtctcattctgggtatgtttcatacctgaagatacaatctaaatcaaaattttaattttatattcattctaagctcttcctcacctcagtaagttatgcctgacctatggttagaggatccatagaaagggaatggtgttgaggtgaggagttcgagaccagcctggtcaacatggtgaaacgccatctctactaaaaatacaaaaattagccaggtgtggtggcaggcacttgtaatcccagctacttgggaggctgaggcatgagaattgcttgaacctgggaggcagaggttgagccgatatcatgccaatgcactccagcctgggggatagagcgagactctgtctccaaaaaaaaaaaaaaaagaaagaaagaaagaaagggaatggtgtagtatgttctttcaatatttctgagccttctcttcccttttccaggagctgggggtgagggagggtaggtaatagaagaaagggcaaacagactcttgtttaacaggtcctgctgctctatctttgacaacactatttggtcatcaatgttctctgtgtgggaggtgcccaaatgctggtcttttcataggacacatgtatggtttctttagagttaccatggggacctcagcattacatagttccatgacatgagagatgtttctttcagctatccttctgcaactctcctctccccatcagctcttcttacttccagtgatatatccaagactctattggttctgctatcccctcagcctgcctaactgccttcttgggtagaatatcttcaaaagggataaagcccagctactttcaacagtattcacttgttacagaataaactcatgtcaaacagcaggaaggtaaactgctccactcttgccctctcttcttgcccactattatgggcattacagccttcaaaattctccatggaaaagcaggttaccagtaactatccacgtatgcctccaaatttcgggacacacattcaaaatctccccagaactctgtcactatgccattcttccataaagaaatgcaaataaagaattcttatcggcaataatgaatattagaaaacaggggaaggaattttttttgagatgcagtcttgctctgttgcccaggctggagtgcagtggggtgatcttggctcactgcaaccttcacctcccagtttcaagcaattctcctgcctcagcctcctgagtagctgggattacaggcacacgccacaatgcccggctattttttttgtatttttagtagagatgggttttcaccatgttggccaagctggtcttgaactcctgacctcaagtgatctgcccgcctcggcctcccaaagtgctgggattacaggcgtgagccaccgcacccagcgggaaaatttttataaccagtctgtctgcccatcatgtgatactgaaggattcagaaagttcaccctctatgtaccacatatttagaagttacttgagaatatacttccagaaaaacaaaagaagaaatcaaaaaatagaaatgtacaagggaaaagtagttaatgctattcactacaagaatgtctttaagaagaaaaagatttggttccagcactttgggaggctgaggcaggcagatcgcttgagctcaggagttcgacaccagtctgggcaacaagttaacaccccatttctacaaaaaataaaaataataaaaaaaattagctgggcatggtagtgtgcgtctgtggtcccaactactcaggaggctgaagtgggaggatagcctgagcctgggaggcagaggttgcagtgagccaagatcgtgccactgtactccagcctgggtgacagagcgagacgctgtctcaaaaaaaaaataaaagatttggatagcaagcaatacatagaatgattaagaagctgaaaggcctaagaaatagggttgaagaagcctacatttcttttccgaataaaagaaaacaaagtcttacttcaggatacacctttgtgttgggaacattccaaatcctctcatctagctatttgaaaatagatgtcattgttgactacagtcaccctacagtgctatagaacattaggacttatgcctcctatctagctggaattttgcatccattaaccaacgtctccctatttccccctccccttcccctctttagcctctagtaaccactattttatctctacttctatgagatcaacttttttccttccacatattattttatcttaatagtaaaatcacttgagctgtagaaaagagagcaatcatagcatattacccagttctgcagttaacatttatgaaaagaaacttgctaaaatactaaaataatacaaatgctgttttttaattttttaagctttagagaaaatatatagacaaagcaaggaagagttatttcaaattacagcacaaaatgtaaatgttatcaagtttagttttgtaaaagtaaaggaatggctagcagcagtagagaaaagaaaggtttggggaaaggaaaagtgaggggtacagtttttaatatccttaatttatgaagtatggagtcaaaagatattttcaatccatgattggaaaatatcttactaaaagttgatgtttagtatatttttaaagttctaatgatagccaatccaactgaaaacactgataaaactgaaacaacttgaatggaaaaaagcacaaaacaaagtaagtatataatgtctaaagttgaaaaacaaagagttagcagtataagtaactttttagagatgtagagataaccaccaaaaatcaaaaacagaaattcttaaaaatggatgcctctagggaggcagcccttttgtagttttaagcatacacatctattattttgataaatattcatccaaaattaaataatagaaagaatatacataacatccaatctactaaaagaaaaaataaatctttaaacagcaaacaatatagtaaataaaaactggagttgtgaactatttagaaatgaatatgcgaagaaccctgaaaatatcaaactagataccaaaagtgagagtgaaaccctgttgagagagagagagagagagagcaaggaagagcaataacatggaagctgcagcaaagaatcctgaaaatatcaaactagttacccaaagtgtggaataccacactagataccaaaagtgtggaatgtagctgaaaaccgtactcagaaaaaaaaattatcttaagtgccagaagaaccagcttcaagattttagggcatttacagtagttgcagtggaaccaattgcagtggaatctaattggctgtggaatatttgaacatcaccgctaggtaataggaaaaacatgtcaggcgactcttcacgaatttacatgaaacatcacctgaggattcctataattgatttttataactttagactggagcttgaggtccggccaacagctggagaaaggaccaacataattttagttgttattgatgatatttatctcatctgtatctacaggtaaaaaagagctataaatcgagggaatatttaccttttggtaatctccttgaatacaaaggacggacatcagtgattccgtgagggtagatgttatatggtctgcttgcttgattcttaaatataatctgaaagtataagcgagatctaagatcaaatcctaaaacgactaggatcaacaagaaaactgtggtctaactccagataaataaaagtggcctctatctacattatagtaatttgaggctagataaaactcaaaatatttggtcttttcatgaaattgttccttggcatgcatggaggattggttccaggacccctgcagataccacaatctgtgatgctcaagtctcttactcaaaatgatgtagtatttgcatataacatatgcacatcctctcatgtactttaactcgtctctagatttcttacagtacataatataacataaatgctatgtaaatagttgttttaccgtattgtttctttgtattattgtttattgttgtattattatcttttattgttttggggttgttttttgaatactttcaatcaatggttgtttgaatatgagactagaaatccagtgatactgaaaaataaaaataaaatcttaagcatccccaaacgactgaagagacccctttctcggccaaggagaccccagagatggcttaaaaactgagtttctgaccatgatgggatgggagatcgggcatgccttgttacattccctccctccctaatctgccgttagactttctttcttaagggttaaacataaaccagtcctttctaaagacgtggtggattcccctccctttgtgcagttttatcataacaaccgagaagcattgcttcctgatgagagaccactgaccatggactggctctggccagtttacagaggctgcctctgtgtcctctgtttcatcttttgacatatacagcctaattttcatgcatctaaatgttaagtctccaccccaaagtgaacatggaatgtatgtaacatgtgtggttgcaggtgccccatcataaatattcacagctcctcctggaacctgttaaatatgtatacttagccaactcattcagcataaattcttatctcatccttccttcttcaaagtgcttgcttccatttgctgccagaggctacacttcccagcctgcaaccctttccactccaaatttacaaacttaggattcttcagttgacaatgtagagggctgacagtacttaggtttctctctaaaggcccctttccacttctttaaaaattgtttcaattgcttcaggaagtattctctgcaccttctcacactaattgaaatttagatgcctggtgaggacactgcttcctctcagcctttattactatttgggcattaaattcactgataatagagaaagagacagtgtttcaggagataaaatcttcagtgcatgagcaggcatgaccaagaggacagttgattacagtattaagcaagggtagcaggtggtattgcctgattgcaccagctttaaaagaaaacaaaggcctaggtgcagtggctcatgccagcactttgggaggctgaggcaggaggatcgtttgagcccaggacttcaagaccagcctgggtaacacagtgagacctcatctctacaaaaaataaaaaaattagctaggcgtggtggtgcatgcctatagtaccagctacttgggaggctgaggtgggaggatcacttcagcccaggaagttgaggctgcagtagtgagctgtgatcacaccacagcactccagcctgggtgacagaatgagaccctatctcaagagagagagagagagacagagacgagagagagagagagagagagagagagaatggaagagcaataacatggaagctgcagcgaagaaccctgaaaatatcaatcccacctccagatctgaggtgtgtgatatgaggataaaaatgcaacttccacttctgctcttgtcttaaaacccagtcattcttcctatccatgagcatggaatgttcttccatttgtttgtgtcctcttttatttcgttgagcagtggtttgtaggtctccttgaagaggtccttcatatcccttgtaagttggattcctaggtattttattctctttgaagcaattgtgaatgggagttcactcatgatttggctctctgtctgttattggtgtataagaatgtttgtgatttttgcacattgattttgtatcctgagactttgctgaagttgcttatcagcttaaggagattttgggctgagacaatggtgttttctagatatacaatcatgtcatctgcaaacggggacattttttatggctgcatagtattccatggtgtatatgtgccacattttcttaatcagtctatcattgttggatatttgggttggttccaagtctttgctattgtgagtagtgccgcaataaacatacgtgtgcatgtgtctttatagcagcatgatttatattcctttgggtatatacctagtaatgggatggctgggtcaaatggtttttcttttgttgcttgttggttttggtgtcctatccaataaactattgtctaattcaagatcacaaagatttatcctgttgttttcttataattttgtagttttagctcttacattttatctttgatccattttgaggtaatgtttaagtgtaggattcagcatggtatccagagtataacctgaataaatcaaagaatggggtagatctatatatgttgacatgaaatgatatccaaaatatattgttactttttttttttttgagacagagtctcactctgttgcccagggtggagtgcagtggtgcgatctcagctcactgcaacctccgcctcccagattcgagcgattctcctgcctcagcctccagagtagctgggactacaggcatgtgccaccatgcctggctaattcaaaatatattgttaccttttaaaaatcaaggtacagaccaatttacactgctcttgtttttgtgtgaaatgcacacacacacacacatacacacacacatttgtacatgtatgcactacttctggaggggagtatacaaacccacagcaatgactgtctgtcagactatggggttggaagtccaagagggaggaaaatttacattttattgcatgctcttgtttatctatttttaaattagccagtaaaagtaactcaaaatacacaaaaagtaccctataaatatgtaaaattattgtgtcattatgcattttaaaaattaatgaataaaaaataaaattatacaatcttcaaaaaatgaaaaatagaaaaaatacgtacacaaaatttatgaagaaaaattgtacaataatagctaataaaaattttgaagaagtacaatgaaagaagatgtcatacagatatcaaacatatcacaaagttgaagtcattaaaacagggtggtaacagattagttaaggagaattaaaaatcccagattttagcaatttagtatatgataaagaagacattttcaaattaatgaaaaaaggattggttgtgtcagctgccatttgggaaaatttctatttgaattatgcactacattcaaaagtaacttccagggcaattagattgctcactgtaaaaataaagctatacaagtaagagaataaaatatagactatttttgtagtgtcttgggggtggcaaagacattctcaggcagaaaacataagtgaaaaagatccagagacatataaatgaaaagattgataaaagataggaggttttgactatataaagatgaaaaatctttgaaggacaaaaaatatcataaaggagttaaagtacaagtgacaatgtgaggaaaacatttgaaagataaataacaatgtgtcaatatccataatctataaagaccttttacaaatacataagcaaaagatgactgaccaaatagaaaactggacaaaatttacaagcaggcaattcacagagggagttatacaaatagccaacaaacatgaaacaatatacaatttgaccactaaccagggaaatgcaaatgaagacaacatataaacattttgctcatcaaattggaaaattttctgaaggtttataatatatgttgttggcaatggtgtggggaaaagggcagtcatatacttatggtaggggatataaattggtacaaaattgctgaaagtcagtttggcagtatctaacaaaactccatatctaaaaaccagtgttcttcatgacattcttcagcggctgaatttatggaaccaacgaccaatcttcaaatttcttgtgaagaaaataaacccttatttatttaaaccactgtccattgagtattctgttacttacaccatactcattcttaatatcctagatcaggagcaagcaagcattttttggaaaaggctggatagtaagtactctaaaatttgtgagccctatctagcctctgtcacatattctcttgctcctccgccttctcctccccttcctcccatcctcctttcttttctttgcaatattttaaaaatgtaaaatctcatctaagctcatggactgttcaaaagcaggccacaagccaaatttggttcacaggccatagtctgctgactcctatatgacataattaatggagaaagatctggaaggatatgtatcaaagtctaagcagtatttcaaaggagtgtcgagtttagtgggtgacattaaatttttattctatatactcaaactttaaatacatacaatcagctattatttgtgtaacatttatagcttttaaaagatcatgtccattggagacaaggctgaattatgaggtattttagaaactcaaaactctccagactttttcttcttacctgaccttaaatcttttcttcaacttaccaacagtgtgtctccaacttccccataaagtaaaggtcccaagattcctgattcatgctgaatagcttcacgagtcttaaaggtttcatctgtgtatgccataaatcggacttttttgtacttcctaccaatccgctgagggccattgttcaaatattgacttttataacttctgtataagagaaaaaaagatgagaggttgggaagaaaaattctaggtaggctcaaatccaactctaaaacagcttatatgattcaatcaaggcaaggagtgagaaaaatacaagcttctctgatgctcagctatgttagtttccaaatgttaatacccttgccatttgattccatacctgtacctaaccttaaacatggcttcaggatttgttggtttgaataactggtaagaactttttgagtatggggaagagagagtaccaatagtcaaaaagtgcttacctgtcatcgggggcgaggactaagggagcatagtcccagtcctcctcttcagcagcaatgtaatgtacccaagttttaggatgcttcttggcaactgagcgaatttggataaaggaaggagagttgtcatcatcaaacctgaccacatccatttcagaatcagtaagatcatcatcatagtcttccgcttcttcattatttttcattcgtagttggggttcctctggacagctgtctactttgacataagcttccatgccatctggagtcagacaaaccaaacaatgtcagagtgtcttgctatattaggctgttctataccagagactaggtaatttataaagaaaagagattgaattggctcatgtttctgcaggctatatgggaagcatggtgctggcatctgcttggcttcagggaggtctcaggaagcttacaatcatgggggtaggtgaagggggaggagacatgtcacatggtgaaagcaggagcaagacagagagtgcaagttgccacacacttctgaatgaccaaatatcatgaagacagcatcaagccatgagggattcacccccatgatccaaacatctgccaccagaccccacctccagcattggaaattacaattcaacatgagatttcagtgaagataaatatccaaaccatatcacttgccttaacttttatgacttctttctctcttattaggccttccaggctctcccctaagtaccccccctttccacatcactatcccttcttgccacaaatcattgatttaataacagcttattgggaaaaatgttagtgtagatataaactttaagacatgttccaagttcataaaaccatgacaagatacaacttaaaatcaaggagatatatattttaagagcatgtctgcctgtgactagttgtaaaccctatggcaaatgtattcaacattctcagtctcatcttcatgctttgtaaaatggataataataattcctgccctatttataccacagggcaattttgaagatcaaatacttctaagaagggagacctgtttacttgattatgaggaacagggaaggttttaggagcagcaaacaactagtctggggttcatgtagccttaaacataactcagtctgcatcgaaaaacaaagtgtttggtctgaggttcaataagataaagcatttttttctgaaaaataaagattaaaattagtggatagaatctgtgaaaaggagaaaaacaaaacaaaaaataaactgaatcggggtccaactggacaatgattgattgacaatgatcatatacaagtaaatgacctattcctctgtgcctgcaagaatgttgtttgtgcatcaacttcctgttactcattcagtatgacacattttgtccactaaggtcttgtcaaaattccataaatattatgtgacacatggggaagagagatttctattcttaatcactacagaagacaataaacaaggtcactaatagaacataaggaggaaaatggtggatgcatggcaagatcaattctcttttctaagtcaaccaaggaacctgaggagaaggttaatatgagagtaataggaagaaagaaatgctattaaatataaaagattaggcctctccgacatttttctccaataactcttgctatggtttgaatgtctgtcccctccgaaactcatattgaaatttaattatcatcgtgatggtattgagaggtgaacatataaaaggtgtttaggtcataagcgttccaccctcatgaatggactaatgcagttatctggggaaagtgttcatgggagtggatttgttatcacaggagtgagctcaccctcctcttgctctctctcaccctttctttgcccttttgtcatataatgccttccaccatgttaagacgcagaaaaaggcaacttgatattggacctcccagcccccagaaatgtgagccaataaatttctgtccattataaattacccattctgtggtatactgttattgcagcacaaactgactaagagccttcaatggccacgagaggggtagagaaagagggttattaggttgatccaagattaagagttagcagaataaatacaaaagtaaggaaaattggggtgaaatgatgatgcaatctgaatttgcacaactagcagttacaaataaagttacattaacaataatttaaaactgtagttaccatcgtcctaatttgcttacacagaacctttgaccctttccaaagttcccaccaaatagtcctttcaatcccatgttacttctaaaattcactagctcctgacctgccctcagtttcacaggtgtctctcatctactgccaggtatctacagagtgcctctggctgtctggtgtctgaagtcaagctctacaatagcctgtcatatttgctatttactgctctgggcattactaatgatatagtggagcccttacagttgcaatctggacaatgcctttttttcccatttccctagatttctccaaaaaaaaaaaaaatctcttcagctacaacttgcagttcctctctccataatattggagcgtaattaatgggataaggctgagaaaccaagggcatactattctcctcattttcccacctcaatcatccataagccatcttttctccatcacagacatttaactaaaaatccatgagtcctactaatactcaagcccttttatagtcaaggtaaaaactttacactggaagctggaaactaggggatcttggctgaggtctaatacagtaactctataatgtccccttcagcaacacactatattcctgtacattgtccagtaaattttattaaaagtaggactggatatttataatattcattttaaagatccaagatattaccatgttggtgggaagagatatgacaaaacagtagaaactgtccaaggtccatcaagagtgtttgagcagtaaggaaagttattggcgagatttccaaggacgcctggcgatggttcctcacaagaaatgtgtgaccttcgaggaatattgagtgcacttcaggagtggtgcccattccaatcacatgccaatagactgatttcctgtggcatccaatcagacctgtaaagtaggaataagacacctatggctatgaagtagagaatctgaaatggaaaacacttgctaggacagaatggacaaattgactttagacactttattgctaccttgacttgtaaacaaatttatcaagaacattgggctactatcaaaccaacagctcttgccaaggtcaccaatcaccatcatgctgctaaatccaatggacatttttcagtctttatttgcacctgttgaccattcattcgtttttaaaactctctcttcccttggcctctgtgccaacatctctgtgggtttttttctcctacttctcagactgctccttcttctgtctcccctgctgacctcttctggaactccaggctcatacagccaatcactttctcaacatctccacctagatatctcaaaaaacccacatgttcaaaaccaaatttacaattttcatcacttcattctcttccagagttttttataacagtgaatggcagcatcctgcatttgaatatgcaagtgagagttatccttgttaccattctcatctcccatatgcagtttgacactgaccagggcaatataatcaataatagctaatatgtattgagcacttgttttatgtcaagcactgtccaaagtattttacaagttttaattcattcattcctcataacaaccctatgaatgtagaaaccattatcatccatgtcttgcaggagaggaaacggatgcccagagaggttaattaatttgctcagtatttgaacccaagtagtcatgtgttcagatcccacactggtaacaacaagggcacagctgcctcctattttggctctaaaagctttcaaatgtatctagtttttcactgttactactaccactatcttaatccaagttaccattatctcgtctgagctactgataaactttttttacaggtctccctacagttggtcatattctcccctctaagacttttacccacaaagaaactggtgtactatttctgcattccagatctgattgtagtatccgccagcctaaaacccactggaggctgtcattccacatagaataaagtccagactctctactaaggactagaaggccccaataggtttgattcctaatacctctaacagcttcatctcacattgcctcattttcccagtttcaaagctaagttcaaggggtacttgcttagggaagccttctctgattccccagtctaggtcagattcctgtattataggcttacatagaattatgtaattttccttcagagtaatgctcagtttgtaattttgcatgtattattatgcttatttgactacaatctgtccctccactataaggtatgtgagaacaggaacttgcatgttgtcaaaattaatttcctttttaattataaaattatgcatgtttattatcaaattattgaaaaatacggaaaagaactaaggagaaaacatccccctcatacttcattattctcttgggttgctgaatctcccaaattcctcttttatgtagtttctggttttactatagtacacattcagtgactattaaggccctctatatatgaaaatgtcttttttcttcccccaaaattgattcatagtttgactaaaaattctaggttccaaataatttttcccttagatcttttacaatattgcttaattatatcgccagtctaattcccattcttttgtatgcgtcctgttcctctcagaagaagctttaagtatcttctctctgtgctctgaaatgccacaatgataattttgtgtgtgggtctttttatttatcctaatgggcaattttatttttttaactgtattactttttattgacacataaataattctacaaatttatgggtacaatgtgatgtttcaatacatgtatacattgtgtaattattcaaatcagggtaattatcatatccatcaccttaaatgtttgtcatttctttgttgtgagaccattcaaaatcctctcttctatttgaaatatacaatatattattgttggctattgtcaccctactgtgcaatagagtaccagaacttattccttctatctacctgtaacattgtacccattgaccaatctctccccatctcccacttcccccttatcttcctagaatcactaatctcaactactatgagatcaaattttaaagattgtacataggactgagatcatggagtatttgtctttctctgcctggcttatttcacttaacataatgtcctccaggctcatccacgttgttgaaaatgacaggatttcatcttttttaaatggatgaatagtattccattgtgtatctatatcacagtttctttatccattcatccattgatgggcatttaagttgattttatatcttgactattgtgaataatgctgtcataaacatggggatgcagatgtttcttcaacatgctgatttcatttctttttggtatatacccagtagtgggattgctagaaaatatgatagatctatttttaatttttgaggcatctctataccattatctctaatggcttaactaatttatattcccaccaacagtgtataagggtttctttgtctccacatccttgctagcacttgttattttgtcttttttataatagtcattctaacaggggtaagtgatatctcattgtagttttgattttaattttcctgatggttagtgatgttgagcatttttcatatacctgttggccatttgtaggtctcttttggagaaatgtctattcaggtcttttgttcatttttaataggattatttggacttttgctattgagttgtttgagttccttatatattctagatatcaatcccttgtcagatgtataatctgcaaatattttctcccattctataggttgtctcttcactctgttgattgtttcctttgctgtgcagaagctttctagtttgatgtaatccaatttctttatttttgcttttgttactcatgattttgaggtcttgtctaacaaattcttgcccaaattgatgtcatgaaatgcttacactatgttttcttctaataatttcagagtttcaggtcttaaatttaattccttaatctattgttcttttcttttctttctgtctttcttttttttttttttttttttttttttgagacagagtctcactctgttgcccaggctggagtgcaatagcacgatctaggctcactgcagcctccacctctggggttcaagtgattctcctgcctcagcctcccaagttgctgggactacaggtgtgccaccacacctggctaattttgtatttttagtaaagacggggtttcaccatgttggccaggccggtctcaaactcctgaccccaagtgatctgcctgccttggcctcccaaagtgctgggattacaggcatgagccactgtgcctggcctatttgactttcatacgtggtgagagatagggggtctaggttcattcttttgcatatggatatccagttttcccagcaccatttattgaaaagactgttctttacccatcatgtattcttgccaacttcgtagaaaatcagttggctttaaatgtttgggtgtatttctgggctctctattttgttctattggtctatatgtctgtttttatgtcaacacaatgctgttttggttactataactttgtagtataatttgaaatcaggtagtgtgatgcctccaggtttattctttttgctcaagacttctttggctctttgggattttttgtggttccacacaaatcttaggattgtttttctatttctgtgaagaatgacattggaattttgataggaattgcattgaatctgtagattgctttggctttaataatattaattcttcaatccatgaacatgaaatatctttccatttatttgtgtcttattcaatttctttcatcaatattttatagttttcattatagagatctttcacttccttggttaatttatttctggacattttttgtagctattgtaaacgtgattgctttcttgattgctttttcagattgttcactgttggcatatagacatgctatcaattattgtatgttgattttgtagactacaagtttactacattcatttactagctctaacagttttttggtgtagttttggcagttttctatatataagatcatgtcttctgcaaacagggacaatttgttttgtttgtttttgtttttgtttcgagacagtgtttcactctgttgcccaggctgcagtgcagtggtgcgatcttggctcaccacaagctccgcctctggggttctagtgattctcctgcttcagcctctcgagtagctgggactacaggagcgcaccaccatgtctggctagcatgtgtgtgtgtgtgtgtgtgtgtgtgtatttttagtagagatggggtttcaccatattgccaggctggtctcgaactctggacatcaagtgatctgcccgccttggcctcccaaagttctgggattacaggcataagccattgagcctggccaaacagggacaatttgacttccttctttccaatttggatgtcttgcctaattgctctggctaggacttccagtactgtgttgaatagaagtggtgagggtggatatgcttgtcttattccagttcttaaaggaaaagctttcaacttttccccactcagtttcatcttgtttgtaggtttatcatataggtatgctccttctatactttgttgagagtttttatcatgaagggatattgaattttgtcaaatgcctttactgtgtctattaaaatgataatataatttttgtccttcattcttaatttgcatatgttaaaccatccttacatcactgggataaatcccacctgatcatggtaaatgatcttttaatgtgctgttgaattctatttctagtattttgttgaggatattggcctgtagttgtttgttgttattgtgcttttgtctggttttgggatcaggataatgatcattatcctcctaaaataattttggaagagtttcttccttttcaattttttgaatagtttgtgaagaattggtattagttctttagatgtttggtagaattcagcagtgaagccattgggtactgaacttttctttgatgggagactttgtatttttgcttcaatcttgttgctcattgttgatttgttcaaaatttccattttttcttgattcaaccttggtaggttgtatgtgtccaggaatttatccatttcttctaggcttttcaatttgttggcttatagttgttcatagtagtttcttataattctttgtatttctgtgttatcagttgtaatgtctcctttttcatgtctgatttatttctgtttttcttctttattatcacttagtctggctaaaagtttattgacttttttttatcttttcaaagaactaactaactcattatactgatcttttgtattttttagtttctattttgattatttgtgctctcatctgtattcattcatttcttctaataatttggggttttgtttgttcttgtttttctagttccatgagatgcatcattaggttgtttatttgagatttttttttgatgtaggcatttattgctataaacttttctttaaggactacttttgctgtatcccataagttttggcatgttatgtttccattttcatttgtttcaagaaattttttaacttctcctttaatttcttcattgacccattgtttgtttaggggcatgttctttaatttccatgtatttgtacagttgttcctcctgttgttgatttatagttttattccattattggcaggaaaaaaatacttcattttaaaaaagttagttaagacttgctttgtggcctaatgtataatctcctggagaatgttccatgtgcagttgagaagaatgtgaactgtgtagctgttggatggaatgttccgtaaatgtctgtttgctctatttggtctacagtgcagttcaagtccagtgtttctttgttgatattttgtctggatgatctgtccattggtgaaagtggggtgttaaagttttctactattatttcattgctgtcttcatttcccccttggtctattaatgtttgctttatattaggttggtgcaaaagtaattgtagtttttgcccttacttttaatgagactagaaaatacaaagatcaaacattaatatatttaggtgctccaatgttgggtgtatatatatttatgcttgttacattctcctgttgtattaacttctttactattatataatggccttgtttgtcaatttttttttgacagattctcgctgtgtgcccaggctggagtgcagcggtgcaatgtcggctcactgcaagctccgcctcccgggttcatgccattctcctgcctcagcctcccgagtagctgggactacaggcgcctgccaccatgcttggttaatttttgtatttttagtagagatggagtttcgccatttggccaggctggtctcgaacttctgacttcaggtgatccacccgcctcagcctcccaaagtgctgaaattacaggcatgagccaccacgtctggctgtttgtctctttttatagtttttgacttgaagtctattttatcagatataagtatagctattcctgctttctttttgtttacatgtgcatggaatatctgtttctatcccttcgctttcagtctatgtgtgtccttacaggtaaagtctttctcttaggcagtatgtagttagatctttttttaaaaaaaaattcattcagccaccctatgtctttttttaaatttttttatttttatttttattatactttaagttttagggtacatgtgcacattgtgcaggttagttacatatgtatacatgtgccatgctggtgcactgcacccactaactcgtcatctagcattaggtatatctcctaatgctatccctcccccttccccccaccccacaacagttcccagagtgtgatattccccttcctgtgtccatgtgatctcattgttcaattcccacctatgagtgagaatatgcggtccaaatgtccaacaatgatagactggattaagaaaatgtggcacatatacaccatggaatactatgcagccataaaaaatgatgagttcatgtcctttgtagggacatggaggaaattggaaatcatcattctcagtaaactatcgcaagaacaaaaaaccaaacactctatgtcttttagttggagaatttaacccatttgtattcaaggtaatttttgataggtaagaacttggtagtgccatatttttacttgttttctagttgttgtgtagatcctttgttcctttcttcctctcttaatctcttcccttgtggttaagtgattcttctatcagtatgttttaatcccttgctttttatttttagtgtatctattataaaaatttttgctttgtaattaccatgaggcttacacagaataccttatagttataacaagttagtttgaactgataacaacttaattttgattgcaagaaaattttttaaaaaatcgactcccaaattttgtgtttttgatgtcatcatttacatctttttatattgcttattctttaacaggttatggtaattatttttatctgttttgttttttaatcttcctactaaggatataagtgatttatgttctacaattaccatgttagagaattctgaatttgtcgggatacttacttttacctgtgggttttataccttcagatgttttcatgttacacattaggacctttttctttcagtttgaaaaactccctttagcatttcctgtaaagcagatcaggttgcaatgaatttcctcagtttttttttgtctgaaaatatttttctctctctttcatttatgaaggataattttgctgtgtacagtatccttggctggcaggtgtttttttttttttttctctctctctcattctctcctggcttgtaaagtttctgctgagaaattcacagttagtctgatagcggctcctttacaggtgactatatgcttttctcttgctatttttaaatttttttctttgacttttgatagtttgactataatgtgccctggagaagacctttttgcattgtatttatttgggtatttttgagccttctttatctagatgtctaaatctcttggtagacttggaaatttttcatctaatatttcattaaataggctttctaacctcttcattttctctttgccttctgggacactgaagattcaaatatttggtcactttatagtgcctaatatgtcatgaaatctttgctcattttttaaaattcttttttctttatttttgtctgattgggttatttcaaaagatctgtatttcagttctgatactcttctgcttggtccggtctattgttgaacctttcaaatctattttgtatttcattcaatgaattctttggttccagaatttttgtttggttcttttttgatatctatctcttgggtaaatttctctttcatagcctcaattgtttttctgtgttctttgtatttttttcagaattctcttgtatctcactgagtttatttagtatcaaaatttggaattatttttccaggatttcataaatttttaaagagatgttggccagtttacttaaaaaccaatggtcacatatactgttttgcttgtaaactatgatttttttattttgtggatacatagtaggtgtatatatttatggaacacatgagatgttttgatacaggcatgtgatgtgaaacaaacacatcatggagaatgaggtatgtataccctcaagcacttatcctttgagttattaacaatccaattacactctttattttagaatgtacaattaagttattattaactatagtcaccatgttgtgctatcaaatagcaggtcttattcattctttctatttttttgtacccatcttaaattttttttatttggatctcttgctacagaattattgtgctcctttggagtgtcatagttccttgatttttcatgtttcctgtgtccttacattgatatctgcacatctggtgtaataatcactttttccaatttttaaaatttgcttttgtaggaaagaactttttcctgaagatgtatctgtggtgttgcttgggtagagcacttcggttttgattctcggtgaatgtagtagcctctgtataagattctaaacagcatcagtgatatttgtgattttctcagtggcttagggtgtggttattagtggaggctgtggtgaagtttttctgagaagtgggatgccaggtaggcctgtcttcaggccccaatggtggcagcagtgggctgagtgtgcttgtctttggtgtaccatggtggcatatgattgcactggttttaggtccaggcaggttgatttgtgggcctccaagtggtttacttgggtgccagaagtggtattgatggatcacatgggtgggtgggttctcaagttcctgggcagcaaagtggcatggttgatggcaatcatagcaatgaaacaacctgaatctcaagtggtctgtgctggcgttggttgtggctgctatggatcgcatggccagtctccagaccctcaagtggtgcatgcagtgagtgctaactgtggcagtagtggcaggttgagtgggcctgacctcagaccccaggaggtgctcaggtgccaccagtggtggacagggctaagtgatccctaggcccctggatgatatgcttgggtactgggggcaggtagagctgggctacgtgaacctgccctcaggctccttggtggtgtgtgaggtgctggttgtgctatgcaggggtggggtgataccgaggtcactagcaaaatgctcaggttggggtgcagcagtagctgtgctatagccctgctcttggtgaaggtggggttgctttctcagggagtagctgtaggcaggtagcttgggagcacaaggttcactagtgttttggccccacagcagcctgcagcagcagtggttgtaggtagtggaatttgttcttggaatatgtgaaaatgcatgggcactcctctgctgggtggggcaggatcactgctcagggctcctgcctaagtcacggccatcatagcagggcaggatgtgtgggctgtgttctcaaaatggtgctgtgctgcagctgcttgggagaattgcagaatccagcgtgagctctctgttgcaatgccttcacacggtctttaggcaactccctatgctagtctctgtgctgtcaaggaataaggcgctctcctgtggctaggattgcaagagtccttggtgaaaatgaggaacactaagggtctcttaccttttccccacattaggaagctgttccagactcccagccaatcccaggcaaacaggccttatttctctctcctcccttgctttcaatgcttcctgtcactgctctgttgaattccagtgttctctcttagatgacctattcaaagtataattatctacttgctactttggttcctctccatggaagggatgaacactagatgcatctagtcaaccatcctgaagcccctcctgattgtatttttggataacctgtctttgagcttgctgatcctttcttctgcctgatcaattctgttgctgatgtcttgtattgcatgtgtcattttttattatacttttcagttccaggatttctgactttttttattccttcaatttctctgttaaatttctttgataaacttctgaattgtttctctgtgttttataaaagtttgttgagttttcttaaaatagctattttgaattctttgtctaccagatcattcacctgcatgtctttaggattagtcactggcacgattttttgttcatttgttgaggctgtctttcttaggctattcttattctttgcagatgtgcatccctgtctacacattgaagaattaggtatttattctcatgttcacagtctgggtttgtttgtgactgctctatttcagtgagctcgtttagaaattgagtggggctgagtgtggtggctcatacttgtaacctagcactttaggaggctgaggctggaggattgctttaggtcaggagttcgagacccagcctgagcaacatagcaataccccaatcttccccaccccacacacaaaacccgaaaatttagccaggcatagtggcacacacctgtagtcccactctggaggctgaggtgggaagaccgtgtgagcccagccaggagttcaagactgcagtaatctatgatcgcaccactgcactccaacctaggcaacagagaccatatcaaaaagaaagtgaaaggactggctgttgtatttccttttagcacgagagggcgccctgagcccaggttagacgcaagtctcatgctggctctgctactaattagtggagatccacagagggcactcaggccatacgggagagttttccggtgtaaaaaccgtgggtccatggtgactttccgcctgtggtactgcagtggcttgcgggtggggtctcagtcataaagaaccaatcccctttatgtgcaactatggttttactcgtctttgcagtccaaaagggcttcacagtcttgctcatgggttcaggttttcttaactcttctgaaggtaatttcacgcatcgagttgttaccttgatgtttctgtgaggagattattgctgaagagtcctattccaccactttgctccactcagcatgcactacttaatcacaagcaggagatgaaggcccggaaagaagacaatagaagcccaaacccctctcctcaacctttatctagtagaccacagtgtccttataattcagcagtcagcaccttttcttataaacgccagatggaagagatgcatatataaggaagggtatgtgggaaggggcatggggccagccactctccaggaacctccatgcgttcagctactcagaagctcctgatgggcaattctaatatgaatatttatctcttttaattcttatcatttttctatcatttcttgatgttaaaatctgctttaaaacacacagttgactcttgaacaatacaggtttgaactgcatgagtccacttatatgcagttttttttcaataaatatagtgagatttttttggaaatttatgacaatttgaaaaaactgtcagatggaccacatagggtaaaaatatcaaaaaaattaagaaaaaggtatgttatgaatgcaaaaaatatatggagatggccggatgcagtggctcacacttataatcccagcactttgggaggccaaggcgggcagatcacgaggtcaggagttcaagaccggcctggcaaacatggtgaaaccccatctctactaaaactacaaaaattaggtgggcgtggtggcacatgcctgtaatcccagctacttgggaggctggggcaggagaatcgcttgaacccaagagggggaagttgcagtgagctcagattgtgccactgcactccagcctgggtgacagaacaagactccgtctcaaaaaatatatatatatactttgggaggccaaggcgggtggatcacgaggtcaggagatcgagaccatcctggctaacacaatgaaaccccgtctctactaaaaatacaaaaaattagccagtcgaggtggcgggcgcctgtagtcccagctactcgggaggctgaggcaggagaatggcgtgaaccccggggggcagagcctgcagtgagctgagattgcgccactgcactccagcctgggcgacagcaagactccgtctcaaaaaaaaaaaaaaaaaaaatatatatatatatgtatacacacttatatatacatatacatgttgatactagactattttatcatttattaccataaaatatacaaaaatctattataaaaagttgaaatttataaaaacttacatacttacaaccatacatggcaccattcccagttgggacaaatgtaaacaaacgtaaagatccagtattaaatcgcaactgcataaaattaacggtagtagccatctcctattgttattgtgctgagctcgagtgctgcaggcatccactgaaaactctgcatgatgctaatcatctctgcataagcatttcatctctccataaactttgaaggatacttgggacccgtataaagtgccactagtgatgctggaagtactcccaagaagcagagaaaagtataaataacattttcctttctctagcttactttattgaaaatatacagcatataatacatacacaaaatatttgttgtttatgttattgataaggcttctgatcaacaataggtcattagtacttgaatttggagggagtcaaaagttatacatggatttttgactgtgcagggggttagtaccccaacccccacattgttcaagggtcaactatattctcaaccacattttgtttgaccttatgaaagattttatctattcttagtactttctattgagtttctattttgaccattgtgtttataatttttatgagcacgttttgttatgattgtttttcatagaatcctattgttaccttatttttaagtttctttttattgatgtaaaatatacatatgtaatttgccatcattaccatttttaagtgtacagttcagtggtatatatacataatggaatactatttggccataaaaaagaatattttcatttgcatcaacataggtgacactgcagggcaataccacatgttctcactcacatgtgggagctaaaagagtggatcttgtgaaaatagagagtagaatcgtggttaccatagtctggggtggggagggtggaggtgatgaaggtgccagttgggacaaatgtaaacaaacgtaaagatccagtattaaatcgtaactgcataaaattaacggtagtagccatctcctattgttattgtgctgagctcaagtgctgggattacaggtgttccagtaagtggtcagagccctgcctgtcccaagtgggtgaggtcccaaagggattatcatagcagtgttggaaggccagctagtgattcatgccaaggtgacctgtaggataaacctgctacagcatggtgctgctgcacggccattctgaatttgcatgtctttggccaaattatagagcagaatttccagggctggggatggtagtccttcctccctcatttgtctctgcctgtactctgggatatttctgccttcagacagtcatgatgttttctgtgggttaaggcaaggacaaatctccccccagggaacccaagaaggtggagaagctggttgaacacctcaatgtcactttttccagtgtagaaaccatgagttgaggggagattttccatacacttggtgctgggcagaataggaggaaggagagtcatggatgtggaagtctgattctcaaagttttttcacttctctgtggctccgggaactgtctcatcctcacatgtgagctctgggttgttgttggtgtagatattggtgctgtatgtttggttttggttttctgtgagagggagtaaagccagcctgcctctatgcccctattttaaaactggaaggcatcttattgttactttattgatgcagtatcttcttgaatctttatgaaaatagaagtaagagcttccgatgagttctgttctgagccatagctttttttattctgggattattattttctttgttcatctttgcatatcccttccatattttaggttctttttaaatgtctgttcatccttggttgcccactcacatttaagaaaaggaaagaaaaatctgactgtgggctgtatgtacatgggtaagccttcattttcaggtgaccaaaagaggaattgcctactatacattaagatccccagaggccagagatcttcaagtattcagtgggctatatcctctgagatgccgagctgtttgtgaactgaagtacagaactctggtgctgaatttggaagaccctgaggattgttgagcaggtgtgtacatacctggcagagacctgtttacataaccattgactgtgtgcattttaggccaggcccgagcagatgcagcatccctatcctgcatcaaggagttctttgtttctgagtgccaacttttccctgatgagagagaaggcaaagatagagtcagctaagcatgtgtctcatgaatgaccgcctcccctttctccttccctgctcccagtgtgctcacaccttaagcatttttgtcagcaaagtaggcacacagcacttatcctctcaaagtcagtgtgagggagggagaagataattatgtaaaggcagacatctcttgctcaaactgattttctctccctccatttgtccatgacaataagtgggaatggataataatagaagacagaatattggttagcttgaggcatcaggattcaattctttttattagctgaattatttaaaagaaagcttatgaaaatcatcctaggggccgggcgcggtggctcacacctgtaatcgtagcactctgggaggctgaggcaggtggatcacttcaggtcaggcgtttgagagtagcctggccaacatggtgaaaccctatccccactaaaaatacacaaattaggcgggcatggtggcatgtgcctgtaatctcagctactcaggaggctgaggcaggagaatcacttgaacctgggaggtggacgttgcagtgagccaagattgtgccactgcactccaacctgggcaacagagtgagactcgatctcaaaaaaaaaagaaaagaaaaaagaaaattgtcctaggaaaaaggctgtctgtcagtccctgtctccgttataattgcttcatcccagcttatatttatgaaaccccaggaacctgaaagctccctaacactgtctctgaaattgataagggctgaagcactggaaatactattgaacagtgactccctggagttacccctttgtgtgaaggactggtagctagtgctaaaactttatgaggcagccattcatttgttcattcattcaaacacatatttattgagcactactaattgtagacactgatgatagagaggaagatacagcctctgctttcaagatgcttacactctagctggaatcgtcagagaagctgataattataataaagagtaaagagtgatataataaagatgagagtagggtgttacagggagcagagaggagaagaaatttcactttgcttgaagggaaaaagatatgagatcaaagaagataaatattaaataaagtagaaaatactgatatagtatgataaggaataagctcaagatgctgtggaaatataagcaggcatctaatccagactagaggtcatcctgggagaaggaattaaggaaggggataactgaagtaagtcagacttaaagaaaaaggagaagcttacttagtgtaaagagggagacagatttttccaggcagaggaaactgcatatgcagaggtctcatgcaagaaaaagcattacatatttgggtgacatggaagataaggcaggaaatggaacacaacaaggctggaaatgtcaccagagaatagataatgcattttgcactttaccttgaaattgaattattttatttgttttgttgtttgagatagggtctggctttatcacccaggctggagtgcagtggcgcaatcacagctcactgcaaccttcacctcctgggctcaagtgatcctcccacctcagcctcccaagtagctggagtacaggtacccgccaccatgaccggctgattttttaattcttttgtagagatgtggtttcgccctgttgcccaggctggtctcaaactcctgggctcaagcaatctgcccacctcagcctcctaaagtgctgggattacaggcatgagccaccgaaactggcaaactgaagtattgtagaggctagagtgacaagatcagatactcacttcagtaagcttcctttgagagttatgagacagatcatgagggcctcaattaagaagatggcaatgtaaattgataagggggcaagaagaatattatgttactatgattacatagtgattacattaggaggaggaggaagaggcggaggtactaacactattgagggcctactctatgccacacagtgctctaggttacttaagtgaaatcactcagcactcacaacaatcttatgaaaaatgtactattatttccatttaggaaaccgagacacagagaggttaaataacttgccaaaggttgtgcacttaataatagatgaagataagagaaagtatttagaaagtagagcccaaagtatttgttgacagtcttaatgagggggatgaggccagtccgttatccagctcctctatcttcttacctcatagctgccagtggaactgaggttacgttttgttttcttggaattcatttttaaccccatctccttcattcctgaacagtaatgtaatttatgatctttctataatcacctcctcttaatagtagcagaggatttctttcaggaatccaaaattcagattaagactcactaaccttcatcaaatacagcaaaaagtagtataaatttgtgcaaggtctgtgtcttttccttggccagactccctgaaaaagaagtgagaacatttatcttctatttaaaaaatctcattgtaggaaattgtcactaggaggagacagttcttcatcagttacttgacagtaagaacaaatgtagtcttctgtctcttgataacttggctttgatgtcaggtctcctatagcagtgtttctaaaactatctggagcaaagaatttttttatttcaactttgatgaagaccactacttgtgtaaaatatgataaaaatgaattactaaagaaaaaaattaaaaacacttacaaaatacaagccctcacacactgtgtgataatagtgaaattatagataatttctgttactcttgtaactttttatacttctgcaattgtaaattaaaagttttgagtaaaatagcaattgtccatattaaacatctatactcatgattttttttcaatagcccacagtgcttctaattatactcacattttaaataaataccgtgtatatcgatagctgaagtttttaatggaacaaactagcttgtttcatgctttaactgttgagcttgttggctatctttcttagaattatatattttttaaatttgactggaaacttttgtttacaggcttattttgagtagaaagatttttgtttatgacattttgccgttctttctctctctcgcacccttaatgcttagaaataaaaattagcttggactaagaaagcaacagtacgtgtgctgctactcatcaggctgggataagagacatagataaagctaactgcagagttaacaacaccatttctcccaaggacacattgccactgtataaactcactgaatgccaactatttgctttgattatctcttgctttcttactcaattgagttgtttgttctctgaattcacagcctgccagaaatgtttgaactaatagcaacaagaatgaaacatctcattctttcctaggtcatctaaattactttgacacaaagaagcagctcaatttaaagctcaagcttcaggtaaggggtgccttgacttaacctttcatgtctatgttaactttttagaacacttcacagtctagacctcatggttatttctttacacacaactctactttgcttcatttaaatatcacctaacctccacccttccccaaaattctttactaactctatacagtatttccctttgtttagggaggtgtccacagtctcttgttgccatgagccaataaatctgactttgttgaactatagtgatctttgctgtcccttgtgatcattggttgattaagcaaaggatgtgttcactattctctatctagcaaatcataccctagaatggaattttggagatactggccaatggaaaccttggggatattgcagattcccccactgaaccaagaaaacttagttcagttcctattctaggactgggtttgctttcccctcttctaggactctgagtttccacaaagccatggccctaaacaaagagtgagcagcagctgtgctcagctctctttcaagtgaagaagagcccaactctatgatatgggctctcagtccctctggtggggagcactatttatccttgtcatcctgactccttggctaccgcagctggcttcctgacccagatctcagttggcctgtaatttccaccccttttactactcacagttcctgttctgcttctggtccacaaatatttatcttctttttcagctgaccatgcctattcgattttctctatttatggtttacctatctttgttgttggttttcagcgaggttggggttgaggtggaggatggaaaaatggctaagtaggaagaccctgtgccatctttaccagaagtactggattaaaaactttagagacacatttaaaatacgtataaagctgtcttaaaacattctaattacttttatataaattttcaattatagtgaaattgactttttcttttggtgtataggtctataacttttaacaaagatataagctcatgaaaccccatcatcgtcaagatacagatccatttcaatatccaaaaagaactccctcctgctatccctctatagtgtacatctaatttcacaagaaactgccagagactgtttctctaccaagcagcaaaactgccattctgttttccagaatggctataccattgtgcattgtgaaactttctgttgctctgaattcttgacaggattcttggcaattttatattattattttagctattctaatagatacatcactgttgattgaatttgcatttccctaatggttaatgatgttgaacatcttttcatatgtttgtccatataactcttgctttataaaagacaccattaaaagaatgaaaaaacaaactatagagtgggagaaaatatttgccaatcacataactggcaagggatttatatccaaaatgaatttcatattcagacttaagttccatccccaagctatctcattatatatgtgcaaatattccagtatctgaaatctgaaacgttcttggttccaagcatttcaggtaagggatactcaatcagtattttgcatgcagatattcacctgtttcagcactgtttattgaagacactattctttcccctattgaatggttttggcactcctggcaaaaatcaatgttgtgattacagatttgtactacttcaactttcttcatattcatgtttgcatcatatatccttttccatctttatgctggtaacctacctatatcatttttttgaaatgagtttcttgtaaacaacatataattggttcaagcttttatatccagtatgctaatctctgtttttaattggtgtgttttagccatttgcacttaatgtaagtattgatatgtttagatttaagcctatcattttattatgattttactgcttcttctctctgattttcatctctccttacttgccttcttttgagttatttgaatatttttgatataccattgtaattagtttattgtgactttttactgtgtctcttggtataattttttattggttgctctagggattacaaaatacatacttaacctttcactatcatctacttagagtcaacattttaccatttgaattggaatgaagttgaatggaccataaagttttccttaccctcctcttgttatgctatgattcttttatgtattgtatctaccatacattaaaaaacctatctcacaatgttctatctttgctttcagccatcagacatgttttaaggaattctgtgggcgttagtttcagatgaaagtatgatttctcatatactgagttcagtttcatagtcataattaatgagaaagtgccaaaaccacagtgtgttatttatgggacgtaaaggctaatggaacatgttgaagactgtgaaactgagatttcccctcaagcaccagactggccactgcgttggactcaatggcactgcaaggggtttaaaacagatctgacactgaaactacatacctggatgtgtaggttgggggtgaatccaggagttaatgcacaactttatgggtttactttcctgggatcttttctctctgtcatctataaactttccagttctgtgagctcccttttttggttttctaaccagaagcttccaatttccacaactacatcatagctaaggtcaagcaatggaaggggaaagacagagagaaagtaatgtgcttttcccccaatgtcttagatctgtagctgtactgaatgaagaataatgttcccctccctaagtttttactccggcaggtttctgttgccagccactgtcattgccacaggcaacctgggactgaagcttgagagaatggtggaaaagaggacaaaaaccctaggggatttcccctcccacgctctctgagcatttagagttacctttctcactccttgaaaccccagagggtttgtcctggagctctctttgcaacatagtactcacttcgaagtctccagttatgttttaattcaggttaaggaatactagagtggggaaaaaggtatactcccccacaagtttggtaatactttcaattctagtgtcttttctctatatacttgttctatttgctttttagaaatttttaaatatctgggctttgcattttgtcaaggttttatagttaagttcaatgggaaataaagggtggagtgtgtttatccatttcacctggaactagaacctctgtagactctttagttcaactctgtgtcaaagaatcatttgggtttttaacttatttctttatatgtcatatgtaaacactaatgttttgatgatctcattgttccattagcctttacatcccataaataatacactgtggttttggcactttctcattaattatgactatgaaactgaactcagtatatgagaaatcatactttcatctgaaactattataaactacaaacctttctcatcttctccactccccgctcccatcctttttttgaatcacattcatcatcaccattcagaaagagtatggtgattcctgttaataaattctttgcctattccccatcaaaaggtggagtctccctttatagactggtcttagtgatgcattctaactaatagaatgtaggttatgtgagtgatttccaaggttacattagaaatcgtgaaacagcttctaatgggctatctcaggaccatataagaagtctggctaccctgtaaaacccatgtgagagagatcatgtggagagtaccatcaagccaaggtcaaagacatgtgaataaagtcacctttgggatgatttcagctctagccactgtttgactacagcctcatgagacacacttagataggccaccaagtcaaaacactgacaaattccatgagactcacagaaaccatgagagataataagagactgttgttgttttaagccactaaattgtggagttatgcagtaaaagataaatggaacaaggaaaaggtacagtgaagctgatttcaccataaaaaataggataaaaacaaattatgcaaaatttacttccctaatttatgctaaggtataaattaaaaacaggtttgattagaattattttagaatatattaattcaatccaaattaattaattttcagtaacatataaataaatgctgacttttcttagatttttatatacttttggtttacagatgacaaactaaccacctgaaccagtctatatgccattgatcacacacttggatgtgtttacctccatgaagttttcaaggaacctagctcaaagtttgcaaaaggcagaggacagtagaaatcactactgataaagcccacagatttgaagaggaaaatagcaatgctttgaggagagagatttaattctggaactcagctcctcctgatcccagcttagagtttattgtggttatatagaatgcatatctgcttctctcagaaactggattattctcctttccatgagcatgatgctagagtaaaaaagcctctttcaggtgaaggaacacaaatgctaactgttatagatagattcagttgtttgtacttctctgcttatttcatctcaatcctacgctttcatacacttaccttctctacatactagtagggctccaatgaggcctgaattcaagtcttttaccaggtccacatgagaaagatatgagtaggtaaggcacagtgggtcagaggccattggaccattctctttcaggacctgccagacatatgtatggcttccaccagggaagactttatcatcttctttctccctttgactggtctgatcatcatattcagctcctatagcaggaagaaataaaattgtcctttctatatccactgtacactcaaagaaacatgtcaagtttattgtcaccaataggttctacataagaaacggactttctgcatctttgttgttgttgttgttgttgttttgagacggagtctcactctgttgcccaggctggatctcggctcacagcaacgtccgcctcccaggttcaagtgattttcctgcctcagactccccagcagctgggattacaggcacgtgccaccatgcccggctaattttgtatttttagtagagatggggtttcatcatgttggtcaggatggtcttaaactcctgaccttgtgatccacccgcctcagcctcccaaagtgctgggattacaggcgcgaaccaccacacccggcctactttctgcatcttaatttgaaaaactaacaagcagcagccacaaatggggagaagcttcatatactccagaggatcttgagatcactaaccctagcatgagcagtaaaaactaggttctggttgatatctccacattctgttaaataataaattgcttccattattgcatctttttgcctaattcaattcaacaacaaatacactttgtcacagactctttggtaggcactagtgagggtcacggaacagtaagaaagagagatttaagaaaatttcttaaactttgttctttcctagtggtacaacactatgtttggtgggggacatagacatataaagatataattataataccatgtggaaatattcacctatttattcacaaatatttattgagttcttattctttaccagactcagctacaagctgaaaatataaagatcaagatagaagtctctatgcccttggagcgagcaacacagtggataaaaaaagtaaacaagcttcctactcttcagtaatgcttgatgaaggaggtggaatttgagatgaatcttgaaagacagatatatttgtgttctttttcatgtgtttaatataaagaatttaatatttttgtgagtggatgttagaaaattattcttagaattgcactgctactttcacttttttctttcaacacactttttatgatgatgcattttaatgtacattacaaatttcatgatagtccactcctatatactttagaagtcatctttaaaaaaaaattgcccacataaacaaaatgacactagcacacctgatccagttaatatcacctaatatcaatgcaatattcaaattttcttaattgcctcaaaggcatcctttgtagctagttggtccaaatcagaatccaacctaagactgcagattgcatctggttgtttaggcccatagtctcttttagtatggagtagtccctttttttctgacactcatttggtgaaagaaatttggcttgtagtcctgtagaatatcccatgctattgaatatgcctaagttctgattagattcaaattaaataagttttttggctaaaatatatcaaagatgatgctgagtccctcatattgtgccatatcaggggcagataatatctggccatcccatccttagtgacactaaaactgacctgtggattagcctgatacctccattctaaagttaacatttccacttacaatcagaaaaaaatcactgggatattattttggcgccatacaaatgtcaaattccacatcaggaattcacctaatgattgtaacatcagcttggatgtgtttgaagccaatcctagacaggatatcatttcatttatgagtattacaatatgtatctctattatataagtgttgtttttaatgtgatcattattttttcaatgatcaattactttgaactttgacaatgagagccttttcctgccagccccatagaggagtacagactgtatgtaaaatgcttaattttgtaaaataaattaagcaaagatgacaaaatgttaagatttggcaaagtgaggtgatgggcacatgtttgtttgttatattattttctgtatttatctttgtttgaaatatttcattaggaaaaaaataccctttttcccaaggctcacgttgtggtgggggcaggggcgggagcacatgttggaggttcaatgagaggctaacaatgtgtgaaacattatagctgtcttggggagagggagagtaaatggattaggggaaatgtagcagtagaatggctaggcaatgctgaaggcccacctgaggtgagataccattcagtgtgattgcgtgatttttatttcagctatgtccatccctttggttgttggtagaataggtggagaacagatttaaccaaggtaagtgacccagcccagaaagatttgagtctgttcctctccaggaatgggttgaacctagttttccttggacagaagaacttggccaaatctgagatgagccactgcatcaggagcagcaacttcaacatatgctaaacatttcactgttcaatagaaatataatgcaaaccacatatgtaattttaaattttctggtagtcacattaagaaaagtaaaaagaaacaggtgaaattattttaataatgtatttcgtttaacctagtatatccaaatataagcatttcaacttgtacttataaacaatgaatgagatatttttagtcttttttgtacttaacctttgaaatctggtgtatattttacagtatgtctcaagtaggactcaccacatttcaagtgcctgatagctcatggctaccatttgaactgtgcagtatagactctatggttggtgtcccctcattggataagatgtggccatttgggggtcccaaaaggtgttaccttttctgatgggtttaacttgagctggattttaaaatattatctccccataattgtgattttaaagctcttatctctccctgatgtcagcagaaaaaaaaagataaaattgcattggccactcgtttctccaccaatttttggaaaatttccccaatgttgaactacgaatacatgtaactctttaagatatagccaagccgagaccctccagatttgccatggcttcctgtctctgattatacagctacatgtttagggtaggatcagtggtatagaaggagcagataaaggtagattgtcctgcctttgcaccatgcctgcaaagagctaggcaactaagaaaaggacaagaccaacacccccttaagactcctataagatccatggcccacatgatatacatgaagtagtagaatcttgattttattatatttgggctccatcccctaagtataggattacctggtaataataggtcctttttctcataaatttcaaaatgctagtgcaagtactctcattggcctagcttgggtaaggtgcccatctctggaccaatcaactgtggccaaggaggtgggatacccgtgtcaactgctcactcctagatcaactgctatggctagggaggcatgggctttaagaaaatggcaggttctgtttgaagtatattcagaaaagcaattcctagggggtatacaggtgagaaatgtttaattttaggaagaaaaaatgactggtgtccactacaccctcattcttgtattgagtatctactatagggtaggcaatatgttatatgctaaggacacagcaataaataagatggatttccctatcttgagatatttataatctagtaaatgttaagaaatacacataatgttcagttaggaccttaaaagagttgtaacgccaccattacaaagcacacacatctcactgttctattcatagaatgacaggacaataggagggtattttactcaccctcagaagctttccagtaggatacaccaacagcatgaagactgacaggatgggaagccatgttcttaagtgtaatgaccactgtatcataaacctcagcctggatggtaggacctagcagacctgtaagaatgagatgtccgccaaaggttacttggggatagtactccagaaaacctgttattccaaaagttagagtcaaggtcacagtggagaagcatgcccctgtaattactgacaaaaagtagtatttgcttgctgccaacatcagcctaaccttatggttgctctgaggcaagatttctggcaatcattcaattcattcattcattcaactagagttcctactatattctaggaactgtcttatgcactggaggtgcagtagcaaacaagacagataatggagatcatattctcaagacattaagcacataaagaaataaataagaaaatttcaagttgttataaatataaaagatagtggtctgctagaaagtgatgaggcaggaggtagaggatactttcagtgtagtagtcaggaagggcctctctgaggaggtgacatttgagtagagatctgactaatgaaaaagaagcaagattttcaaagatctagtggaagagcattgaaaacagataaaacaaatgcaaacgtccagaggcagaaataagtttggtatagtcaagtaaagtgtggctgaagcacagtgaatcagcagaggagtaacagaaaatatggtcaaaaaggaaacataacatgtaggaccttgcaggccacaggaatttggatgaatttggattttacaagaagtaaaataagaagacttggaacttgttttggaggaacagtcaacaggacttgctcataaatatgatgtggagatagaaaaaaagagaggagtcaaagaaaactcctatgattttggcttgtgcaactgggttgttagtcaggccatgacagaaaatcaggaggaaaattaagagctctgttttatgaatacactaagtataaaatgcctataaacagtctgttgaatgaactggattgagtgggataaaaacataaaatagccttatttttcttagaccactgcttttaattactttatgtgagatctcccttttcttgcactttggttgatcccaaatcttttccagtaaccttcaggtattaaccaacagtatcactcttaggttctaacaagtccagtccagtctaataccaaatttttgatgtcttctgcaattgcaagttcccttccttctccagctacattctgacagccccagaaatctgcaatatgtaaaggtaatttgttttggcagcttcgctgctttcccaccttcctctcctaatcttcctccccaactcacctttgtgtctctggacctgccaaggtaggagcaagtggaaaggaggggggagggtaaaaacaaataggcacaatgacaaagtctttcttggaaggagcagtgataatgtggcattagtactccctagttgtgacacataccaaaattctgcctttctttcttagggaacttatgagttatttggagacctctccctgccaacaaggagacaccccactgctcctgatcttggcatgggatataccttctccagctggtcacttgtatctctcctctcagattctgcttctggcagtacaacccatacaggctttttctattggggttatctaatcctggcaggaagacctctcaggcagagtctttgtaagacaagtcccattcagtgaccttcctggccttacacctaacaatggtagtgcagttagctcccactattgcccactccccctgctattccatcaggagaagtccttttggcctctgaccttgaaaatttatccagataaaaaccaggcagtggtcagtgtctcccaagttccataggtaccttgtccagtcttctaagtggttctcctgaagcctccttcattataccttgacatgagggacaggcctcccactccccatggggtaagcaacacataaaacaccgaagaggctctccaaataataaatattcaaatctaaagtcttccataagttcctagcctttttttatacaaggttggaggtgagtcagggcctaagggttgcagaaccaattttggactactacctgaacaagttctaaatcgataggctgatatctctctttagaataaggggatacttcccacctataattctcagcaacaattctaagacagaaaatgtcctgtcataacatgttgttacatactttatttgacatctaagtggaggtaagcagttggcatagaccaagcagaggaagacggcccagcaaaaagacagaaaatgcagtcagtgtatttccctataggtagcagttagggaaacattctctttggcagctgcactttttaactgcaacctcaagattggggaatctgtgatagaaaataagatacccaatttcataaatagcattcaacattgttttcattacccatccagggtggccttggcttagcgatgttgaaaaggtgatccgtgaattctacaaacagagtctttttgtacacgactgaggtgttgaatggaaaagattttggcactctaggaggaaatctgcgtgaagaaaggaaaaagtcgttcattttggtggacacttcaaaaagcagctggaagtaatgcttccatactactcttttctactattagcaaggaggcaaatttgaagttgtatataaatccctaacatccattaaaccgaaacactgttttcacaactcaactgatacattaggtgccatatgataagaatcataaaatcaataaccatacactgcatcagccaaaaatcctttgccaaagcaatagctactgcatccttcaatttcatctctaaaacagactataactttcatctaagtaccttgtgttcaaattttgtcagtatgtacctaaaattatacttccctccttagggataccaggaatatcacagagaaaattacctttcagcagactatgtatattgaaacctactagtgccagaagctgtaattcagaatcagtcctacattaatgttcattcttgtctccactcagatactcccaattactcatttattcatgaaccagctactgaatcagaaattatataattacttatataaatgttcccaaaatgttattatttgcctccattgtcaaagcccttttaagcaaaggctggttcccaacttttcctctctccctgcatgacagtttagcatgtctgggggcctcctcacgccaaataatcaaaaggaccaatgtgaatcttggtgaataagggacactggccccaagtgaattggtagaaattacaaagtggttgaaggtgactatctccactcactagtttcatgtgctgatgagttttgcacaccatggagcagttctgcagctttctctatgccataaagagcctctcttcctgacttttatgcttctggacatctaacttttatctcccatcagattttaccagttggtatcatttcaacaagccaaaggcacaacacatgggcatttgggtaattaaggcttagttggagaaagcaaggctcctgccctggaaaaaagctttcatgtgtagatctaaaattgagcatttgccctccacagatatacatcgattcacttatgaaccgtatactacatgccactttgccataacaaaacacatcagacataaacatggaaaaggagagatttttaaagacatacacttagatgtgaagcagttgttcgagtcgcatgtcttattgactctcagggacttttgaaaagtggtagatgtgaaagatggagaacagcacaaataaatgcttggtatggcggaccactgaagaaagaaccccaaatatcatccagtgagacactccctccattgtcataaatgatggcaataatgataaagtgagggaaaggagaggcagcttctgattgtaagtattcatatgcttggagtaaaagccacaccatgcctcagattaccaggatgtggaatgaataagaaggggtctgggcatttatcacttgtttatttctttctcagtcttgtggtgaaataacaaaagtctcattgttcctttcaggagcagccacactggagaatcattcattcttgtaagaaattttgcttttcctttagtcagaatgctgagatagagaaggaaaatgcaatctaaaaatggtgaaaatggctaaattggtaaaccagtgacccatggggattttcttcaattttaataattgtggtaaaatacacataaaatttactatcgtaaatcttttttttttttttttttttttgacagggtctcactctgttgctcaggctggagtgcagtggcgagatccacctcccgggttcgagtgatcctcccgcctcagccgccagagtaggtgggactacaggcgtgtgccaccatgcccggttaatgtttttgtagagacagggtttcaccatgttgcccaggctggtgtcacactcctgggctcaagcaatccaccctccttggcttcccaaagtgctgggattataggcatgaggcaccatgcccagcccaagcatgtttaaatatacagttcagtagcattaaatattctggccaggtgtggtggcacacacctgtaatcccagtactttgggaggccagggcaggatgatcacttgagcccaggggttcaacaccagcctgggcaacacagcagtacctggcctctacaaataataataattagccaggcgtggtggtgtgcacctgtggtcttagctgctttggtgcctggggtgggaggatcacttgagcccagacagttaaggctgcagtgagctatgatcacaaaactgcactccagcctgggcaacagagtgagatcccatctccaaaaagaaaacgtgtaatatgctcccatctacctccagaattaattttatgttgtaaactgaaactgtataaacattaaacaataactctcacctcctccagtctctggcatccaccattctactttctgtatcattttgactactctaagtacccaatataagtggaatcatacagcatttgtcttttcatgactggcttatttcacttagcgtaatatactcaaggttcatctatgtcgtagcatgtgtcagaatttccttctttcgtaatgctttgtgtgtatataccacatttagattatccattcatctgtcaatagacacttgcagtacttccacattttagctattgtgaataatgctgcttataaacatggatatgatggttaattttatatgtcaacttgactgggctaagagatgcccagatacatggcaaaacagtatttctaggtatgtctgtgatgatgtttccagaagagaatagcatgtgaattggtaaagaagatcactctcaccaatgtgggtgggcattatccattccactgagggcctgaatagaacaaaaagacagaggaagggcaaattcactctccctgtttgaactgggacatctgtcttctcctgcccttggacataagcattcttggttctgccttctgactcagaccctgtacttttaccattggcatatatttacacacacacacacacacacacacacacacacacggatctgtttcattggagaaccctaatacaattgatgtataaatatctctttaagaccccatttcagttcttttgcatatatagccagaagtcgagttgctggatcatatggtaattctgtttaatttttagagaaactgccctattgtacatttgcaatagtgcacaagggttccaatttctccacatcctcaccaacattcattattttctgttttagttttgatagtagccatcctaatgggtgtgaggcagtatctctttgtagttttgatttatatttctctaatgattagtgatgttgagcatcttttctttctttccatctcaccacatcactatgggcctatttactgtagttcctcatagccagtacatcatgtccaccttttaacaagaaattacaaggcacactaaagggcaaaacccacaaaatttgaagagactgaacaagcaagcatcagaatcagagtcaaatatggcaggaatgtcataattatcagaccaggaattttttaaactatgattaatatgctaatggctttaatgtaaaaagtagacaacatgcaatgacagatgtatatcataaggaaaaatatggaaattctaagacagaataaaaaagaaatgctagagatcaaaacactgtaacagagatgaagaatgtctttgatgggctcattggttgatgagacatggctgaggaaagaatctctgagcttgaggacatgacaatagaaacttccaatcaaaactgaaaagcaaagagaaaaaaagactgaaaaaaaaaaaaacaccaacaacaacggcagaggctatgcatgggcccagaatgtccaaaaactgtggaacaacaactacaaaagttgtaacatacacataatggaaatgccagaagaagaatgcagaaatgaataggagcaaatttttaaagcaataatgactgagaatttcccccaaattaatgtcagacaccagacaccataccacagattcaggaagctcagagaataccaaagaagatggatgcagctgggcgcggtggctcacgcctgtaatcccagcactttgggaggccgaggcgggcagatcacgaggtcaggagatcgagaccatcctggctaacatggtgaaaccccatctttactaaaaaatacaaaaaaaattagccagctgtggtggcgggtgcctgtagtcccagctattcaggaggctgaggcaggagaatggcgtgaacccaagaggtggagcttgcagtgagccgagttcgcgccactgcactccagcctgggtgacagggcgagattctgtctcaaaaaaaaaaaaaaaaaaaaaaagatagatgcaaacgagcaaacaaataaaaaaaccctacacctaggcatattatattcaaactccagaaaatcaaagacaaaaaatgttgtaagaaaccagatggggaaaaacactttatccatagaggagcaaagataaaaattacatccaacttcgcctcagaaaccatgcaaacaagaagagagtgcactgacatatttaaagtgttgagagaaagaaaaaacagtcaacctaaaattctgaactctgtgaaagtatccttcaaaaatgaaggagaaataaaaactttctcagacaataaaaattaaggaatttattgacagtagacctgcctttcaataaatatccaaagaagttgttcagagagaaggaaattgaatctacaaaggatacgcattacagaatgaataaatgaaaagaacatcagccacagaaacagcactaaacaaccaagtagactgaatgacttagccactttgatgcttaccagtctctgctgttggtgccccaattcttacaaaatggatgtatgaaaggaggagccatggcagaggctatgcatgggcccaacatcatggactcatcaatacagatctagctactgatgttgttaatgttcaacttgccagtaacagagaccaaagctaaggctctgatatgtcaccatttctcaagaaaatcattcagttgcttggtgagcctcagtaaacaccaccattcaaggcctcacagaatatttgatcttacataacactgcatcagaccaagagacctactttaaagcaagaagatacatgaccatggaatccactacccagaagctacccacttgatagagtggtaggacagcttgttgaaggcacagctgaggcactagcttagacataatacctaaggacgaggcaccatcctgcaggatgcagtatatactctagatcaatggccatcgtttagtggggtgtgtcccgaagtaaaatatatggttttggaaaacaaggagtgtaagtaggagcagcctcacactaccattactcccagtgacccaattagggaaactatgcctcttatcccaactctgggctctgagagtttagaagtactggttcttaaaaggggaatatgtccgccagtggacacaccaagagtctcattaaacttgaaactatggttgccatcatattacttcagatcactattaagagaccaagaggtaaggaaaagagtcactatcctggcaagcgtaaccgatcctgatcatcaggaggaagggctgacattacacaatggagacagaggagaatatatttggcagccaggtcatctgcctgggtatctcttagtattcccttgttcaatgttgatgataaatggacaagtacagtcatggcttacaaagggcatgatgaccagataccttatctggtaacccacttggagcagcagaagtatgaattgagagggtggtggggggagggatctagaatgggtagtagaaggggaagatgatgagtaccagttgcagactcaagaaaagctaaagcagcaggagttgtgctgtgttccaaacctttctcttttgtttccccaggaaagggagcccatcagaatcctgaaggaaccattccagaacttatgaagcaaatgaatctgagcagcagaaagggtggaccacagtggaggctggtgtccagattcaccgcttcaggactaaagcacttatttcctaagctgctgggtgtgctgacagctgacaactctaatctgaattcctctctgagaaccaattttggctgaagtcagtcaccacatccaaactcatgccttattcctggtaaaggtgggactatataggtccagacaacttgcctcaatagagaacatctctgcagagccatcctagcttgagctccctgtgggactgacctttattcagactgtatcacctcaacttcttttacccaatcctgcttccttcactcccccatgggtgttgatccagaggatccccctcctataaactttctgcatgcaagaaaaaaaagagagaaaaaaggagaaaaaagcagacaataatttttattcatgtgcttaaaaagttgtaaaatcacccaaggaagcacataagttgtcagtatgtgaacaatgttggaaacattttattttgtctgatttcctttgggagaattcattgccagctataaatctgtggaaacgctgccacacaatcttagcacacaagattggcagaaaatcgcttagaaacactgaaaacatgtgacaaagtgctttccgtgaaaagggtggatgcgaagcagtaaggacccccttcatgaagcacgcggtcaccctccagccaccagaaccagaggaacgctgtggtaactgagggaaaacgcatctaggcacacgtcacggtggcaccttccagcaggtccccggggttgtgcccctggagctctgacaaagagtgtggcccggaaatgtgatgtttggactgcaagttttggtgagaaataacaatgcatcaggttgcagacaaagcagaccctgctctgtgcgtttatgggagccgcgcccaacaggaaccacagggaatgatcgaaaggagagggacggacacaaacagacacaccagagagaggttctcaggaggaggctctgtggcctccagaccacgtcaaagccaaggcagaaaggatgaactgaggaaaggaggaaaatttccccttaaggaaggtaaaatccagaagggatccctaaaatggtgagcagtttaaacctagcagttttgcattaattcacataaagtataatgaaaactgttggacacacaaggagagactggccaatctatagtcacagaggaagaccttcacaccccttcacaggatctcgcagcagattggctgaaaagtctccttgaaactgcagacctctctcaaggagacccactgagttgggcaaaggtggggccgacttaattcttgcctccctgctctcccacgtagccctgcatttcactccattccagggtttctgggacacccgagaaagcacgtagtccagggagcacgtctgccaactgaaggccttgacaaatgactttctgtactggctgagggccagggcccagcgtactgataaggaagctcttccagaaaaaagttgggacaaaggcatattagtgagtggacacaaactagaaaaatctccaagtaatacgttaatgccaacagaaagcatccatcttgaaggaagcacaaaccaacaacacatataaaaatgactctggcaattcacatcagctagcctctgcataggccatcgcagtactggcaagacatgagctaagtggctacagcagcagggagagaattaatgcatggacccaaaagcgtggcttcccactgactaaggctgatctagctactgttgccaccaaagtccaacctgccagcaacaaaaatcaatgctgagctcccaatatgccatattgggcccaacccctgggcccctgaccagtactggtctgtggcctgttaggaatggggtcacatagcaggaagtgagcagcaggcagggagcaaagcttcatctgtatttacagcggctccccatcacttgcattaccgcctgggctctgcctcctgtgagatcagctgctgcattagattctcataggagtgcgaatgctactgtgaactgcatatgcaagggatctaggttttgtgctccttatgagaacctaactaatgccgcatgatctgaggcggacagtttcatgccgtaaccattcccaacaaccccaaagtctctggaaaaattatcttccacgaaaccagtccctggtgccaaaaaggttggggattgctgcaatatggtattgtccatcacagagacaaaccagcttctcggtggccagacacactgaactccttccatcctagaaaggacaggacttcattgtgatacctaatcttggcgtaacttagcctttcctcccttcagggccttagccagcaccactatctgaaatcttacagaggatttgattcactgatgtggaattccatatagcaccgtgtagacctggggaatcattgtacagcaaaagagatgagggagtgggtccacaaccaggcacaggtagaactccagcttggaggcaggtctctgtgaggatggagggccagcctccaaggtgctgtatatgtatgaattcaaagatgattctgtgtccccactaagaagattacatggggtttgggaatcaaagagtggcagcaaaagaactctgattagcacccccgccaatgagccacgtggggagtctctgccgcccctccctgcagctctgggacccgcagcagaaaggcccctgcagcagaaaggcaagagtatacggcgggtgccacctggccccgccaggctaacccagggcaatgcagagcagtggcagggagagggggtgagggggaagaatggcaggggctgggggtgccatcacgcccagggcgcgggcaggagcgtgcagctgagccctgaacccacgacgacctggagctgagcagcaagagggtgaggggcgcccggatggcagtctaggaaagaactccccagtcccagccattgggtgtgggaagtcagccttcacctccgctgaggtgtgcgccgggattgccccagaggaatgttgcctgtgggggccacgcaccttccttcccaagacagaccacgcccctctaccagggcatgccccgcccatttccaggacaggccccaccccctctctgggcagaccacgcctcttcccagcgccgactctgccctgtcccaggatggacagcacttcatgagtgctcagtgcagggacacagaggcctggacatgttggtccaacctggaaggttcattccagctccagagctccctgtaagatccagcaaggctgtcctggagcctacccggcagcgcgcttctccctctgcctatccctgattcctcaggtgttgatcccaagaacactccaaataaaattcctgcatgttaatcttcatctcagagtctacatctagggaacacaaccagtaacattaatttttttttttttttttttgagacggagtctcgctctgtcgcccaggccggactgcggactgcagtggcgcaatctcggctcactgcaagaacattaatttatatttaaacatactctaatgtcatctacctctaaaaatttccatggcactagtcttaacataagcctatgtagttttcagtcatttaacattattatgcccttccacattcaccaactcatccctagtttgctacctttctcctttttccatatcatatccttggttccactacgtctatcctaccccctctctgtgcagtttccattgatttctaaggtatttcaacataagttaccacagtgctttcactttaaatgtttctgattaaaggccagacccaatggctcacatctgtaatcccagcactttgggaggccgaggcgggaggatcacctgaggtcaggagttcgacaccagccgggccaacatgaagaaaccctgtctactaaaaatacaaaaattagctgggcgtggtggggcatgcctgtaatgccagctactcaggaggctgaggcaggagaatcgcttgaacacgggaggcagaggttgcagtgagccgagatcatgccactgcactccagcctgggggatagagttagactctgtctcaaaaaataaataaataaataaataaataaatgtttctgactaaaatgaagatataagacacatataaaatatgttatagagcaatagattggaagatcagagagggaacaggatcaagagcacacagaaacactttttccctctctgagggaagagtgaaaacacataattgatggagaaacaagattgtgagacagaaaaacaaaaaggcctaggccctaggtcaagtatatgtgattcaggacaggactctattcaaagggaataactagatgttcctaagagcattaacaccctccaagtgtgtgattcagttctgagatgaacctattacaggacaatatccagctccccagcctgagacctttgccatttgagtgaatattttccacgctggcagaaacatgtgatttatttgcctgtctcactttcaggcaaatctgcatagtaaatgacaaaatgttccagggttcctgggttttactccttcctaacttttgtggggttttgtttgtgtatttcctttgggattcaatatagaaatcctgccaaatatatttggcaaccattgtccttgacatgaactgttctttcacattttatctaaaactaatcggaaaacctattatattccctgacctgtggttagaagaaactgagcagctgcgggaacagataatataaaactgaattttcccagctgtttatttcaaaccttggcagaggctgtcaggatgtgtccagagtcagcttatcctgttaatcagcatcaaaataatctaaagtataaaagggtttcattaaaataaaaattctatcaacttttttctggtaaatacatgtgactgcctatacaataacagaaagctagataataaattaatgatgtattccattcaattcaattttatactcaaactattattctctgtgcctcaggctgcatgctagatggacactaatatacacagtgtattaagtaaaattatctcaatattaattgttaacagggctaactttaatggataaatggttgtttagttagatgccaggctactgacaacctgggcctctactttcaaggtcactaacattgctcatctgcaggctatataggctgtagaacgaacttggatcccctcctcacaccatataccaaaattaactccaagtggatcaatgacctcaatgtaagaactaaaactataaaagtctcaaaagaaaatataggtttaaatcttagtgatctttgatttgacattgatttcttagatatgacaacaaaaatacaagcaaccaaaggggtaaaataaataaatattggatttcatcaaaatgaaaaactttgtgcatcacaggatactattaggaaagtgaaaatactacccacagaatgggaaaaaatattttcatgtcatagctctgataagggtataatattaagaataaataaagaacttatacaactcagtactaaaaaacaaataatccaattaaaaacacgcaaagcatttaaatagacatttctccaaaggagatacacaaatggtcaataaacacatgaaaagactctcaacaacgtaagtcatcagggaaatgcaaatccaaactacaatgagatatcactttatccacactaggatgagtataattaaaaagacagacagtaacaagtgttgataagaatatggaaaaattggaacactcatactttggtagtgaaaatgtaaaatggtgcagctgctttgaaaaagtctggcagttcctctaaaagttaaacatagaattaccatgtgacctagcaattatattcctaagtatattccgaagagaaataaaagcatatgtacacaaagacttgtacatgaatgttctatagcagcattattcataatagccaaaaggggaaacaatccaaaagtccatcaacagatgaatggataaacaaaatgtggtctatccatacaatggagtattattcagccataaaaaggagttaaattctgatacatactacaacatggaagatttttttaaattaaaaaatgaaaatagtttcattcttactatatctttattttcttattttaactcctctatcattctgcaaaaatggaagaatcttgaaaacatgctaagcaaaagatgctagacacaaaaggccacatattttatcccttcatttacatgaaatatccagaataggcaaaaccacagtgacggaaagtaggttaatggttgccaggggctggggaaaggaagaaaattagaagtgactgtttaatgattacagggtttctttttgaggtgatgaaaatattctggaattaaataaagatgatagttgtacactttacggattcactaaaaaccactgaattgtacactttcaaatggtgaattttatgatatgtaaagtatatgtcaataaaaatgtggagatttaggaaaggaaaagaatctccacactgaaaataagtgatttttacagtatgtaaatcatacctccaaggagtgaaaaaatggtaaggaaatattctgaactttatactattaaattcaacagctcagatggaatttcttttctttttttgagacagagccttgctttgttgctcaggctggagtgcagtagcatgatccatagttaattgcagccttgaactcttgggctcaagtgatcctcctgcctcagccttccaagtagctgggactacaggcatatgttaccacacttggctaatgaaaaaaaattctgtagaagtcaagtcttgttatgttgcccaggctgatctcaaactcctggcctagagcaatcctgctgcctcctcccaaagtgttggggttacaggtgtgagccaccatgcccagtctcaaatggaatttcttaaaagaaattattaaaatttatcctataagaaatagaaaattcaaatagccctttacctattaaaaatagaattcacaattaagacccttaaaaaaaaaaccaaaccaaaacaaaaaacactgggataagatgatttccctggtgaataaacatttaaaaaagaaatgataccaattctacacaaactctttcattaaatagaagagtgaacacgtctcaactcattttataagaatagtcagccgggcgcggtggctcacgcttgtaatcccagcactttgggaggccgaggtgggcggatcatgaggtcaggagatcgagactatcctggctaacacggtgaaaccccgtctctactatcagtataaaaaattagccaggcgtggtggcgggcgcctgtcgtcccagctactcgggaggctgaggcaggagaatggcgtgaacccgggaggcggagcttgcagtgagccgagatcgcaccactgcactccagcctgggtgacagagcgagactccgtctcaaaaaaaaaaaaaaaaaaaaaaagaatagtcttactctttgatatggtttggctgtgtccccacctaaatctcatcttgaattgtagctcccacaatccccatgtgctgtgagagggaccaggtgggaggtaattgaatcatggcagtggggttttcccatgctgttcacattatagtgaataagtctcatgagggctgatggttttataaagggcagttctcctgtacaatgctctcttgtctgccaccatgccatataagatgtgtctttgctcctcctttgccttccaccatgattgtgaggcctccccagccatgtggaactgtgagtccattaaatctctttcctttataaattacccagtctcgggtatgtcctcatagcagcattagaacggactaataccactcttatatcaaaaccagacaatgacattataagaaaatcacagccaaatatccatcatgaacacagacgcaaaaactaaaaaaccaccatcaccaccaaaacccttaacaaaacagttttagttggccagggctgccataacaaaatactagagattgggtgacttaaacaacagaaacttattttctcacagttccggaggctggaaatccaatatcagggtgccagcacggtcagtttctagtggagccctcttcccagctggtagatggctgccttctcgctgtatgttcacatggcttttcctcagtgcatgagtgtagagagagaaccttctctcttcttatgaggccaccagtcctatcagattaggactccatccttatggcctcatttaaccttgtttacctcctaaaagccctatctccaaatataatcatcttgagagttaggacttcaacatatgaatttggggtggggggaggtggagacaattcagtccatagcgaaaatattaccaatgtaatatgtcacaaccaggtggattttttccctgggaatacatagctagttcctcattaaaaaatcaatcaaggtaattcaccataacagaataaacaagataaaccatatgaccatttgaatagatgcagaaaaagcatttgacaaaatctaatatcaaatcttgataaaaactctcacaccaagaatagaaggaaacttcctcaatttgacaaagggcatctatgaaaaaatttacaagtaattgtacttaatggtaaaataatgaatattttccctctgaaatcaggaagaagacaaggattctgctatcatcagttctatctaacattgtactggaggcccttgccagtacagtaaggcatgaaaaaaaaaataaaaagcatccagtttggaaaggaagaagcaaactgtctttatttgcagacaacattattgtatatgtagaaattctaaaagaagtgcaaaacgctactagagctaaaatgcaaattaacaagattagagtgaacaaggtcaatatacaaaaatcaattgaatttctatattttagtaacaaatgattggaaaacgaaaacaaataaaaatgatacaattaacaatagcatcgaatccctcaaaatacttggggatacaattaatataattcttgcaagaactactctgtaggctacaaaatatcctagagggaaattaaagaaaatttaaagaaacaaagccataccatgttgttgtattgaaagattcagtattgtttaaatgtcaattctccccaaattgatctacagattcaattcaattccagtcaaaatcccagttggctatttggtggagttggctagttgactataaaattaatacagaaatataaaagcctaaatatatcaaaagcaatttcaataaaaaagtaagttggaggttttagactgcctgatattaagacttactataaagttacaacaatcaaaacaatctggtactggcataagcacagatatacacatctatggaactagagaatccataaacagatttgcctatatacagtcatttaattttctacaaaggcaccaagggaattcaatagagaaagaaaagtcacaccatacagaaaatttaactcaaaatgtattataaacctaaatactaatgctaaaatgataaaagttctagaagaaaacagaagaaaggctttgtgaacttgaggtgggcaaagatttcctaggacaggggaaaaaaaagcatgaatcatagaagaagaaaagctaaattggacttaactacaactataaatttccactatttgaaagacaccatttggaaaatgaaaatgcaagccatagattggaaaaaaacattcaaaacaggtacctctgaatagtcttgtacccagaatatataaaaaattatcaaaactcaacaataacaagacaaacaacccaattaaaaactggcaaaccattatcctaagtgaattaacacaggaactgaaaaccaaataccatatgttctcacttagaagtgggagctaaatgatgagaacacatggacatagaataatagacactggagacgactagaggaaagagggaggaggaagggtagcaaggagtgaaaaaccacctattgggtactatgttcactacttcagtgacaggatcattcattcgtaacccaaacttcagcaccatgcaacatactcatgtaacaaacctgcacatgtacctcctcagtctaaaataaaagttgaaactacgtttaaaaacaaaggaccaatgatttgaatagacacttccaagaagatataggaatggctaattagcacatgcaaagatgctcaacatctttagtcatcagagacacgcaaattaaaagtataaccaggtgcagtggctcaagccgtaatcccaacattttgggaggccgaggcgggtggatcacttgaggccaggagtttgagaccagcctggccaacatggcaaaaccccgtctctaccaaaaatacaaaaattagctgggcacggtggcgtgtgaccatagtcctagctactcaggaggctgaggcatgagaattgcttgagcctaggaggcagatgttgagctgagattgcgccactgcactccagcctgtgtgatgggatgagattccatctcaaaaaaaaaaaaaagtatagtgagataccactgtgcagtcattaagtactggcaacatcaaatgttgtccaggatatattgcaactggaactctcatgcattgctggtgggagtatagaatggtacgttcaagaaatctgtctggcagtttctcttaaacatgcacttaccatatgatccagcaattccactcctagatatttaactaagataaatgaaaatagatgttcacacaaaacatgtggagcactgttcatagcaggtttatttgtatttgctcctaactggaaataatccaaaattatgatataatcccataatggagcagtaatcagcaataaaaaggatagaaatactttatacaacaacctgcatgaatttccaaatcatgatgctgaagaaaaaaagccatagaagaatacataccgtatgattccactgatgtaaaattctagaacatgtgaaaacaaatctgtaacttccagatagcagtttattggctgaggccaggtcagtgggagagactcattaaaaagttgcaggagggttgatgtaaatgcatgttgattagggtggtggttatgcaagtgtatgcatttgtcaaaactcatcaaactgcatatttaaaattgatgagcttcattgtatgtaaactatacctgtggcaggtaaaaatttggcccacatcacctttgctccttggtgtcatgtccaaaaatatattatgtggcaaattaaactttgcagatggaattaaggggctgattagctgaccttgagatggggagagtattctgaattacccaggtcggcccaatgtaatcacatgagtccttaaaagtaaaagagagaggcaaaaaaggccagagatatgcacggaaaattgaagtcagagcaattccaagcatgagagagtgttgatgcaccattgctggtagagggcactacatggaaagtgagagaaggaactgaatttgctaacattccaaatgagcctgtaagcagattctccccaagagctttcactaaggagtgcagccctattaaaaccttggtgttggccttgtatgaccctgcacagagtatccagctgagtccacctggacttctaactcacagaaactgtgagacagtaaatgggtctgtcataagctgatacatttgatgtagtttgttacacagcaataggaaattaacaggatattcaatgttgacccaaatactacaaactaacttgataaacaaatttaaaaagcaattaaaatcatacgtctagattatcaaagatgaaatcaaagaagatattacaaactattctgaaaaaaatgaaaagaaaacccttcatgctataccattttacaatgtatacttacatcaaaacattatcttgtacaccttaaatatatacaacttttatttgtcaattataccacaataaagctggggtggggtgggatagaattacctggggactaaatagtttgctgaggatggggcctaggaatgtaaattttaataagcttcccgagtgattcttatgcacactgaagtttgagaactagtgccttcatggacttcagctttggggtgagctttaagaaagtcagggtccagttaatgaatatgagagatactgcttttttttatttttttattttttgaaatggagtctcactctgtcacctaggctgagcacaatcttagctcactgccacctccgcctcctaggttcaagcaattctcctgcctcagcctcctcagtagctgggattacaggtgagcaccaccatgcccagctaattttttttttttttttggtagacacggagttttgccatgttggctaggctggtgtcaaactcctgacctcaggtgatctgcctgcctcggcctcccaaagtgctgggattacaggcatgaaccaccatacctggccgattgcttatttatatctccaagcttcactgatcagaaaatacttttcctgaaaagttatcctacagaaatcagatcatgttgagaggataagtctctggaatgttaataaaggtatatggagctagcatagttgaactgttcactttttgcataagaaatctcactgttcatgttttcccatcagacaaaataaaacagactgacgagttttatatattaatgtgtgaacagtgcatagctacatgccaataaagcagcacagttaatgaatcaatagcttctttttctgctcagtgaaaataaaaatgctttataccaactagaaaaaaaaaaaatccaaaagcccattctttgaaaagagcaccaccagcaacaaaatagacaagtcattggcaagcttattcaaggaaaaaaagataaatagcaaagatagaggaatttaggaataagaaagggcacataactacagataatgtggagtaaaagaatcatgagtgagtgctacatgcaacactgtggcaacaaaattgaaaaaataaataaagttacttcctagaaaggtatataattattggaagttgaaacttgaattgactgattatcatagaagagcctggaggggtgattaaagatattgcaaatgccactaggaccaaatggattcataagtgagtctcacctaacttttagacaatggataattcaaatgttacttaagctattctaagcaatagaaaaagatggagtactcatcaattcatttgataaagccaacaaaactttgtttattattattagtaggttgagtagtgaaaatctactaagaatagtctaaagaaatagtacatagaacccactaatgatcaaattccatgaatagtagattttactccaagaatgtaagggtatttagtgtcaggacatctatgaacataatttgttcatcagcatatcaaagaagacaattcagatgataccagctgctgaaaacttatttatgataaacattttgtggcaaatgagaatagaataaacaccatttacaaaaaccaaaacagcaaatgttactctaaatagcaaaatacaaaaattatttcaagtaaaatcatagagtagaaggaatgttcactttcattgttattatttaacatttgctcttgttttctaataaattcaataagataagaaaatgaaataactggctataaatattggaaatgagctaaaatctgtctcatttaacttatgatatgattcaatactcacagagactttagggtaaaattactagaattaataggcaaatttggtaaggtagctagatttaagatgaatatacaatggctgggtgcggtggctcaaacctgtaatcctagctctttgggaggctgaggtggggggaatgcttgagctcaggagttgaaaaccagcctgggtaacatggcaaaaacccatctctaaaaaatatacaaaaattttccgggcatggtggcctgctcctgtagtcccagctacttggggggctgatatacaggagaattgcttgaatccaggaggttgaggctgcagtaaggtgagatcaccccactgcactccagcctgggtgacaaaatgagacccaggctcaaaagaaaaagctgaaaatacacaaaccaatagcttatctctatttggtactaagcactcataaatggaaataggagaaaactatcttattaacaatagcatcacacttataaaatacacagagataaatgtaataagaaaaatatttaaatttattacattaataaaattaaggtctgagtttaatgaaattgcagttagaatcacaacagggcttggatctttttaatttgaaaaatatcttaacagttttatgtggaagaataaagtgtctaagaatagctaagaaaggtacaaaaagaatagtgaggattgctttcacccaccagatatcagaagatatcataggctcactgtaatcaaatcactatggtactggcatagcaagataatagtagattagtgaaacagcctaatgaatccagaaatatatgctaatatatatgagaactttatatgatgaatgtgttgattcaaatcagtggcaaaaggtgccatcacaataggctattgatctggatggaaataaaactagacaaatccctctctcatgccatatgacaaaagtaattagcagataattgaagcaatgcatataaaaagcgaaacagtaaacatcttgcaagaaaatctgggagattacacgtacaatcttgaggtgtgggaaacatttttaaccaaccttgccgactctgaagatatgaaagaaaagatatctctgattataaaaattaaaaactgttttggtaaaagttataagaaagtcaacagacaaacaatagatcttggggaaaactgcaatatacatgacaaagagttaatatttgtaataataaaagggttctcataatttttttaaatgaaagagtccaaagaataatgggcaaatcatatgactaattaaatcccccaaataaatccaatagccaacaagcatttaaaaagatgctcaacttattagaaataaaaataacacaatgaaagtaatgatgcaatatcactctacacctgtaaaattggcaaattttaaaaacaggataaaacttatcgctatgtgaatgcagagagaaggccattttcatacttcgatggtagaaatgtttgaaaagttctgacctctttggaaattaaaacttagaaggaaacattcccttcgttccattaatattcctcttgcaagtttgttcaacagaagtaaaagcaccagtatgtaatgatataggatatagtagccaaaaactggaataaagtgaacatattgactaaattgtgatacagccataccatagaatcttatatagccaataaaaataatgaattaaagctataccaattgacttagagttctagtacgtgttaatgagtgagaaatgtgtgtataatgtcccaattttataaaacaaataatgtccaagaaaacctttgtgtgtgtgtatgtgtatgtgaatatatattatcatactggggttacctagctgaggtgggggagaaggggactgatgtggaaagagggtggggagccaaacagaaagaaccaaaaagaatataaagtatgtacaacatgaccacatttaatgtttacacagccacaatctatgtattatatttaaatctttataatacacatttaaagaagacaaaaaaataaaataaatgatttcagcattcaactcaagaagcaaaaatctaacaacaaaatgaaccaaaggaaattagaaggaaggaataaatcaatgaaagtagaagcagaaactgatgcaacagaaagaaaaaagagattgataaatcaaaccaaaagaaaattcttgacaagaccaataaaatcaagaaaactcctggaaatattatttttaaaagagaggaagagaacatatacaacataaggaatgaaaaagaaaatataactacagacacagaacagtttaacaaaatcacaggagactcttacataacttgataccaatacattatcaaatctagggacagtagattgctttctatgaaagtatagaccaaaatataccaatatttactgaagaagaggtagaaaaatctgaatcaactgatgaccatagacaatattgataaagttatttaatactctgcctaaatgcaccagaacccccaaaacacgaaaagcttctgaactcaaggctcatattatccttacacccaaagtaggaaaagatattataaaaacacacattgcatgtacacacaagagaaccagacatgaaacttgtgtgtgatattgattggatttcattgccttgattctctctatggaagcttgggcaggcagagggaagttttgtctttgtcccttcaccctccctctactccagtctctagattctggaggagcagcatatgacgaagagaagcaatggacaaaacagaacaaaatatcaacaaataggtcagacctatgaaaagaattggcagttagcatttctgctaataacacagatgtgtgcacaccttacccagaaatgtttctttggggcccaggtagcatcacaaccatcctaacccgatgtctgcaccttcctccaagcagacttacatccccacaatcctggccccgatcagaccctacaggacatgcctttaccttgcgtccacaggcagctcaccgagatcactttgcatatagtcccatgacagttccactgcacccaggtagtatcttctggtggcactaaagcagaatcgcaaaaggcacagaaagaagcaggtggagagctctatttgcatgacttattgctacaaatgttcaactggagaagcaaaaggttaattcttctctaaaatatctttagctcccaggaggggaaaaaagtaaaatttctgatttaatgaaaagtcccaatttctttgcagagcattttaaggaactttacccactggatgtgctcagcactaagc

SEQ ID NO: 1418 - DNA, 50514 bp, Homo sapiens
ttgtttgtatgtgtcaatgttttatttaactcattactgaagaaaccagcaggaaaataaaagagctagttccatgaacatttgagaaatagagatgtatatagtcaatgggaaaagaatgccaaaataagattatcaagttaaacataacaggaaataaaaccatatcacctttggggttaactcctctaccgggctataaaacaaaacaacttattcatttctgtaagttagcctctaaactttaagaacttcacagggctataaaccatttgcacctgcatcatttgtggattgtgactatactgtgacagctatgttatagtttccaaagaggtcagataagggtcaagcaggattattagaaaatactccagcatagaaaaaagtagccattcttttgccttttctcagattgggatccatttttctttcatattaggatctcctgttttccatttgccctgggttgcaatctttggatgcttcctccaactgctctataacttatccttgtctccagccccctttactatcaggagattctgtgtagtcatagtgaaggggtcaggcagatggaaggagcagtaaacccttcacaatcttatgggggtggagggcaagaagggggatcctattgtgtggtgatatggcagactggagtgttttttctgttttcaccagtccaattttcttctgacctccttgatatttcaactatgtaagtaggactctagttttcagtcacggtatataatttcccctgttacatttttgttgtgttattttcagcaggaaattagtagagggagagagtaaactgagtgcattattagaattacaaagtttgtatctcctatctcagataaccatggattttcctcatatttccacagaaatattaaatgtatgtcctttagaagcctaatgtcatcatcattttctttcttggccatcacaaatttcaagaagacattgttattttatttcaaagctttcaacaattgcatcctcctgacttatttttttattggtcagaattaagaccaaatggctttatatctatggacactcgtcagaaaaatgcacatttgcatttatacagaatgccttatataatttcaggggacttagggattcttgaaccccatctataattctcagtttaagaatgctagttttggagataagaatgtgcccctcataatgactaaataacataattatatctatgtgtaaggaagcagaaacagactttactgtagtagttattgtattctctccattttgcagattgtccaaatgatttgccttttgactccaagattgtattgatctgatcctgaaacatgctttgttccatgcttgatcaggataataaacaactgagagttttattttaaacgtatgaggcttaacctgaaatgttaacatcataaatatctttttcaaagtttcatcacatagtttttctacaacagaggaagtggtgactctgagaggcctaacttttcagggaagaatgctttcatgcaggtttctcctcacttctttttgcctagttatattggaaggaaggagtaatctgggagcagctgcagaaaataggtaagagttaagttaaattggatgcaccctcctggccccccaccaaagaaatgcaggactgatgatagttaattcaggaggcttcaaggcagtgtctgctaggatttagcacaaaggtagaaggcaagccagggagggacactgccctggagctgaggagggagaggtgacggcagtggcaggtgctgcagtggccaccctcagtagaggtcctgtgcctcgcagcccagaacctccatcctcagggcaatctggtgcacccaactctgggggtgaattcgaaggtagcgagtcagtaacggtgggtctagagagttcaccacaggtgtgaaggagtcttgatttccctgaaaaacctgaaagaggaaagatagcatttattggttgtctgacaggacaatggtcactgcaaagcacagacgcttttctcacttctagttgtttccagtagtccaggattaaaccctggaagatgactagatgactctgtcctacgcatctgggacatctagaattaagagcaccctgctttggaggccttcactctagctaggccttatatctacagtgttctcacccacttcccaaacctcagtgacattaagtgctttgtcctgggtcacacacagcatctgtgttggaccatctggagatgagagtcaggctttggccagcagactcccttgtcaatgcatttgctgtggcaagaggagtacatggcaagagctcagaaaatggtagctatcgttattagataaactggtttcgcacatgttggtgacaactttagaatgataacgaatgcaacacagcaaggcatgcaatttagtgtggctgggcaaccttggcaggaggggatgcagaagagagaaagaagtgggaagagtctaagactcaaggcaccttgctactccaggactttggagcaaaggtcacctataactgggtggatgtttgggaaaatgaagatctgaatgttcaaaacgtgtaattcaaggcaactctgaaaccctgtgggttttgtgtggattccgaggtaatcctacagtagaaagtccagccaaatggtgagaataagcaagagtcttggagaaaaaggaacagaatgaaggcaatgtcctaccataatgcatgctcttgcaaggacagacagacaccatgatatctttaggatctcctgaggcagtttgtgtaaaaggaggcaacttgccaccaaaatgggaaagaagtggttaaacagcaacagtagggctcctgcttcctggagctattgggtgacattttcctctaacaatcctggcatcttcaagtgtggtgtcagttttacttcggattccaaatgggaagagacttttcctggcaaatgcactgtgaagtaacactgtgatcctacagagagtttagctatcagaacaaaagacgtttgggccatcttcattcatctagctacattttccccctaggttcccaaccctggctgcttattggaatcgcctttggagcttttaaaaaatgatgcatgggtaagttccccacccccccacccccccaagagatgccaatttaatcggtctgttcccaccttggcccccttactctggtctccaagttctgcctaatatagcccctgcccaagtctctgatctgttctcccactgcattcctcctattttaccgcatcgcagatgagctgatctttcagtttctcaacaatgtcaactcttgttttatttaacatgagagcctttgtatatgtgattccctctgcttggaaggctcttaccccttctgtttcttcttttatccatgttttttacccttcgggtctcagtttaaataccacctcttaaactaagcatagtggcatgcccctggagtcccagctactcagcaggctgaggcaggaggattgcttgagcccaggagtttgagacaagcctaggcaacatagcgaaattctgcctcaatttttttttttttttttgagacggagtctcgctctgtcgcccaggctggagtgcagtggcaccatctcggctcactgcaagctccgcctcccgggttcacgccattctcctgcctcagcctcccaagtagctgggactacaggtgcccgccaccatgcccggctcattttttgtatttttagtagagatggggtttcactgtgttagccaggatggtcttgatctcctgacctcgtgatccacccgcctcggcctcccaaagtgctgagctacctctttagaaaggtcttcctcattattcctcttgtaaaataggactcttttttgttctaaatctcaacttatttgtttcctttgtagcattcagtatcttttcctttatctctttacatgcttattgactgtttcctctgtctccgccaccaaatgtcagttccacaagggcaaagaccttggtcattgttgtatcttcagcacatagaatatatagcataatgtatatagcatggcaaatataccataaacatctatagaaataaagttctgtatttggaaaaatttttgagaaacattaaggtccctgttctgagattattttacaaatgtttacgctgtatttggaggctttgtacatcttttgttagacttaatccttactgcattaaatcagggggcatgcgatgccagattgtcccattattgatgatgctaagtttgatcacttggttaagatgtccacctaatctctatatttataaaggtaaccctttccctttcctaacaatctgtggagtgagactttgagaccatgcaaatattctgtttcacaacaagcttttatccaatggtattagcaacccttaaagttctttacaagtattcaatagtaagtacattgatggttgcaaactgattttccagttatgatccattaccctcattattccttttgatgctcaaattgtctcaaatctggccaacaggaagcccttcagaccagtttctgtgttcttttcacatgatcccattaatcttctggcacatcaagatcaccaagatcatctaagattgcctggcagtttccttgatccagccttgaaaaagtcatttctctagggagctcagattcttttgactggaaaatggtagttagagaccaagatttgggcatgggatgggctcgttattactgcagtgtaattacttctagattccctcagtgaacagtgctaagaatatgattttttaaattcctaagttctcactgacacttctaattcaactctaacattctttttgttagtattagatttctagggctactgtaacaaattcaccacacacttggtgcctttaaaacaaaagaaatttattcacttatcgttctagaggcttaaagtctggagcctggagcagaggcacaaaagagtgtgtcaaacacaaaatcacatttaaagcttctatttggaagtggtatatatgtcatgtccaatcacattctattgatcaagatgagccgtacggccatgcctaaagttgatgaggttttcaaggaaagagggaataaaaactcaagaacattaataccatctgcttcatatgctattttctgttcatttagaaattccttacattttcttgtttcagcaataagaggtgatttatgcaggcagacatgagggctgggtggcttactaggtttcttagccaggagtaccctctactgttgataaatggaagtgtaatttatttaatagatgtgaccaaagaggtttgtgggtcttgtgatttagtaattcacttttgtttttataggacagttaatttccaacatttgctttcttctttttttttttttttttttttttgagacagggtttctctctggagcaaggttggctagatttatatatttattttctacttgtaaatataaacttatagtactttttgtcttctggttattctatagatgggttatgggtggttttagtcataatttaaaattgtgtgtgtatgtgtatgtatggtttttgaagactgtggagagatttaggcagctgccattatctgacaggaatgtgcaactcctgcttggaatttttaaatgctatttaaaactatttttccaactgtttcaggtatacagaaatacaattaattttggtatttattttgttttcagcaagcttgaaaaattttaaaaattctaataatttatatataaattcctttggattttctatctatgccatcatatcttccacatacaatgagtttgtttcatcatattcaatccttacatattttccttctttttctcatcttattgcactgcttaggacagccaatatgtataatccttcagtctgtcactgtgataaattatatcagttttctaatgtataagccaaacttgcattcctagcataaatccaatttggatccatattgctaatattttgtttgggatttatgtttatgaataaaacgggcctattatcttcctttctaatattgttcttgttcggtttggttgtcaaggttatgctattatcataagataattgaataacattccatctttttccattttctgaaagaatttttgcaaggttaatattatttctcctttgaaaaattggtagaatatagttagtgtagccatctggatctggattttttaaattaataaccttttaacactaagtttggaaaattaggtaaaatggattaatccctggtaaatacaacaagaaagaacatttaatattaataagtatcctcattttttatatttttatattggcagaaatttttgtgggatctttattgatgtccagttttttaaagtttctgatattatttgtgccttcttttcatcttgattgctcttgccagaagtttgtcaattttcaaggaaccaacttttggttttctttattctctctattgtatgtttcttttttacttcatttacttcatatctttattatttccttgcttctacttccttttggtttattttgctgtttcactagcttcttgagacataccttagctcattaattgtcaggctttcttctcttccaatatatgtttttaacgctatacatttctttctaaatattgctttagctgattcccacattttaatatgtcatgccttgttatcattcagtttaaaatattttctaatttatgatttcttatttgacacatgggtttaaaagtatagttcttgattctaacataggaagattttatagttatctttcttatttatatcaactttaattgtattgtgaccagaaaacatgttttatattatctgaaatttgagactactttatttgtagcttatttgtagcttaaaatggaaaattctaacatgtttcctttgtgtgcttacaaagaatgtgtaattttgcaatttctttttttttattatactgtaagttctagggtacatgtgcacaacgtgcaggtttgttacatatgtatacatgtgccatgttggtgtgctgcacccattaactcgtcatttacattaggtatatctcctaatgctatccctcccctgtccacccaccccatgacaggccccggtgtgtgatgttcccctacctgtgtccaagtgttcttattgttcaattcccacctacgagtgagaacatgcggtgtttggttttttgtccttgtgatagtttttgagaatgatggtttccagcttcatccatgtccctacaaaggacatgaacagatcctttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtacatacccagtaatgggatggctgggtcaaatggtatttctagttctagatccttgaggaatcgccacactgtcttccacaattgttgaactagtttacagtcccaccaacagtgtaaaagcgttcctatttctccacatcctctccagcacctgttgtttcctgactttttaatgatcgccattctaactggtgtgagatggtatctcactgtggttttgatttgcatttctctgatggccagtgatgatgagcattttttcatgtatctgttggctgcataaatgtcttcttttgagaagtgtctgtttatatccttcacccactttttgatggggtctttttttcttgtaagtttgtttgagttcttcgtagattctggatattagccctttgtcagatgaatagattgcaaacattttctcccaatttgtagctcgcctgttcactgggatggtagtttcttttgctgtgcggaagctctttagtttcattagatcccatttgtcaattttggcttttgttgccattgcttttggtgttttagacatgaagttcttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattcaatagggaatcctttccccatttcttgtttttgtcaggtttgtcaaagatcagatggttgtagatgtgtggtattacttctgagggctctgttctgttccattggtctatatctctgttttggtaccagtaccatgctgttttggttactgtagccgtgtagtatagtttgaagtcaggtagcgtgatgcctccagctttgttcttttggcttaggattgacttggcaatgcgggctcttttttggttccaaatgaactttaaaatagttttttagaattctgtaaagaaagtcattggtagcatgatggggatggcattgaatctataaaataccttgggcagtatggccattttcacaatattgattcttcctacccatgagcatggaatgttcttccatttgtttgtatccccttttatttcattgagcagtggtttgtagttctccttgaagaggtccttcatatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcataaggagattttgggctgagacaatggtgttttctagatatacaatcatgtcgtctgcgaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctaatttattgagagtttttagcatgaagtgttgttgaattttgtcaaaggccttttctgcatctattgagataatcatgtggtttttgtctttggttctgtttatatgctggattacgtttattgattttcgtatgttgaaccagccttgcatcccagagatgaagcccacttgatcatggtggataagctttttgatgtgctgctggatttggtttgccagtattttattgaggatttttgcatcaatgttcatcagggatattggtctaaaattctctttttttgttgtttctctgccaggctttggtatcaggatgatgctggcctcataaaatgagttagggaggattccatctttttctattgattggaatagtttcagaaggaatggtaccagctcctccttgtagttctggtagaatttgagtgtgaatccgtctggtcctggactttttttggttggtaagctattaattattgcctcaatttcagagcctgttattggtctattcagggattcaacttcttcctggtttagtcttgggagggtgtatgtgtccaggaatttatccatttcttctagattttctagtttatttacatagaggtgtttatagtattctctgatggtagtttgtatttctgtgggattggtggtgatatcccctttatcattttttattgcgtctatttgattcttctctcttttcttctttattagtcttgctagtgttctatcaattttgttgatcttttcaaaaaaccagttcctggattcattgattttttaaagggttttttgtgtctctatctccttcagttctgctctgatcttagttatttcttgccttctgccagcttttgaatgtgtttgctcttgcttctctagttctttaaattgtgatgttagggtgtcaatttttgatctttcctgctttctcctgtgggcacttagtgctataaattttcctctacacactgctttaaatgtgtcccagagattctggtatattgtgtctttgttctcattggtttcaaagaacatctttatttctgccttcatttcgctatgtacccagtagtcattcaggagcaggttgttcagtttccatgtagttgagcggttttgaatgagtttcttaatcctgagttctagtttgattgcactgtggcctgagagacagtttgttataatttctgttcttttacatttgctgaggagtgctttacttccaactatgtggtcagttttggatgtggtgctgagaagaatgtatattctgttgatttgggatggagagttctgtagatgtctattaggtccgcttgctgcagagctgagttcaattcctggatatccttgttaactttctgtctcgttgaactgtctaatgttgacagtggggtgttaaagtctcccattattattgtgtgggagtctaagtctctttgtaggtctctaaggacttgctttatgaatctgggtgctcctgtattgggtgcatatatattttggatagttagctcttcttgttgaattgatccctttaccattatgtaatggccttgtctcttttgatctttgttggtttaaagtctgttttatcagagactaggattgcaacccctgcttttctttttttgttttccatttgcttggtagatcttcctccatccctttatttcgagcctatgtgagtctctgcatgtgagatgggtctcctgaatacagcacactgatgggtcttgactctttatccaatgtgccagtctgtgtcttttaattggagcagttagcccatttatgtttaaggttaatattgttatgtgtgaatttgatcctgtcattatgatgttagctggttattttgctcattagttgatgcagtttcttcctagcatcgatggtctttacaatttgggatgtttttgcagtggctggtaccggttgttcctttctatgtttagtgcttccttcaggagctcttgtagggcaagcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgcgggtaacccgaactttctgtctggctgcccttaacattttttccttcatttcaactttggtgaatctgacagttatgtgtcttggagttgctcttctcaaggagtatctttgtggcgttctctgtatttcctgaatttgaatgttggcctgccttgctaggttggggaagttctcctggataatatcctgcagagtgttttccaacttggttccattctccctgtcactttcaggtacactaatcagacatagatttggtcttttcacatagtcccatatttcttggaggctttgttcatttctttttattcttttttctctaaacttctcttctcgcttcatttcattcatttgatcttcaatcactgataccctttcttccagttgatcgcatcggctactaaagcttatgcattcgtcacatagttctcgtgccatggttttcagctccatcaggtcatttaaggacttctctatactggttattctagttagccattcatctaaccttttttttcaaggtttttagcttctttgtgatgggttcgaacttcctcctttagctcagagaagtttgatcatctgaagccttcttctctcaactcgtcaaagtcattttctgtccagctttgttccgttgctggcgaggagctgcgttcctttggagtaggagaggtactctgatttttagaattttcagcttttctgctctgttttttccccatctttgtggttttatctacctttggtctttgatgatggtgatgtacagatggggttttggtgtggatgtcctttctgtttgttagttttccttctaacagacaggaccctcagctgcaggtctgttggagtttgctggaggtccgctccagaccctgtttgcctgggtatcagcagcagaggctgcagaagagcgaatattgctgaacagcaaatgttgctgcctgatcgttcctctggaagcttggtctcagaggggtacccagctgtgtgaggtgtcagtctgcccctactggggcgtgcctcccagttaggctactcgggggtcagggacccacttgaggaggcagtctgtccgttctcagatcacaaactctgtgctgggagaaccactactctcttcaaagctgtcagacagggacatttaagtctgcagaggttactgctgtctttttgtttgtctttgccctgcccccaaaggtggagcgtacagaggcaggcaggcctccttgagctgcggtgggctccaccaagttcgagcttcctggccgctttgtttacctactcaagcctcagcaatggcgggtgcccctctccctgccttgcagccaccttgcagtttgatctcagactgctgtgctagcaatgagcgaggctccgtgggtgtgggaccctctgagccaggtgcaggatataatctcctggtgtgccgtttgctaagaccattggaaaagcgcagtattaggatgggagtgacccaattttccaggtgccatctgtcacagcttcccttggctaggaaagggaattccctgaccccttgtgcttcccgggtgaggtgataccttaccctgcttcggctcatgctcggtgggctgcacccactgtcctgcacccactgtccgacaagccacagtgagattaacctggtaccttagttggaaatgcagaaatcacctgtcttctgtgtcattcatgctgggagctgtagactggagctgttcctattcggccatgttggaaccacccttgtaattttgcaatttcaaggtgctattttctaaatatgtctataagatcaaacttgtgaatcatgttaattgttctatttctatacattgttccatcaattgacgagagatgtgttaaaatctagcctcccgagttcacgccattctcctgcctcaccctcctgagtaactgggactacaggtgtccgccaccacacccggctaatttttgtatttttttttagtagagacggggtttcaccatgttagccaggatggtctcaatttcctgacctcatgatccacctgcctcggcctcccaaagtgctgggattacaggtgtgagccaccgcgtccagccatgaaatcacattcttaatcttcagcaatactttcttgctttaaagtctatttttctgctatcaatagagctgtaatcgatatcttttagatatttgcataatttcttttcccatttttgtcttgctacttttctgtatctaatgttttagatatgactcataaaatgcacacaatttacttttgctttttttttttttttttaaagagacaagtctcactatcttgtccaggctgaacctcctgggctcaagtgatcctcccacatcagcatcctaagtagctgggactacaggtgtgagccatcacacccagctacttttgcttttttatcaatctgacaatctttgtcttttaactgaaatatttggtccattcatattacatatgattactgttatatttcaatttaaatataccatcttatcttgctatttttcctacctgttttatgtttctttatctctctttgcttgctttcatttaggtttgttgagtatattttatcctttcatattttttcttctaccattttgggagtcttacattgtgtgtatttctattacttactggctatcctataaactacaacattaatcaaattatgaaggtttaatattaacatctttacctcctagataatacatggattttagaatcctttattctatttatccacatgctgacttttttgctgttgtcatatgttctaaattttcacacgcacacctggcttaaacaatagaaatttattttctcacagttctggaggctacaagtccaagatcaaggggtaggcaggcttgttttgtgtgtgtgtgtgtgtgtgtgtgtgtgtgtgtgtgtattttttttttgtctgtttgttttttgagatggagtctccctctgtagtccaggctggaatgtgatggcgcgatctgggctcactgcaacttctgcctcctgggctcaagcaattcttgtgcctcagcctcccgagtagctgggattacaagcgcatgccagcatgtccagctaatttttgtatttttagtagaggggggtttcaccatgttgggcaggctggtcttgaactcctgacctcagatgatcttcctgcctcagccttccaaagtgctgggattacaggcatgagttaccacgcctggccagcaggcttggttctttttttttttcttttccttttcttcttcttctccttctctttatttttttttttagaggcagggtcttgttctgtttcccaggctggagtgcagtggcacaaccctagctcactgcacccttgtaacaagaactacaagtgcacactaccacacctggctaagggttggtttcttgtaaggcctctctcgttggcttgtaggtgtctgtcctctttctatatcttcatgtggtcgtccctctgtgcctgtctgtgtcctaatttcctcttttgctttaacgcataaaagatattttcattaggttttctttttgagagaggggttcacattgtttattttagcattgtgaagacatcattcattattttctgatatttgctattatttagaaatcagctgtcagtttgttactcattatggtaatgtacatgtcttctgacttatctattgcaaaattcgcaaacataaaatttaccattttaacaattttaaagtgtgaagttcagtgccatttagtacattcacaatgttatatagccatcaccactatctagttccagaacatttctataaccccaaaaggagattcaatacttattaagaagccactccacattcactccttctgccagcttctggcaaccactaatctgttttctgtctctatggatttgctattctgggtatttcatataagtggaatgtggccttttgtgcctggctgctttcacttagcataatgctttcaaggagcatccatgttttagcatggatcagtactttgattttttatgaataaataatagtccatatatggatagaccacattttgtttatctgttcatcacttgatgaacatttgaattgttttcacctgtttgctattatgaatagtacttctatatgcatttgtatattagtttttgttagagtgcctgcttttaattcttttgggtccacacccaggagtagaattgctgggtctatgttaattctatgttttccttactgaggaactgccaaaatattttctacagtggctgccctatttcacattctcatcatcaaggaaggttccaatttctttatattcttgctaacacttgttattttcccgcttgacattttgtttttgttttttttttaatttagccatcctagcaggtttgaaatgctatctcattgtggttttgatttgcatttccctaataactaatgatgttgtctatcttttcatgagtttgttggatccttgtatatcttctttggagaagttccattgaagtcctttacccattttaaaatttggttgtctttctgttgttgagttgtaagagttctttttatattctgggatactaggccctttatcagatatatgatttgcaatttttttctcctatactgtagatcatctttttactttcttgatagtgttctttgatgtacaaaagcttttaactttaaagatgcctactatatatatttttatagagttgttgcttgtgattgtggtgtcacatctaagaaaccattgccaaatccagtatcataacaatttacctctttgttttttcttacagttttatggttttagcttttatatttagttttttgatacatttttagttaaatgattttttacagacagggtcttgctctgacacccaggctggagtgcagtggtgcgatcatggctcactgcagcctccacctcctgggctcaagcgatcctcctatcccagcttccctagtagctgggactacaggtgtgtaccatcatgccagctaatttttttttcttgttttgtagatacagagtctcactgtgttgcccaggctggtctcaaactcctgagctcaagtgatccaccagccttagcctcccaaagtgctgggattacagatgtgagccaccacatccagccttgagttaaattttgtatatggtaaagatccaacttcattcttttgcatgtggatatccaattgtcccagcaccatttgttgaagagactattcttttcccacaaaatggtcttggcacttttattgaaaatcaattgaccatagatgtataggcttatttctggactctcaattctattccattgatctatgtgtctatatttatgtaagtactgccctgttttgattcttgtagctttgtagtaagttctgaaattgggaagtatgactcctccaacgttgttctttttcaagattgttttggctattcagggtcccttgaaattccatctgaattttaggatagatttttctattcctcaaaaaaaaaaatgtctttgggattctgatagagaatgctttgaggccggagaatcgcttgagcccaggaagcagaggttatggtgagtggagattgcaccaccacactgcagcctgagcgacagagtgagactccgtctcaaatcaaaaaacaaacaaacaaacaaaaaaacccagaatgcttgctttgaatctgcaaatggtttgtggtaatattcttatcttaagaatattatgtcttcaaatccataaatccaggatgccttttcatttatttagttatttaatttctcttttaatttttaatttttaatttttttctagttgctaattttccatatttgctgtcttcagaccagacagttctttagtttctttcaactgggtttttttgtttttagtggacaagacttgcacctccttcgttaaatttattcctaaatattgtattatctttgatgctattgtaaatagacttttctgttttccttttcatatttgtaattgttagtatataaaaatacaattgatttttgcatgttgactttgtaacctgcaatggtttttttcaactgcctaataatgttggataatttgtcttttattttcatgtttccatatgttattactttaaagattttatacataattatttcatattatgtatccgataatgtcaatatctggtgttcttcaagttttaaatctgaattgattgtttctgttcacttgtactcaagttgtcttgttgtcttgcatgtttgctgatctatgtctgtgatcttataattttaatatgtaggaatcctggaggcctaaactggaggtgctttttttctagagtaggttgagaatggttcttccaggtgccagaggataatatttatctgcaacttctctagcttccttctgggattcatgacaatgcagaattctcacactgagttctccttgcattttgctcaaggcttagtcttccagtaacaacattaatatgggcattctgtctgaggaaaggtcttcctttttatatttgctcattattcacctctccgctatgatttcagctcattattttaaaatagaagtttgtgggggtttttgttgatggggaggctggagattcccctttctttgctaaatacaacaatgcattgtcagtgatatagccttttttattgttgtacaatatacataaaatttaccattttaatcatttttaagtgtacaatttagtggtattaagtatactcacaatattgtgcacccattaccactatccatttccagaactttttcatcaccccaaacagaaactctgtactcattaaaaataactctccatttcttccccattccaagaccctggtaacctcttttctactttctgtctttatgaatttgcctgctctagatacctcattatggtggttaattttatgtgtcaacttgactgggccatggggtgcccatatatttgattaaactttattttatgtgtgtctgtgagagtgttttttggtgagattaacatttgaattggtagactaagtaaagcagattgttctccccagtgtgggtagaacttatccaatcagttgaaggcctaaatataacaaaaaggcttactgtcctcttagtaagagacagttccttctatttgactacctttaaactgggacttcagtttttttcctgcctttgggctcgaactaaaacattttaactctttctgggtctgtagcctgctggtctttgaactggaactacgaatcagctctctggggtctctaggctgccaactcaccctgcagatcttgagacttggcagactccataatcacatgagctaattccttgtgtgtgtgtgtgtgtgtgtgtgtgtgtatgtatctcctcttggttctggttttgtttctttgggaaccatgactaatacagattttcacaccaagagtgattctaaaggaacagaattttaaggataaattttataaatttgttattggatttctggaattggttctgtaacctgatgaaatttaaagacactaatgactattttcagtagtaaaaattgtccatggcatgatctggcaatagaaatatgtaggccaggctgggcgcggtggctcacgcctgtaatcccagcactttgggaggccgaggtggatggatcacctgaggtcaggagttcgagaccagcctggccaacatgatgaaaccctgtctctactaaaaacacaaaaattaggcaggtgcctgtaatcccaactactcgggaggctgaggcatgataatcgcttgaacctgggagatggaggttgcagtgagctgagatcatgccactgcactccggcctgggtgacagagcgagactccatctcaaaaaatatgtatatgcaaaatatctccattggatactcctaatcaactacttttaagaagcaagggtcttggtgactatgtatattgacacttgtgaacatatttgtcaaactaatgaatatgatgggattagtcggttgctcctaatgttgctggaaaaagtgatgaaagaaaaggaggagctcaggaatttgaattcccagctcaagagctgcataaatgacttgacagattctatgtatgccctgaaggagacccttatctactgtagccacagagctgagattgctgaaaatcaaatgccaaatctcatcctgtgactaactgaattacaaagcaagccaaactcccagctttgcagggtgtctactgttaaagcaagggcagtgattgggaaagaatggggcactacaagttggattaggtatgtgtggaagaccctgattaagctggggacattgagctcctaaatattgatgagtcttctttgtcagtgaaagttttctctccagccctgtggtggcagtatctctactccagtctaagtggattaaccctgcactgcctgaggaaactgtaatggcttcccctgaggcaactgccatgcaagataatgctgattccttcaggacccaccctaccacccctctttgttattagatctataactacactcaagtcccagcaggcgaggtgaggtatgaaggtgacccatgacaaggtgcactacactccaaaatcatgacttgagttttctaatttacacaagcaggaatccagagaatatgtataggaatgggtactaaggatgtgagataacggtggaaggcacgtaaagttggattaggccaaatttattgacatgggcccactaagcagagattctggacttaatgttgcatctcagggaattaggaaggcctctaacagtttaattggttggctgaaacacagaccaaaagatggcccacagtgagcaaactagaaatttcagacttgccctggtttaatgtagaagaaaggagattgaaatgctagagtgaatttgtcatttaagacatactcaccaacactgggagagttcagaagacacagatctcactattactttgaggaataaatttgtgaggggaacctcagcatccttgaagggctctgtgatcactcttctctgtaggtgacaccttacagcaggacctgcagtcactgaattagaaaacctaaatacaatgggaataattggatcctggggtggaaggggccaatgggcagcactcaactgccaaaggcaaggtaagtgtggttaccataagggacagcagagtcaaagcagcagttagaatagtatgacttgcacagacctatggtgttggctagtagattatagtgttcctagatgtgatatagatagaatgcctaccaaattcttgaactgcataagtggaaaagttctaggtcaagtgaacaaaagtctaacctgaataataaaaacagagtcacggcctctcaatcaattcccagacttgagcaggtttacagacccagcactccttgaatgaaggggaggctcagtctccttgaggaaggactctggtacactgccaagaatactgccactctttctctcagccttccccaaagggacatatggcctttctatcagaataaatgtgcactgaagaaaaataattaatcagacctttcagggactactggacaatggctctgaactggcactaatttcaggagacccaaaatgtcactgtggtccaccagtcagagtatgggcttatggagggtcaaatgatcaatggaattttagctcaagtccatctcaaagtggatgcagaggatctgtgagactatcttgtggttatttccccagtcctggaatgcgtaattggaacagatatattgagcagctagcaggatcttcacattggttccctgacctatggagcaggggctactgtagtgagaaatcctcctgtaatcctctgtgaataactgttctccttttgtgagatagctcttggcctactactgggccttagtagatactgaatgcttagccacagaccaccaagttgccatgtgacctgaactgcccatcatgaactaggtgttatctgacccaccaagccataaagttgggtatgaacaatggcactccatcatcaaatggaagtggtatatacatgatcatgtctgagcaggtactgaaaacacatgtaaattacatgaagaagtagcccaaatgtccatggtgcctgtttctgctaccctgccttctctctcccagcctgcacttatggccccattgggagttccctatgatcagtttacagaggaagaggagtcttgggcctggtttacagacggttctgcacgatatgcaggtactacacaaaagtggacagtcccgatctgagatacccatgaaggacagtgggcagaattttaggcagtgtacctggttgtggactttgcttagaaggagaaatggccaggtgtgcaattatatgtcaagtaatgggctgtagtcagtgctttgtccagatagggacttggaaggaacatgattagaaaacaggtgacaaagaaatttggggaagaggtatgtggacagatctctctgaatgggcaaaggatgtgaatatatttatgtcccatgtgagtgctcaacgaagggtgacctcagcagataaggatttcaataatcaagtaaatatgatgggccgggtgcagtggctcacgcctgtaatcccagcactttgggaagccaaggcgggaggatcacctgaagtcaggagttcaagaccagcctggccaacatggtgaaaccctgtctctactaaaaatacaaaaattagccaggcatggtgatgcgtgcctgtagtcccagctactcgggaggctgaggcacgagaaatgcttgaacctgggaggcagaggttgcagtgagctgagattgtgccactgcactccagcctgggcaacagagcaagactccatctcaaaaaaaaagtagatatgatgacctgttctgtggataccagtcatcctttttactcagccacctatgtcactgcctgatgggctcatgaacaaagtagccatggtggcagggatagaggctatgcatgggctcagcaacatggacttctattcaacaaggctgacctggctatggccactgctaagtgcccaatctgccagcagtagagacaaacacagagtcctcagtatggcagtatttcccaggatgatcagccagctatctggcagcaggttgattacattggaatatgttcatcatggaaggggcagcgttttgtccttcctggaaggaaactgaactactgcttcacaatggaggtatggaagagtgtgtctggaatacaatagatcccttagagtgtctcttagtattaccaggccctatgattctggtcaatgggaaactacagcaacccaatccatgcaggactactagtggcccaggctcttcaggaataaaggtttgggtcacctcatcaggtaaagaaccacaatcagctgagatgcttgctgaaggcaaagtcaatacagaatgggtagtagaagaaggtagttatcaataccagccaagttttgttatatcatgttaggtggaattatgacctcatttttgtctctacttagagataaaggagatgtgtatgatgggtgctacattgacaaggggtggacttgtcatggttaattttatgtatctactttacttggtcataaggtgcccagatatttactcaaacattattctggttatttctgtgaaggtgtttttgaatgggattaacatcgaagtcagtagactgagtaaagcagattgctctccctaatgtgggaggcatcatccaattagttgaaggcctgaatagaacaaaaagactgagtcttccccaagtaagaaagtattcttgctgcctgtctgcctttggactggaacatcagctttttcctgctttcagtcttgaactaaaacagtttagctcatccagagagacagagagagagagacagacagacagaatctcctattggttctatttctttggatatccctgactaacacactcatataagtagaatcatataatatctatccttttatgtctggcctattcacttagcgtattttcttttttttttttttttgagatggagtctcactctgttgcccaggttggaatgcagtggtgcgatctcggctcactgcaagctctgcctcccgggttcatgccattctcctgtctcagcctcccgagtagctgggactacaggcacccgccaccacgcttggctaattttttgtatttttagtagagatggggtttcactgtgttagccaggatggtctcaatttaccgacctcgtgatctgcctgcctcagcctcccaaagtgctgggattacaggcatcagccaccgcgcccggccttcacttagcatattttgaaagttcatcatgttgtggcactaatcagagatataaccttttttaaatgggaatttttcttctagaatatccaatgtctagacttcagttcaccaaactgccagtttggtgaagtctttcatccagccttgatggataagggaattcttcttggacatgatgtttacctgagacttaacgaatgagtcaggtgaaagtggcagtagagggtagctagaaaaatgttccaggtagaagaaatagtatctatttaaaagcctggtatgagatataatggctgtatttagtgacctgagaatttcttagtatggatggagcttaaagagccaagtggcaagagactgtattagagagattggtaaggaccacatcatggttaattcttggtgaaaaaagaatataaaaaataccaaagagaggaactattccttcccccattactcatggggtgataagactttatgtcatgtcttttaatcaggacaatttgttgaattatccagcaaacccagattaagaatgaagacttcctggaccactaaacttaaaggtcaaaaaggcttgggaatcaaggtgctgatgaggagaattaactcttggatctactctgcccttttctcagtattttacctttttcttaaagtcactgtgttctctcagaatgccttttacaatgtcttgctaccataggtacttaataaattttgctctgaaaatttggtcatatatcaacctttttatgttatgttaagctctaggagaggtggtattttttttctttctttctttctttccaaggagaccagcttacctttactttgccattctgaaaaaagagagtccactgatggccatcttgactgctggagatgaggaactccttcacatacatgctggtaagcagagattttactccctgagtagttactcctgtgactttcattgtcttctggaagtccacttgcagccactcttttggattattcacctgagggcaatagagttggactagtagcctcttggtcaccatttactcccagaaattcccaaatccctcttaaccataccacagcacttctcactctactttcttttttgagacggagtcttgctctgtcacccaggctgtagtgcaatggcatgatctcagctcactgaacctctgcctcccgagttcaaccgattctcctgcctcagcttcccgagtagctgtggttacaggtgcccaccaccatgtccagataattttatatttttagtagagatgaggtttcaccaggttggccaggctggtcttgaactcctgacttcaggtgatctgccacctaggcctcccaaagtgctaggattacaggcgtgagccactctgcccggcctccttccttccttcctttctttctttttcttccttccttctttcctttctttctctctctctctctctctgcctctttcagacagagtcaggcactgttgcctgggctggagtgcaatagcatgatctcagctcactgcaacctccgcctcccaggttcatgcgattatcctgcctcagcaaaagagtgatctagaactcctgaccttgtgatcggcccgcctcagcctcccaaagtgctgggattacaggcatgagccaccgcacccagcctccactttctattggctagtcagtctctcttattcaactctaagcaacttcagggccaaaatttttcacaattcacctttgtatccctaggctcatcctagggatactaagatgtgcagtaaatgtttacttttcattgatgtaatgagaaacctggaaagaaagctaattgttgatatttatctgtaaaatggactttagcttctacaattctttgacagatattagctcagtactagatatagagattcttcttccaggaggttcaattagagatcatttcccccaaatgcctgtgtggttgtctgcccataaccaaacttccttgacacactttttagaactaacagttgacagaaatacctcagaagaaacagtcaaggccttccccgattttttccccaaccactgctctgagtcagttaaacagtaaatctgttgcctcttacctgaggtctccaggcattactcctcccttggaggtgaagtcgagcttttgaaggagaccaggtggcaaacatattggtaaagtaggatgaagcagtaatctgtgcatctgatattgctttactctccattcccaatggcatgctgcaacctcaaagaaaagaaaaaagaaggttatcacaaggacatgcttcagcctcagttatactgagcagcttccactgatattctagggctactgtcatcataatatcatttctcaggttttaacttttgcacagattctgttattggttttttgttttgttttgttttgtttttgtttttttgagatggagtctcgctttgtcacccaggctggagtgtagtggcatgatctcagctcactgcaacctctgcctcccgagttcaagcgattctcttgcctcagcctcccgagtagctgggactacaggcgcacaccaccacacccggctaattttttgtatttttagtagagttggggtttcactatgttagccaggatggtcttgatctcctgacctcgtgatccacccgccttggcctcacaaagtgctgggattacaggtgtgagccaccacgcccggccaattctgttattgctatctgttttccagccagctcttcccactttgtgtgactctttaattttctttgtttcttttcttcttctacttttattttagattctaggggtacatgggtaggtttgttgcatgggtaaattgcatgtcactgaggcttggtgtatgaatgatcccctcactcaggtagtgagtgcagtacacaatacataaccttctaacccacacccccctcccaacctctcccctcctgagtgtccatcattgtgtccatgtgcatttaatgtttagctcccacttatgagaacacatgatatttggttttctgttcctgcattagttcatttatgataatggcctctagctgcatctatgttgctgaaaaggacatgatctcattcttttttatggctgcatagtattccatggtatgtatgtaccacattttctttatccaatctgttgttgatgggcatttaggttgactccatgcctttgctattgtgaatagtgctgaaatgaacatatgcgtgcatgtgtctttatgacagaatgatttatattcctttgattatatacccagtgatgggactgctgggttgaatggtatttctgggtttgcccaggactatgctggttttagcactgacaattttgtgtcctgataccgggaacccctcccccagtctcaggataactagaacagttagtcaccctacccatggttgagggaagaaggatatgggatgacttggcacttactatttaaatcacagcccatcaactccatgcgaagagtgctgcgaatgctataatgagttgggtgcaaacggatgtatcgagcaataattggagggttaaaaatattgtgttttatcccagatgaatccacattgccaaagaagacctgtatggagagattagcacaaatacatggaaagtgaatacagagtaaaaagcaatttctgtcaatcatatcttccttctaatttgctttgtgcgtttctcaacagcatccaacatctacataagacaactatggttagatggatgttacgatggtagacacaaaggaggaaagcaccaagaagaagtgggaacaaaggaaattattaggtctggggcaagtgaagttattttctactttgagttcctgtaaaaggctcataaaagttgaggaagccatttgggctctgctactccagcatggtccacagaccaggagtagcagcatcacctgagggcaattcaaaatgcagcatcaggagaacggtatcagtgagttgatgggataggaggtccctagctcttgttcccccacaggaacaataatttgacaatgatctatggacaaaagtgtctttgtgggagccttgggattcaggtaggaggttgagaaaccctggtagagctcaagaacaaagatgaatactttaataaggcaggcccacattctagcggcaggcctgtcaactgtagttctggttgtggacccagaagcagcccaccaccctggggacttagctccagagttgtttgtatgtggtcctaccactatccctatctgcccaggaatctgggaggagcaactcccattggcaaccccagtaacagggctcccaactgtggactctgaagcagccctgtacctaaagcagcttcagtaccacactaccatggtcttggggaagttttgcctacttaggaaacaggtgggagtcatgccagtccacctctggaagcaggcccaccaactagacctgactgtggactcagaagtaaccctgtgagccaactccagtcttgctgtaccatgttctggagacagtcctgcctgaatccacacttacctgtgcccccataacaggcccactgactgtgggcccaagtggggaccctgaagcagccctttgacccagctccaggcccactgcatcatggtctgcaggcagtcctgcccactcaaggacccagtgagagctacacctatccaaagccctggtaatgggcccattgtctgagtacccaacttcagaccagaagaggtgtcagctcactccaatgcacagataccaatgctaggctatgtggatcatgaagaatcaggcaaatatgacatcaccaaagggaactaataaagctccagtaaccaaccctgaagaaatggagattcatgaaatttttgacaaagaattcaaaataatcatttaaagaagctcaattagctacaagaggatacaggaagacgactaacaaaatgaggaaaacaatacatgaacaacattagaagtttaataaagaaataaaaaccataaaaaagaaccaaataaaaatcctgtagctaaagaatattgctgaatatagctgaagaatgactgaactaaaaaatttaatagcgatctttaatagcagactcaatcattcagaagaaagaatttgtaaacttgaagacaagtcatttgaaattatctagttagcggaataaaaagaacaatgagaaagagtgaaggaagaacagaggacttatgggacatcatcaagcaaaatgatagatgcattatagaaatcttaaaaggagaagagagagagaaaggaaacttatttaaagaaataataggtgagaactccccaaatctatggaggggaagtgccatctggattcattaagcccaaagataaccaaatacattaaacccacagaagtctacagtgagatgcattataattaaattttcaacaaagacaaaagagaattttggggtagtaagaagaaagtgaattgtcacctataggggagctccataagactatgagtggatatctcagcagaaaccttgcaggtcaggaaagagtgggatgatatattcaaagtactgagagaaaaaaatccaatcaacaatactttatctggaaaaactgtcctttaagaatgaacacaaagataaagcctttctcaaacaaaaactgagggggtttgtcaccatgagacctgccttataagaagtgctaatagttcttcaagttgaaataaaaaaaaaacagtaacacaaaagcatatgaatcctttcactgctaaaggtaaatataaagagaaacatagactattgtaacactataatgattgttataaatcactattaatattaatttataaattaaaagacaaaaatagtaatagtaactatagtgacagaaatttgtcaatggaaacacaatatagaaggaagtaaaatatgacgtcgattacataaagttgtggcggggggaatgagtaaagtatagagtttctgtatgtgattgaaggtgttgtcagcttaaaacagactgccataactataaagtgttcaatttgatccctgtggtaacccccccgaccgcccccccacacagtagatatacagaagataaagagaaaagaatcaaaacacatccaagcaaaaatcatcaaaccacaaagaaagaaaaagaggaaaggaacaagaaaactacaaaacagaaaactattaacagaatggcaacagaaagtcctaacctatcaataattactttaagtgtaaattgactaaactccccagtcaaaagacacagagtaactgaatgggctttttaaaaagccaacaattcagagatgggaagtaagaaacaaaaataaacaggacccaactacatgttgttgataacagactcacttttgatttaaggacatacataggctgaaagtgaaggggtggagaaagttatgccatgcaaactgtaaccaaaagagagcaggggtggctatacttgtatgagaaaaaatagtctttaagtaaaaaactgtgacatgagacatagaaggtcattatataataaaagggtcacttgaacaggaagatgtaataattataaatatatatgtacccaacacgaaagtacctaaatatataaagcaaacattgacagacatggaaggagaaatagataacaatataatatagttgacttcaatactccactctctataatgaatagatcatcccaacagaaaatcaataaggacaaaacagaactgaagaataaaatagacccaatggacctaaaatgtatatacagaactttccacccaacagtagaattatcaagcacacacaaaacattcttcaggacagatcacctttcaggtcacaaaacaagtcataataaatttaagaagattaatatcataccaagtatattttctgaccacaatggattgaaactacaaatcaataacaataagaaaacacgaaaattcacaaatatgtggaaactaaacaacacattcttgaacgaccattgggtcacagaagaaaccaaaatcttgataatataccaaaacttaaaggatgcagtaaaagcatactaatagggaaatttatagcaataaatgcctatatttaaaaagaagaaacatatgaaataaacaacccaacttatcacctccaggaactacaaaaagaagaaaaaaaaaactaagcccaaaggtagcagaacaaaggagataataaatgctagagcagaaataaataaaaaagagaataaaaaaacaattggaaataactgacaaaactaagagttgatttttttgaaaaaataaacaaaattgacaagtccttatctagactacgaaaaaaagagagaagactcatataaataaaatataaatgaaagaggagacactacaactgatgtcacagaaacagacagaaccataagggactattataagtgtcaacaaattggttaacctagaggaaatggataaattcctagaaacatataacataccaaaactgaataacaaagaaatagaaagccttaacagactaacaacaaatagggatattaaatctagtaatcaaaaaccttccaacaaagaaaagcccaggaccaatggcttcatggatgaattccatcaaacattcaacgaagtattaataccagtatttcttaaactcttccaaaaaatacaagagagaacacttcaaaatacaatttattagccaacatcaccctgataccatatccaggcaaaaacaacactagaaaagaaaactacaggccaggccaggtgtggtggctcaagcctgtaatcccaacactttgggaggctgaagcaggcaaatcacttgaggtcaggaattcgagaccagcctggccaacaaggtgaaaactcatctctactaaaaaaatacaaaaattagctgggtgtgatggcatgttccagtagtcccagctactcaggaggctgaggcaggagaatcgcttgaatccaggaggtggaggttgtagtgagccaagatcataccaccactgcactccagcctgggtgacagagcaagactctgtctcaaaaaaaaaaaaaaaaaaaaagaaagaaaaagaaaatgaaaagaaaagaaagaaaactacaggccaatatccctgatgaacacggatacaaaaatcctcaacaaaacaccagccaaccaaattcaacagcacattaaaaggatcattcatcatgaacaagtggtatttatccctaggatgcaaggatggttcaacatgggcaaatcaatcaatgtgatataccacattatcagaatgaaagatgaaaaacacatgattatttcgatcaatacagaaaaagaatttgacaaaactagatatccattcataataaaaactttcagcaagatagatacagaaggaacttaacacaataaagaccatataggaaaagctcacagctgatatcataaccaaatgtggaaaaactgaaggtttttccttttagatactgatatggtttggctctatgttcccactcaaatctcaccttgaatcgtaatccccataatgcccacatgtcaagggagggacctagtgggaggtgattggatcatggggatggtttcccccacgctgttctcctgatagtgagttcttatgagagctgatggttttataagtgtttgacagttcctccttcacacactctctcttgcctgctgccatgtaagatgtgcctatttccctttctgctatgactgtaggtttcctgaggaaagaacatgggacttatgggacagccatgcagaactgtgagtcaattaaacctcttaaagcttcataagtgaaggagaaatgaaattctttacagacaaccgaatgctgagggattttgtcaccatcagacctgccttacaagagctcctgaaagaagcactaaacatggaaaggaacaactggtactagccactgcaaaaacataccaaattgtaaagaacattgacactatgaagaaactgcattaactaatgggcaaaacaaccagctagcatcataatgacaggatcaaattcacacataacaatattaaccttaaatgtaaatgggctaaataccccaattaaaagacacagactggcaaattggataaagagtcaagacccatcagtatgctgtattcaggagactcatctcacttgcaaagacacacataggctcaaaataaagggatggaggaatatttaccaagcaaatggaaagcaaaaaaaaaagcaagagttgcaatcctaatctctgataaaacagactttaaaccaacaaagaccaaaagagacaaagaagagcatcacataatggtaaagggaaaaatgcagcaagaagagctaactatcctaaatacatatgcacccaatacaggagcacccagattcataaagcaagttcttagagacatacaaagagacgtagactcccacacaataatagtgggatactttaacaccccactgtcaatattagattaatgagacagaaaattaacaaggatattcaggacttgaactcagctctggaccaagcagacctaatagagatctacagaactctccaccccaaatcaacagattatacattcttctcagcaccacattacacttattctaaaactgattacataattcgaagtaaaacactcctcagcaaatacaaaagaatggaaatcataacaaacagtctctcagaccacagtgcaatcaaattagaactcaggattaagaaacacactcaaaaccacaaaaatacatggaaactgaacaacctgctcctgaatgactactgggtaaataatgaaatgaaggcagatataaagatgttctttgaaaccaatgagaatgaagacacagcgtaccagaatttctgggacacacttaaagcagtgtttagagggaaatttacagcactaaatgcccacaagagaaagcaagaaaaattgaaaattgacaccctaacatcaaaattaaagaattagagaagcaacagcaaacaaattcaaaagctagcagaagacaggaaataactaagatcagagcagaactgaaggagatagagacacaaaaaaaccttcaaaaaatcattgaatccaggagctggtttttttgaaaaaatcaacaaaatagatagacttctagccacactaataaagaggaaaagagagaagaatcaaatagatgcaataaaaaatgatattggggatatcaccactgatcccacagaaatacaaactaccatcagagaatactataaacacgtctatgcagataaactagaaaatctagaagaaatagataaattcctggacacatacaccctcccaagtctaagccaggaagaagttgaatccctgaatagacctataacaagttctgaaattgaggcagtaattaatagcctaccaaccaaaaaaagtacaggaccagacggattcacagacaaattctaccagaggcacaaagaggagctggtaccattccttctgaaactattccaaacaatagaaaaagagggaatcctccctaactcattttatgaagccagcatcatcctgataccaaaacctgacagagacacaacaaaaaaagaaaatttcaggccaatatccctgatgaacatcgatacaaaaatcctcaataaaacactggcaaaccaaatccagcagcacatcaaaaagcttatctaccacaatcaagttggcttcatccctgggatgcaaggctggttcaacatatgcaaatcaataaacataatccatcacataaacagaaccaatgacaaaaaccacatgattatctcaatagatgcagaaaaggccttcgataaaattcaacaccccttcatgctaaaaactctcaataaactatgtatcggtggaacatatctcaaaataataagagctatttatgacaaacgcacagccaatatcatactgaatgggcaaaaactggaagcattccctttgaaaactggcacaagacagggatgccctctctcaccactcctattcaacatagtattggaagttctggccagggcaatcaggcaagagaaagcaataaagggtattcaaataggaaaagaggaagtcaaattgtctctctttgcagatgacatgattgtatatttagaaaaccccatcatctcagcccaaaacctccttaagctgataagcaacttcagtaaagtctcagggtacaaaatcaatgtacaaaaatcacaagcattcctatacaccaataacagacaaacagagagccaaatcatgagtgaactcccattcacaattgctactaagaaaataaaatacctacgaatacaacttataagagatgtgaaggacctcttcaaggaaaactataaaccactgatcaaggaaataagagaggacacaaacaaatggaaaaacattccatgctcatggataggaagaatcattatcatgaaaatggccatactgcccaaagtaatttatagattcaatgccatctccatcaagctaccactgactttcttcacagaattggaaaacactactttaaacttcatatggaaccaacaaagagccctcatagccaagacaatcctggacaagaaggacaaagctggaggcatcatgctacctgacttgaaactatactacaaggctacagtaaccaaaacagcatggtactggggccaaacagatatgcagaccaatggaacagaatggaggcctcagaaataacaccacacagttacaaccatatgatctttgacaaacctgacacaaacaagcaatggggaaaagattccctatttaataaatggtgttgggaaaactggctagccatatgcagaaaactgaaactggatcccttccttacaccttttacaaaaatcaactcaagatggatcaaatacttaaacgtaagacctaggaccataaaaatcctagaagaaaacctgggcaataccattcaggagataggcatgggcaaagacttcatgtctaaaacaccaaaagcaatggcaacaaaagccaaaattgacaaaggagatctaattaaactaaagagcttctgcacagcaaaagaaactatcatcagggtgagcaggcaacctacaggatgggagaaaatttttgcaatctatccatctgagaaagggctaatatccagaatctacaaagaacttaaacaaatttacaagaaaaaaacaaacaaccccatcaaaaaatgggcaaaggatatgaacagacacttctcaaaagaagacatttatgcagccaacagacatttgaaaaaatgctgatcatcactggtcattaaagaaatgcaaatcaaaaccacaatgagataccaactcacgccagttagaacggtgatcattaaaaagtcaggaaacaacagatgctggagaggttgtggaaaaataggaacgcttttacactgttgatgggagtgtaaattaattcaaccattgtggaagacagtatggcgattcctcaaggatctagaactagaaataccatttgacccagcaaatcccactactgggcatatacccaaaggattataaatcattctacaataaagacacatgcacatgtatgtttactgtggcactattcacaatagcgaagacttggaaccaacccaaatgtccatcaatgatagactggattaagaaaatgtagcacatatacaccatggaatactatacagccataaaaaaggatgagttcctgtcctttgcagggacatggatgaagctggaaaccatcattctcaaaaactatcacaagatcagaaaaccaaacactgcatgttctcactcataagtgggagctgaacaatgagaacacatggaaacagggagtggaacatcacacgctggggcctgttggggggtggggggctaggggagggataacattaggagaaatacctaatgtaggtgacgggttgatgggtgcagcaaaccaccagggcacgtgtatacctatgtaacaaaactgcatgttctgctcatgtaacccagaacttaaaatataatttaaaaaataaataaaataaaaagcatccaaatagaagagaatagtaaaattatctctttttgcagatgacatgatcatacatgtagaaaactctaaagactcaaaaaaaaattgttagaactaatacatgaattctgtaaagttgcaggatacaaaatcaacatacagaaatcagtggtgtttctatacactataaaatatcccaaaggaaattagaaaataatcttatttacaatagcaacaaaagaataaaatacttaggaatagacttaaccaaagaaatgaaagacttgtacaatgaaaatatagaaaacatttatgaaggaaattaaagaagacacagataaataaaagatattccatattcctagattggaagaattagtattgttaaaatgtccacactacccaaagtaatctatagatttgatgtgatccctatcaaaatctcaatggtgttcttcacagaaataaaaaaaaaattttaattaatatgaaatcacaaaagaccccaaggaggcaaagcaatcttttttttttttttttgagacagagtcttgctctgttgcccaggctggagtgcagtggtgcgatcttggctcactacaacctctgcctcccaggtttaagtgattctccacctcagcctccagattagctgggatcacaggggcctgctaccacacctggctaatttttgtattttttcagtagagacggggtttcaccatgttggccaggctgctcttaaacttctgacctcaagtgatccacccacctcagcctcccaaagtgctgggattacaggcgtgggccaccacatgcagcctggcaaagcaatcttaagcaagaagaacaaagctagaggcatcatacttcctgatttcaaaatatactacaagtctccagtaatcaaaatagtatggtactggcataaaaatagacacatcaaccaagggaacagaatagaaaagcccagaaataagttcacacatttacagtcaacagatttttgacaagggtgccaagaacacacaacggggaaaagagagtctcttcaataaatgatattgggaaaactgaatatccacatgcagaagaaagaaattgggcccttttctcacactatacataaaattcaactcaaaattgattaaacacttgtatataagacctgaaactataaaactcctagaagaaaacaggaaaaaagctacctgatattgatttgggcaataatttttttatatgacaccaaaagcacaggcaacaaaaacaaaaatagaaactgggattgcattaaactaaaaactttctgcacagcaaaagaaataatcaacagagtgaaaagacaacctatggaatggatgaaaatatttgcaaactgtatatctgataatgggtaagaaactcaaacaactcattagtaagaaacaacccaattaaaaatgggcaaagaacccaaatagaatttttcaaaagaagaaatataaaaggccaacagataaatgatgctcagcatcactaacccacagggaaatgcaaatcaaaacacaatgagatattccctcacatctattagaatagtgtcttagtctgttatggactataacttattatggactctaatttattatgctgctatgacagaataccacagactgagtaatttgtagtgaacagaaatgtatttggctcacagttctggaggctgggcagtccaagatcaagaggccagcatctggcaaaggccttctttctatatcataacatggcagaagggcaaaaagagggcaagagagagcaattcaaattcacagccttaggtgcttttgtaatcggcattaatccattcatgagggtggagtcctcataacctaaacatctcccattcggccctacctcccaacactgtcgcattgggaattaagtttccaacacatgttttttggggaaaacactcaaaccatagcaaatagctattatcaaaaagacaaaagatgacaaatgttggtggtaatgtggagaaaaggaaacctttgtacactgttgctgcaaaaataaattggtacagccattatgaaaaacagcatagaggttcctcaaaaaaactaaaaatgaataccatgtgatctggcaatctcacttctgttatatatccaaaggatacaaaatcagtatgttgaatatctgcactcccatgttcactgtaacagtattcacaatagtcaagatatggaaacaacctaagtgtgtccattgatggatggagggataaagacaatctgatatatatatatctgatggaatattcccacaattataaaatattatttggccttaaaatagaagaaaatcctcccacttgtgataacatggatgaacctggaaaatattatgctaagtgtaataagccagacactgaaagaaaaatacttcatgacctcatatgtggaatctaagatggtcaaactcataaaagcagacagtagaatcttaggtgctagggactgtggtgtgggggaaacagggagatgttgatcaaagggtacaaaatttcaattatgcaagataaattagttctggagatctaatgtacgatatagtaactatagtaaacaatattgtatacttgaaatttgctaaaagagtaggtcataaatgttctcaccacaaaaaaaggtagctaggcaaagagatagatatatcttaattagcttgcttgtggtgaccatttcacaatgtatcaaacatcatatatgaaaaacaaaatatatcaaaacatcaagttgtacctcttaaatatatgcaacttttgtcaattatacctaaataaagattttttaaaagagatgcagttccttgggcaccatgtcagttctactgaatcagaatctaaattttaataagacccttagctgtttcataagcagtaaagtttgaaaacactggcagaggacacagtcagctgtgaaagagtactgggaatgcacagcctatcctccaccctggtctcagaatgatcttctaagaatgtagtgtgtgtgtgtgtgtgtgtgtgtgtgtgtgtgtgtgtagagagagagagagtctataatgtgggcattaatgaatgatcccactgtatgaattaatgagacacgttagtatccaaaacgtgggatttgacaccttgacatgtctgggttctggacaaaattacataacatattcaagagaaagggaatacagtttgagaaatatggtagtaatgccaattcgaaaggcctagatttaaaccatggcatacagcataagaaatactgaaaatgatatcactcatagaacacctgggattttttatctgcttgaatacactaaaataggtatcagtgtaagtctattatatgatcacacatcagtttagtatcatgggaattttttttttttttttttttttgagacggagtctcgctctgtcgcccaggctggagtgccgtggcgcgatctcggctcactgcaagctccgcctcccgggttcacgccattctcttgcctcagcctcccgagtagctgggactacaggcgcccaccaccacacccagctaatgttttgtatttttagtagagacggtgtttcaccgtgttagccaggatggtctcaatctcctgaccttgtgatccgcccacctcggcctcccaaagtgctgggattacaggcataagccaccgtgcccggctggaaattttaaaaaattattctgccatgtagcatttttttcttcccagggaatagaaaatattaataaatttgtggctttgttcctaaacaagttataccagaaatcacaatattcttttttataaatatatctgtattggggggttaaaatagaatgaataacatattcaaaccatataactttgtttaaagatttaccaaggattttgttttctctgctgctctcctttctatataggagaaaatttgaccttctatttatggcctttagatttggcttttgcaagagctagtataattaaatcccaggtaataagtaaacactccaaaccacctctctggggtgggatggtgcaaaatcatttgtagaaagctacctgtttcgtctagctacctcctgcgtaagtgggtactggcagctcttgggggcctgaattttatgtctcattttgactaaaataatgaatgtgtagtctgactccaaaaggggatagtcatctttgatttgagataggtctcgttatgtttccaaatttctgatttaaaagaaatttgttgctacagaataatcattgagaagtagaagaagttttgaaatgaagtatatatcaatgtaaaatgccattccgttttatcagcatccaaaaagtttatgttgaacttaagagtattatatagctaataaatgttgatcattaacttgtgactaaaccgtatgtgctaggaagaatatgatctctcagtgatgtccacattttaatccccagaacatttgactgtgttatgttgcatggcaagagggatttaaggttgcagatggaattaagtttgccaattagctgatgtcaaaatagggagaatatcctggattatccaggtcggcccaatgtaatcacaagaggccttgaaagtgagagagagaggcagaagaggagagtcaaagggagacgtgactacttaagaatagtcacaaaggtgcaatgttactggcttcgaagatggaggaaggaagccatgagttaatgaatgtgtgtggcctctagaagctggaaaagaaaggaaaaaggatccttttctttttctttttttttgagagggagtctcactctgtcgcccaggctggagtgcagtggcgccatctccgctcactgcaagctccgcctcccgggttcacgccattctcctgcctcagcctcccgagtagctgggactacaggcgaccgaaaaaggatccttttctagagcttccagaaagaaatgcagccctgatgacaccttgattttagcccagtaagacttgggtcagtcttctgccctatcgaactgtaagataataaacttgtgttgttttaagccatattaagtttgtggtaatttgccaccccagcattagaaaactaataccctgtatacattggctttgccttcattcgttactcaatctttgtgccttgattagaaacctgcttggggagacaatttattaattcaacaaatagttaatgactgactatacaaatcctagattccatatattatgtgccaggcattgtgctagaaggcctcactggtaaattctactaaatgtttaaggaaggattaacattaatccttcttaaactcttccaagagacagaaaaggagagtaaactttacaactcatactatgaggccaccatatcttgatatcaaagccagacaaatatatcacaagaaaagaaaattacaaattgcatgtaattgaatatgtgagtataatattcccttatgcatctaggtgcaaaaatcttcaacaaaatattagcaaaccaaatccagcagcatgttataaaggttatagcccatgctcaagtggaaattatcccaataatgcaagactggttcaacataagacaatcaatcccccagtcaactccacattaataaaatatagggaaaaaaacccctgcaagttcattctggttgatgcagaaaaatcacttgataaagctgagcaccttttcatgaccaaaaaaaaaaaaaaaaaaaaaaaccactaagcaaactagaaatggaagagaaaatccacaacatgataaagagcattcataaaatacccaaaactaacatcacactcaatggtagaagactgaaagatatttccctaacattagaaacgagacaagaatgcctgcttttactgcttctattcaaaattgtattggaagtcttagccagagcaattaggaaaaaaagaaataaaaggcatccaaattgaaaaggaataagtaaagctatcttattctcagatgaacatgagcttatgtatggaaaaccccgaagaatccacaaaacactatagagctaataaacgaattcagcaaagttgcaagatataagatcaacgtgcaaaaatcagttgtatttctacacactagcaatgaacaatctgagatgaaattaacaaaataaaaaataattctatttaaaatagcatcaaaaagaataaaatacttaggaataaattcagctaaggaggtaaaagacttgtacactgaaaactacaaaacattgctgaaagatattagagacagcataaagaagtgaaaatatatcctgtgttcatgaattggaagacaatattattaagatgatagtactacccaaagtgatctacagatttaatacaatctgcatcaaaatcccaatggccattttttttttggcagaaatggaaaagccaatcttaaaattcatgtgtaattgtgcaagacctcaaatagccaaaataatcctaaaaaataacaaagctggataactcacatttcccaaattcaaaacttcgtataaagctacagttatcaatgctttgtggtactggcataaggacagacatatatataaatggaatagaattaagaagcaagaaataaacccataaatatattcatgggtatgtacctcaaatatggatggttcccagcttataatggttggacttacaatattttgactttatgatggtatgaaagcaacatgcattcagtagaatccatatgcataaaagtacttaaagtacacatacaaccattctgcctttcactttcagtgcaatattgaataaattacgtgagatagtcaacacttcattataaatttggctttacgttatatgattttgcccaactgtagcctaattgtaagtgttctgagcatgtttaaggtaggcctggctaaattatgatgattggtaggttagccgctgatatggtttggctctgtatccccacccaaatctcacatcgaattgtaatccccgtgtgtcagaggagaggcctggtgggaggtgattggatcatgggggtggatttccccttgctgttcttgagacagtgagtgagttctcatgagatctgatggtttaaaagtgtatgacatttccgtccttcactctctgtctctcctgctccaccatggtaaggcgtgcttgcttcccctttacctgctgctgggactgtaagtttcctgaggcctcacagtcatgcttcctgttaagcctgcagaactgtgagtccattaaacctcttttcttcataaattaccaagtctcaggtagttctttatagcagtgtgagaatggactaatatagctgtattaaatgaatttacactaataatggttttaactaacaatgggtttatcaggatataataccatcccaagttgaggagcgtctgcaatttaaaacatctgttcaaacaaacacttgtacaggagcgttcatggcagcactattcacactatccaatcagtaatgtaggggatcaaatgccacctcaaaatatgccactttggcatattgattattttgtgtttaaaggcacttgaaagtagcagatgcaagaagggcacactgaccttcctttttttttcatgaaaggaagagatgaaactctgatgtgaaaggtattatctgtataccaggaagaagaaacacattcttattgccagagatggggagtccaggcttgagggaaagctgcaccaaaaaaccttgttacacaactcttaccttcttagtgacttttccacaattaactctcctagcccaaaccccaatgtcttgttatgttttcacaatttaccatacttttcccaccctagtatgtaagtattcagctgtaattaatcacttgagtcttcgtatttcttatgagggctcccatgtacatgtaaaaaatgccaaataaaattttgtatgcttttcttttgttaatctatcttatttaagtcctagctggagaatctaagaggatagaggacaacatttacctcccctgccatggaaatcatttaatgaactgttcatcaactgatgagtagataaacaaaatgtggcctatttatacaacagaatatttctcgttggtgttgtctcaatgcttaacacagtatacctggcactacccttcaatattttttgaagaatgagcacatgaattatcatgtctccagctaggttcaccagtatgagtaatatgtagtgagtgtctactgtgtgccattttactacctaaactttttatggactctgtcccctagtcttatctaccaatgccattgtcttagttgagatatctgtcatttcttgactggtataatacagcagctttctaattccaatctcagtcctctctgttctattctccacacacaatcctctctgttctattctccacacagcttccagggtgatatttctagaggcaaatcagaccacgtcactcccaagctgaaagaccacagtgggttcagtgtagcctacagggtattctaaaacctgagcatggcataatagaacctccatgtcttggctcctgcctacctctttcccagccacatcaaccactactgctccactggcatcgtactctccagccttaatgaattggttgcaactcccctcctcccaccggtgccttggcttctcatcatgctacagattctttaacacacacattgtcctccaagaagcttgccagatccactcctattctttcaacgaaatgtttattgaccactctttatacactatgaccaaataggatttatcccacaaatgtaaggttggttcaacatgtgaaaatcaatttatataatacaccatattaacagaatgcatggcggagcgggggcgggggagggggctcatggtcatcttaatcatgtacaaaaaggatcatttgacaaaacgcagtaccctttcatgaaaataaattcaacaaaccaggaacagaaagaaacttcttcaacctgatagagggcatccatgaaaaacccagagataatatcatacttaatggtgaaagactggttgatttccccctaagatcaggaatgccacttgtaactcaacatcgtactcaaagttctagtcagggcaattagtcaagaaaaagaaataaaaggcatccagatcggaaaggaacaagtaaaaccatctctattcatagatgcatagatggcatgttcttatatagaggacactaaagagtccaacaaaagaaaaaaaaaaaaaactgagacggtttggctctgtgtccccacccaaatctcatgtcgaattgtaatccccacctgttgaaggaagggcctagtgggaggtgattgaatcatgggggcggacttcccccttgctattcttctgatagagcgctcacaagatctgatgattgtttgaaaatgtgcagcgcttccccctttgcgtgcgttctctctctcttcctcctgctccaacatgtgaagaaggtgcttgcttccccttcgccttccgccatgattgcacgtttcctgaggcctgcccagaagcagaagccttgtacagcctgcagaaccatgaggcaattaaacctcttttctttaggaattacccattctcaggcagttctttatagcagtgtaggaacggactaatatgccaaccctgtctgagtatgctcagcaaagcatattcggctcagcaaagttgcagtatccaagatcaatctgcaacagtcggttgtatttctacaccctagcaatgaataacatgaaaataagattaaggaaatgattcattttacagtagcatcgaaacaataaaatgtcgaggaataaatttaactaaaggtgtacaagatgtatactctgaaaatttcaagacgttgctaaaataaattaaagaagacctaaataaatcgaaaggcattttgtgttaacggattgggacacttaatattgttaagatgcccataatctccaaggcaatatacagattcatcgtgatgcctgtcagaatccaacctgccttctttgtaaaaactgacaagctgatcctaaaattcataagaaaatgtaaggggctcagatagccaaaacaatctcagaaaagaaaaaagttgaaggactcacacttcccaatttcaaaacgtactacaaaaccgcagtaatccgaaaagggtggtactgccatcgtgatcgatacattaggtcaatgttacagaactcagagtcaggaataaacccatatatttatgtaaagtttattttcagtaagagttccggcacccctcaatgggtggaggggaagaataatcccctcaacaaactgcgctgggacaactggatagccacatgcaaaagaaggcccctggacccctacctcacatcatgtaaagaattaattcaaaatggatcacagatctaaatgtaagggctgaaactataaaactctaagaagaaaacggagatgtaactttgcacgaccttggattaggcaacagctccttcagtatgacaccaaaggcaaagccacagatatcttttcatttggcaagttggactacatccaaatgtaaatcttttgggcaacaaagggctctatccagaaagtgaatgggagaaacatttgcaagtcacatatctgataagagtctattttccagaatatatgaataagttttagaagcccacagccaaaatacaatcaaccgaattaaaaaatgggcaaagggcttgaatagacattcctccaaagcagaggtacagagggccaagaagcacatgaaaagatgtcttagtctgttttctgttgccataattgaatacccgacactgaacaatttataaagaaaagaaatttatttcttaccgttctggggactgggaagtgacccggcatctggggacggcagagggtatcacacggcgagagggcaagagcgtgtatgtcgtttcaggcctctcttcctattcttataaagccaccagtcgcatcctgggggtctcaccccgatgaccttatctaatcctaattaccgtctcagaggctgcgcctccaatcaacatgtgaatttggggattaagtttccaagacacacaatttgggggatgcactcaaaccacagcaacatcattagccatttgggaaatacgaatgaaaaccaccatgagatagcacttgacacccagtaggatggctactgtaaacaaaacaaaatgaggcaaacagaaaacaggttttgatgaggctgtgaagaaattgggactctcatgcactactgttgggaatgcgaaagattacagctgctgtggaaatcagtttggtggttcctcaataagttaaacagaattaccacacgagccagcagtttgactgctagaaatagacccaaaagaactgaaaagagatattcaaagaaaaacctgtagagagatggtcatggcagtgccactcacaatagccagaagggggaaataacctgtccatcaactgacgagtgggtaaacaaaatgtggcctcctattcatacaacagaatcgtactcagtcattcaaaggaaggaagtagtgattcatgcctctacatggatgcaccctgatgaaaccattacgctaagtgaaagcagccagacacacacggcctcacatttggtcgtataattccatctataggaaatctccagaacaggctaacctctatggacagaaagcagatggactaggggttgccagggactatcgggaacgtgtgtatgggcgggggcagggggtgtgtgtgggagggtgtgggggctggtagtggtggtgtggaaggaggcgtgcggcaagtgactgcttataggtacaggggtttcggtttcttttcggggtgttgaaaacgttttggaactaggtggtcgtgatggatgtgcaacattgtgaaggcgtggtacccgtcctcccctcgcccacccctttgtctttcccacggtgttcccatccagtagaaagggaaagttcccactggcaaagagagggtcaccagcgcgattccccctgccccgccccaccccacccccacggccctccagccacttctaggcccaggcctgctccctcgaggccaatgggaaagtgatgaggtcacctgacggacgtgtgtcccttgtgaggggccgtcaccacatgcgtgcccgtcgccggatgtgcgtgcccattggtctcggctccctagccaatgaggggctgggccctggtcgctaggatacacagtactggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcccggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagccatctgcccgcttcagtcactttgccttggggtgggggtgggggggcggtgagatgggttggggggttgtgagacctccacagctggagggatggagaggtggtgggggtctggggttgggtgggagccagggatggcacagaggagcagtctctccgggtgacagtgcaggggagtggccctgggtgggaaggggacacccccgctggttctgagcaagtcagggcctgcccgggaaagtcctcagcatgatggtgttcgttggggcgggtgggcctcaagaccatgactgcagtgttgcgacaggacggacttctaaggcaaccggggtggggacggagaggtggacccggtgcttggcaaggggccctggaccggaagacggaggactgagtagtcggggcggggggggggggggacaacagtctagaaatgcgcagacatggaattagggtcacgagtttcgtttgggtcatgttcagatggagaggctgtgggatgcctttagcaacctagaccacttgcattgcagccgagctagcagcagctggtgccccgccaggccccgcgtaccttcccagggtcttggatccgcatccccgagaccctcgatttgcatacgccgctcacagcccggccaggccccgcctccgatcccgctctttgcacctcatcagggcaaggggcaggctcgggctggggagccggcgcgggcacggcggcagcccgccgagggggacgc

SEQ ID NO: 1419 - DNA, 26107 bp, Homo sapiens
aatggaagcaaaactttattcctcttggctggagaagagaactagtgggtggttgtgtacaggacccccatccctcacccctcccagaaccaaagaagacaagcagcgccaccaaatggctccctctgcccaagtgaaagccgagaggtcagcggctggctggggaggcaggtgagcgcagcacggcacagggcaggggcggctgcagtgacaggcgggcggccagggcggcctgggccggggttgaggggaagagggcggggctgcttgggtagcggggcaggcttgggggctgccggctggcacgggccccagactcagggcaccacaacgcggtaggggctgcctgggatgtgctcgtccccccatttgaccaccagtgtgtactcccccttgtccttgagcaggtaggacacgctgtagagccggctgcccacgtgcttcaccaggatctcctcgcagggggtccttgggccatgaacccccaccagcagcatgttgttgcctgaggcaagaggggtcctcagtcccaggtcccagcccccttcctcccgctggtgtcctgctctcctctcctgtccctaagccagttctggggtgacagttctctcttcctaaagagctgccagcacctccccaacccaggccagcttagcagattccagctcctccctggtctttgtttgaggggtccaggaggtggcagggaggtggctctagaagtgaaagccacgccccaaaggcggtccctgctctcccagacactggccatcctgtgatttctggcctcattttggtgggaaggtgggccgggggcccgggttgcccacctgctttgctgcagtctactgtgaagctgctcttctggcctacgtaggccttgctcagccccaggcccttggccaccaccttgctggcgtcagcaggcccaggacccggggccccatgctggggggcacaggtggccttggtcagagagtctacaaacactgatgatgtctcgtggaggctgtggttgctgacgagacgggggcctgcaaggcagagtgggtggggctaagaggtggctgtggtgccgggcgttgggcagatgccaatagcttggccccaggctcacctgtgactttggccttgaaggggctgcccccaatgtggtaggggccgccgtacttgatggagatgaggtagctgccaggtgccatgggggtataggtgacgcggtagccctcagggcactcctggcaatccatcttcaccttggaggggccgtcaatggtcaccgacagggcaccagctcccgcattgctcgtgttcacgacgaactcagctgggttccctgggagcacaggaggtcaggcagagccagactggcctgcctccctgtcctcggccacccagcacaggcttgtcacctccaggtgcctcctgttgtcaccaagagcttggaggcaagggcctagcagctgtgtgcacacgtgcagccgcaccgacagacttacctgtgacaccgccttccagacctgctccgtaagcagacaccaagcctgggtcccctccatgcccaggctccccaactcggatcttgaaggggcttccagggatgtgggtgccgttgaacttgacgtcaatcaggtaaacgccattctcccgagggatgaagcgcacagcatacttatctgaggagcagggagtcatgctgtgggcctggggcccctcctcaaaccagcagatggtgtctgtgaggaacagcctcaaccctggccctccccattttgccggtccatcagtgtgagcccagccacgctgggcacctgcaccccgcagcagacctcctgagggccgaaggtttagacactcaagctgcccaccgtcagggtgcattgggacggaaatcttttacaagccaaacccaggccttgctgcctcctaagaaaggttaccgtgaacaccatatcccctgcatgttaacaggctcagagacgggcaggaacttgcttcaggtcatgcagctgggaagggcaggactaggccgtgaaatgaagcccactgggctcctcctacccacaaggctgccccaggcctgtgcacaagtaccatggccgtggctgaagggccgggcagcactgaggctggactttgagtctttccctgtggagatggcatggtactgcagggtagaaggccttcctaatagctgtgggtggcgagccacatccccagcggcttgggtcaccaattgggaaagggttgcctggcttagggggcccaggagttggggccccgtcttggctgcttacagaagcggtaccttccttttgtactctcagcctgcttccagccagcagggcagggcggccgggcagggacagggcctcaccttggtcaatttctgtgacatagcactcctccagggctcctgaggggctgtgcaccttggcatcgatcgcccccttggccccgttcaggctgactgcaaaagaggctggctggttgacctttagccctgactcctggaagcacagcagacatggttagatgggggtgcttgagccagggcaagggaggacggaaaggccccaggagcaagaggcccgcgggtcgcacttacccatctggcgtccaacttggtttaaagagggagagccactgatttgcaaggggcagcaagccacaggcgcacatccccgcccctgcccccacactctgccgtcgcacacacccaggtggcaggaagggagggctgccccaccctgtgggcagcacccagccttggcaggctgtccctctttaaaccgcagccctggtgctcaaggggcacaggcttctgttcaaagcctttagacctgagacacgagaaaaactccacgtggtgggcaggatatttcctgccgaccccaagcgtgggctgcacccggccagagcagaggcctggaacccagagctgggccaggggggtcactgaacacagggccaaggcctggtctctgcggtggctctggtctgtccgggcccaggagccccaggtgggcggtttctctcggtgcctcacctgaaggctagaaacagtgaggcggcgggcgtcgccagacggagaagccacaggcaccacgaaggggctgtcgggaatgtgttcctcgttgaacttgactgagacttcgtagtcacctgggcagggaaagagtgtaagaccggctcatcagcctttgggcctcccacctcccacgaacagcctgggtggccctgtgacctcaaagtgaagagtgagtgccaggcagggctatctgtgccagccctgggtccaatacccacactcaggccccacctcctccaaccccagccgggttcccagtacctggctcctggaccacataagccacaccacaggagccgtccttgcggtcctcaaaagagatctcagccttgctggggccctcgacagcaatggccaggcctccagcaccagcttcccgggtccagatactgaattcggctgtgggagaacagtttgtcctcactgaaggctgcttcaccagcctcggccccctccaggcatagccaaggtagacatgcctgccggctctttcctccacccccaaccccaccctggccaacgcaggagagcgagcactcggggtgtgagcaggcctacctggcactccagcttcagctctctccaggccagggcccccagctcggaccttgtgggctcccccttcccctaggggccccacggtgaactggaaggggctcccaggcacgtgctggcccttgtacttcacgctgactgtgtgtgtgcccatctcagcgggaacaaagcggatgcagtaggtgtggttctccccttccacgatctcggcctcatgggtcttgcccgatgggctggtcacctgggctgtcatatcctggatgctaatttctgcagggtggggatgggctagtgagcagcagccctgggctccacccctcctcttggggctgcttgagccccaggacccctccccaggcttcccacagcccctaccagggattttcaggctgaggtcacaatgactaccaacgttggccactgaaggagcccgacgcctgcgggtgatgctctctttcacccggccctcgcctgtcaccttcacagagaaggggctgcctgcaggaagaaagcacggcccacgcccctccagtcacatactgcctgtgggccctggtgtagtgaggggggctgccgaggcactgctgcactcaccaggcacgtgctggtcggcaaacttgatgttgatgatgtagttgcctggctctgtggggcagtaggtgaccctgcacgtcccgtcctccaggtcctctgtgttgatgtccaccttgctggggccctcaatggacaggctgagcccaccatagcctaggggatggatacccctgagcctcggtgctatgcacagtgctcccgccccagctggtgggcagccactgcctacctgcatcgcgggtatcaatgataaactctgcaggctcaaaggtgtggccttcgtgaaggccctgaccagagacccgaacacgactggcatccccaatttccgactggctgatcaccaccgggatggggctgctggccacgtgctggccatttttcttcacatgcaccaggtgctcccccgtctccttgggcacgaatgaaatccctggacacagggcatggctgtcagtcagggagggcatggctccccacaggctgcctcctttctgaaccccctggacccttcagccgcttacccacgtggccattacgcagccgcttcagcaaacagggctcctcccggcccgagggcgggaccacagtggccgtcagcaggctgagatccgtctctgagatgttgatggggatgtcggcagcagagccgacctttaggtgggacatacgcatggagtcgtcacctggtggggacaggccagccatcagtgtgcgtccagccatgggagaccatgcccaccctgccacccgtttctgtcactgctcccagtgccacccacctgtgacccgagcagtgaaggggctgcctgggacgtgctgttcattgtacttgactagaatgctgtagtcccccggcagcacaggcaggtaggacacgctgcatgtcccatcctggttgtcagtgcagctgatttctgctttggacgggccctcaatggccagagacaggccccctggagagagccgtgggtgagcatgggaactatgctggggacactccagttggcctgcactgaggagctccgatggccagggcagcagggcagggagccccattcaggagtatctcctgagtccagcccttaccccggtgagggcatcccgggcacagagcaggtcaagaccagagctattgctcaccctctcctgcatccttggtgttgacggtgaaggtggcaggcttgttcactactccatgggtgaggccaggcccataggcagtgacatggccacagttgacgtaatccacatagaactgcaaggggcttcctgaggcaggaagaagggccttgtggaatggcagcctcgtgtgtcccccagccccatctctctgtgaggtggtggcggtggagtgggcagaggcagggcaggcccacctgggatgtgcatgttgtcatagcggatgtccatctcgtgcaggccagcctcgctgggtgcataccgcacggtcacggtgccgtctttgttgtcagtgatggtgggctgcgccaccttgcctgagggcatccgaacctcccctgtggggcagtggggctgaggtcagggcagctcattggcacagtctggcctccttggctcccgagctccttcccaagtccccactcacctgtgatctcgcccttcttgatggtgaaggggatgacaaggtcaaagggcctcaggctggtcacatccagcccattgacacccaccaggggcctctccggggcctgcagtggagacacagggcatgggtgagggacagtgggaggatctggggtccctcctcacacatggtaaactaggggctcacagaacacccagctggctagccccagtgtccctagctggccaggccgtacccaagtctgctggccgccctgggcgtaggtgtactgtggggccagctgctgagaccgtagagggggctgcaccgagggctggtccccagccagagcctgcagggcaaagcagagagctgctggagagtctgttgtcacagaggggccccaggggaacaggccgggacctgccagacacccctgctgacctaccccccacccctcctcaccgtcacttggaaggggctgttgggcacgtgctcgccaccaaagcgcacacagatgacgtatttgcccggctggggggccgtgtagaagatgtcgaaagtgccgtcctcattctccaccacgtccacatccacctctgagccatcaggcgtgcacacggtgcacgtcactttgcctttgcctgccgccttagtgtccacagtgatcaccgtctcctccccaatctgaatggtggggccgatgccagcacctggtggggcagggtgggtccccaaaggggggccagcgtgtgagctcgggttcaggttgttcccgtccgcctgccgcccacacaggcctctcattgccaccaccaagcacagccaggccgccaggcctcctgccccgccctgcccctccaagctgggatggcgagtggtttctcagaaggcaggaaggtttctcctgaccacctcaagtgcccatgtgggagaggcccgacagtagcacccaggtgcctgggaggaaaaggaagggcccactccagcctaagtgttgacagccactcccttgcctactcagcctcgtccagcaccatggcccacactgctgaacgccagcatctggctgggcacacggctgcctgcgcccttctggcctggccccggcccccattgctgtgtgtggacgcggtgaggcggagtcctgctgcagcgtggggggatgtgacacttgcctccccaccccccaggcctgatggtgaaaccggagtttcctgacaactgagaaggctcgcggtgaaaagcagcccggtgcagacaggagtgggagcggggaagcgggaggcagcggggttagcacccgagtagcgcagcgcagcaggcttggcagagcggggatagcacccagggagacagggaacaggaggcccaagctacagccaccactgctgggttgcgagggcagagcagctgagcaggctccagggccccagagtgcccgaggaaaggggagagacagtgacgttatgatctgggtctccgccgtggaggcttggggggctgtgggctgtgaggcctggcagtgagagtgccccctgcagcctggcctcctgccagggaagcagccaggagcacgaaacctacttgaaggccaagctcgaggggccctgccaccaagtcccactatcggccgagggctcctgctgcactaggctccatgctggcctgccgcggccaggcagctctcccaggctccagacctggctgccggctgcccacgctgccctgggaggcttcactcatgtgcaccccatgccatctagttagtggcttgggccccaacctcacaggtacccgactgcccccactttccctgcccggctcccagccaaccgcaggtctcagccactccatcctcaaagtatgcctcctaatttggctctcactgaagccccgtggccgtcaagcttgccagagagcaacttcagcgcccccttccccaccccgggctccctgtctccattctgcaaacagtagccagggaaactgaggttactgagtcttgctcccaccctcaaagcccccaaggccctgcaatcagtactccccagcctcccccgccctgcgcacacacgcctgtcacacacacatcggatcctacggcctgctctataaagccatctcgctcctgccgcaaaactctagccaccctctcaccctttccttagccacctcgcccaagtgccaggcctgtagcctctcatcagcatccctgggtgtccctggctggggcaggtgaccctccatgcctgttggggaatgtctgaataacgtcactgctgggggataggggaagggggaaggagggagacgggccacagaatgcactttggggctctgaggctgggccgggccccgccatgctggccgcccaagcagtcgacactggcgctactgcactaccagccagccccacccgctcatgcacctcccccggcccgggacgcagaggcccctggaaggtggggatgggggtctgtggatctggccagggctggggctcccattgagttggggagaccccttgttccctcagcccacgcaggagcccttgtgcctccctgggtgccaagatcccgagaccccaaagtccccagtggggtgcctctcaggatgcacctcaccccaaagctctcagctgcaacccgagttctcagatggggaaataaaggcccagagaggggaagagctggagcggtcatgctcagctccggaagcctccctgggccctcgccctccagcccacggcctcatcttctgcaccccacccaactctgtccctgcctagagctgcagctggaactgtcctgggaatcggccccaagaggaaaggaagctgcccctctgggcaggaggggcattgggagtggccccagcaagcagcttacctagcccgtgacctccgattgacactgaggtgagagggcagagagcaaggagaaaggtcaggtgagtcactcaagggggcggcccccactcccacacgccgccccaagcagcgagcccttgcacacaggcacaacccaagccccgtgccgagcgccgcagcggccaacagcgggcgggctcacctgtgacagtgcacttgctggcgtccccggtgggcacggcacgcacgcggtacggggagaaggggatctcgtcaccaccgtacttgatgaggatggtgtagcgacctgtcacgtctggcacgtaggccactgtatacgtgccgtcatggttgtcttggatgtgtgtcttcttcggcttgccttcgggatcctgtgtggcagaggcaggggaggcagttggcccaagcccgagtagccccgggcctgcctcaggcgctcccagagtgcccagcgctgctgctacagggacagtctctgggcctcaggcatcttaactgctatggcccaaaagggctgcctgcacctggcagagtccagaatggagactaaaacatcccacacttcccacatgacaacaggcgcggccagccagcttggcacccatcctcagccccagggcctggccagcactaggaggagctcaccggggtgatctcaagcttctatcctatacctgccccatgagaatattacaggtggggaaactgaggcacagaaggctttggtgacgtgctcaaagttagcagcaagtgcacgtctggggaagcctgtgcctgtcaccaccatcctaaggtagtcacaaccttagcaaaccaaagacaggggccctgtccttccctgccctccttggtgcagctccgcagggagatcagacaccagccacccgcagcccacactccagccgcccaggcccccctgcctcccctgcctgtgcccggagctcaccgtgatctggacagccagcaggccctccccggcgtcctttgcatcgatggtgaactccacgggcaggctggcaggcacgccagtggtgttgagcccggggccactggccttcaccttgctggcatcatgagtaggcagcaccttgaccttgaaggggctgtgagggattggtgttgtgagcagtcagacaggttctcagcatccagcctgggccactccccacaggcagcaggccctgcctcttacctccggggtacctcttcatctccatacagtactgagatgctgtagggcccttctcggctgggcacataattgacggtctgggtgccatcagcgttgtctaccacgtccactggctccaccaggcctggccccagccccagggacagagcatcagctagtctcctgggcctccattcctaccccaccacactggacggccaggacccagccccaggcctagacctcgctttatcctcatccacccgaccctgggaatggccttgaccccctctggcacgaaagacacccatctgggtgccagctgggacccttgcctgcctgccttcctgccacatctgctcagtgaccagtcccatctgctctacctcctccaagtcccccacctggctgcactgtcacctgaggctcttccaaaaacacctacacacttgcaccacctctgcactctggtcctcactttgggcctccagtttcctttcccggccctcaaacaggacactgccctcctgacccctggctccaggcatgcaaacactcacctttgggcccttgcactttgacctgcaatggggccacaccagccttgcttgtgtccacctggaaggactgagggaggttggcacgaaccatgcctgggctcaggccgggcccagagcacttgaccttggacgcatctgtcacatcatgcacagggaccttgaaaggactgcctgagggttggggcaaagggatggcggctgtatgagacagggtggggacgagcagacagtcccagccctgccctggccgccacctcctcacctggcacttgatggccaccataggtgacgttgaggctgtaggtgccagcctcataagggatgtactcgaccgagcagctgccgtccttgttatccatgcaggacatcttggcctcggaggggccctctacagccaggcccaggccgcccgtgccagctcccctggtccaaacagacagccggtcattcctggggttcccaggcccaccagccacacgggctcctgggggctcccttacctggtctccacagtgaacttgttgggcttgttggtggtgccactttggatgcctggcccgtggacacgcacccgggaggggtcgcagccctcggtcacgggcacctggaaggggctgctgggcacgggactgccgtcataggtcacgtccacggagtgcagtcctggaggagtgcaggccaggtcaggaggagcccgggccaccccacccaccccgtctgccagcctgtgggagtccccagcacgcaccctcctcgtaaggcgtgtactccactttgtacatgccatcgccacggtcctgaacgtaggtctccgtcaggttgcctgaggggttggccacacgggccttgacgtgcggccctccggtctgtgtcagagcccgggcgtccacactgaactcagtggtggcctcacggaagacacctgcaaaggcacagagaggaggcttggggctcgggggttctggtccctgtcccccgtcacataccccacggcagggcaactcaccctggccctcaataccaggcccatagcactggacaccggaagtgtccaccgcaggttccacctgcagcttgctggggaagttgggcacgggctggccgccgtacttgatggtgacggtgtaggccccggggcagaggggaatgtaggtaatggtgtgcgtgccatcaccgtggtcctggatgtacacctcggccggaagccccgcctccgagcagatctcaatggtcagctccgcgctgcccgcgctcgagcagtccacttggaattggcccacctccccagcggtggcccgctccagcccggggcctgagcacttgactttggatgcgtcaaagcagggaaccacgtgggccttgaatggggagccagggatgtgggtgtcagcgaagaggatgttgatgttgtagtccccgggctcggtgggcacgtaggacacggaacatgtgccatccccattgtccaagcactcgagctgcgcctcacaggggccctccaccgtcaggcccaggccacctgtgccggcgcccttggtgtcgatggtgaagcgggcgggggagcccgcactgcctccctgcagccccggcccaaacgccttcacctgagggaagaaggggtcaggagccaaggccacactatgccccgatcccagacctcctgcttgactttccacctgcctccccttgccctggcttcctgccctcaccaaacagggacacgggcgggcccaggctgcctgccagatgggccatccatcagtcataaggacaaaaaggagggcagggcgcggtcactcacgcctgtaatctcagccctttgggaggccaaggtgggtggatcacctgaggtcaggagtttgagaacagcctggccaacatggtgaaatctcgtctctactaaaattaccaaaattagctgggcatggtggcgggcacctgtaatcccagctacttgggaggctgaggcaggagtattgcttgaagccaggaggcggagggtgccgtgagccaatatcgcgccactgcactccagcctgggcgacagagtgagactctttctcaaaaaaaaaaaaaaaaaaaaaaaaaaaaaaaaagaaagaaaaaaaaaaaaaagaaattcttcaaccctgatgactttttgtgggtttctatttccctcctcccctttactctcacttaaacagggtcaaggttgacagtctgtctcaggaaaaaaaaaaaaaaaaaaggatttagggcaggtctggagaagatggggtacctttggggccctcagagagcacagtgggttctacccttagggcctcccataccccaattaccttgctaggcttggtgggggccacagcttccagaggaaaggggctgccaggcacgggcacgccgtcataggtcacctccacctcatagggcccttcctcacggggcaggaagcgcaccacactgttgtcagcccccaggcctggctccaccttgcagggcaccgctgcacccgaggggcccacaatcttggatgccactttgccttgaccaccagcaccctttgatttgactgtgaactcctggtctttgccaacgtccacctctgtggaaacgatgaaaggaaggagagagacatgacacccagctcagccaatccctggatgtgacaaaggcctttgcgacaagggccccaactacttactctctcccaggccagacaccttgatcttgctgaggtccaggcttggagatactgccactgagaaagggctcttagggatgggatcccctccataagtgacattgacgcctactggaccctgggaagggtgcagaagggaagggggtatttagagacaccagaattgctccccaaccccctcctggacctccatgcctgtcctctcccaggtaaggaatgagagtgggcagaaagtccctcggagctgtcccctaggctgctgcatgaggaggctggggactcggtgactgtagtggagggtgtggctacctgctggacaggcgtgtacttgactgtgtaggtgttgtcatggtggtcgatgatgtccacatctcgcactgcatcccccttggtgagtcctgagaactggacgtccagcttgcctttgccagcagctttggcatttactgtgaagtgggtgggcttgccaagctcgacacctgaggaacacacagggaccatgtaggggcaccctgccccaagccctcctacccttgatgccccgcaacctgccatggggtacctgtcctcaccagtgcgactgaggccagggccctcggccttcaccttactggcgtcatgagagggctccaccttgactcggatggggctggtgggcgtggcctgcaggcagtgggaggagaaggccttagaggagggcagacgtcatccgcaatgacatcttagcggccaggagcgcagcacccacctggtcagcaaagaggaccataatggtgtagctgccagccccccggggcgtgtacttgaccgtgaaggtgtcattgtcattgcggatgatgtcgaagtcgatgtcagcttcggcggggcctaccactccaggggcacacttgatgccgatgctgacgtcccctgcggcggggagaggagcggaggctgagacctcgcagggacaccccagccacctgccctcccacccacagccaggccttaccctggccagcctcggcgcagtccacagtgaagtaggtgggctcgtgggccttgagccctgtcttggctactccggggccgtatactttgaccttgttggggtggctgccagctcccacattcacctgcagggcacaggggcaagggcaagggcatgagcagcctggaggagactcagaagctccctcagctacactggcaggcacacaaaatggtccagctgccttgggaagagtctggcagttcctcagttgaccacagagggactgtgtgatgctccggttcactccgaggcaactacccaagagaaatgaaagcaaatgtccacgcaaacacctggactcactgttaacagcactgttcatgatcaccaaaggcaagctcatcctcaatatctgttagcaagtgaacggaaaaatggaatgtggtctggccacacaatggagtattatgcggccataaaaataaatgaagcggccggacgtggtggctcatgcctgtaatcccagcactttggaaggccaaggtgggcggaccacctggggtcaggcggttgagaccagtctgaccaacatggagaaaccccgtctctactaaaaatacaaaattagctgggaatggtggcgtatgcctgcaatcccagctactcaggaggctgaggcaggagagaattgcttgaatctggcaggcagaggttgcagtgagctgagatcacgtcattgcactccagcctggcaataagagcaaaactccggctcaaaaaaaaaaaaccaggatgggcgcggtggctcatgcctgtcatcccagcactttgggaggccgaggtgggcagatcacaaggtcaggagatcgacaccatcctggctaacacagtgaaaccttgtctctactaaaaatacaaaaaattagccgggggggtggcgggcgcctgtagtcccagctacccgggaggctgaggcaagacaatggtgtgaacctgggagaaagagcctgcagtgagccgagatcgcgccattgcactccagcctgggcgacagtgtgagactccatctcaaataaataaataaataaacaaaataattataaaggaacaaagtgccaagacatgccaaacatgaacgaaaacacggaaaacttcgtggtgagcgaaagaagccagacacaaaaggccacatggcacacagttccatctatagaacatgtccaggataggcaaagccacagcagaaagcaggttagtggtcaccaggagctgtgggacaggggagtcaggatggtgtgccacaaccacttgaaatggacgaatcgtgtgctacgtgaatgctatcgagatggactaaaggccggtggaggttggctcaccctgaaggggctgttggggatgctgacgcctccccaggacaccatggctgtgtgcttcaccggcttcctgggcacgtaggagcagctgtaagtgccattgccgttgtccttgaccaacgcctccacagggcagccttcattgtcctgtcaggcagataggagcaggtggcctgctggtcagtgcccaggcctgggtgcccacacctgccctgcccccaacacccgtgggtgctctacctggacttggacccgaagtggggccttgccaccgtgcttggcatccactgtgaactctgctggcttgttgacggccacacctgtcttctccaatccaggcccacgtgccttcacctagcgggagaccacccagctgtcagggggccaggtccaggctgccagagctacaacccaggcagggtggccagggacacagagtgccatccccaccagaccccaagcaggagcagcagggcgagacttaggccatcacagcctgctctttaccctgtctgggtggaagtcctggggcgcgtcacggatgtcagccatgaaggggctgaggcggatgtcttcgctgttgcacagcacgtgaacggcatactcgccagcctcctgcggccagtagcgcacatcacaggagccgtcgcccttgtcgtcacattcgatcttagcctgcgatggcccttccaccgagaagcctgacaacagccaccagtcccctcagtgccctggagcctcagggtgggccgtccttgccatcgtctgtccccaggtgcccatgctgcagcctccaacttacccagcgtgcccacgtcgtccccgatagcctccaccacaaagtctgctgacttgccaacgacgccgccctccagcccagggccccaggcccgtaccttctgattgccacactcggtgcccaccttcacttcgaagggactgcaaatgcgagagccacacagggaacaccgaggatcaccacatgagccagcgtgggccccactgtggcggccaggcaggaagagcccatgtggcccctcatcatcaggtggggaggcagaaggaagagaagaggcagagtgtgcagagctgggagagggatgcctgggggcctcacctgcgcccgatgttctgaccaccccacgtgatggtgacgatataggttccagggaccatggggtaatactcgaagccatacacgccatcccccaggtccttctgcttcacgcgctcctctccctctgccaagacaaggagggcctcaggcctgcccagcagtgaacccgggggctgccgccacccatcctggcctggctccaggccaacttactggggcccttcacggtgaccttcagctccccactgccagcgccctttgtgtacaccttgaagtcagctgtctccttcacccgcacacccttgggctggaggccccggccaaccgcccggcaggcactcgggttacaggctgcaggcagaggggccagctgagcaccagcagctcggctgggcgacccctcccttgcctcccacagggccgggctgtcaggattggtgggtccctcagagcttggctggagggggacatgcaagacagaactggaagggactgtgaccccaggaactgtggcctgggccaggacatggcaggcctcctcccacctgctccacaccagcccagagccccccagcctcccccttccaagaagaagacagatccaagtaccgttgaccctgtgggcagagcagagagcagcaggtttctagacagctggagcgagctcttccgaaggtgaaagcgtgaggagagagatggagaggggcgaggagaggagaggaggaagggccccagcaggggaggaaaaacagcatgtgcccagacagtagaagctcaaagagtaggggccccggggcgggctgcagcgggactggcccagggggtccccctcctgtgggaggcccagactgcagtgccacagcagagggcagtcagggccgggcctaccttggccaacagtgacagtgtaggggctgcgagggatgggcacgccggcaaacgtgacgtgcacggtgtggacgccctccatggtgggctggtagctgcagcggtatgtgctgtcgccccgggcctccagctgaggctctaccgtgcccttctgtcccatggggtcctggatcacaacctcgacctcgcccgtgccagctcctgccacgaggcacctgctcagctcccaggccccagtgcggctctccccacagaccagctgggccttggcagcctcccctcacctgccgtaaagatctcaaagtaggtggtcttgttggcgatgttgccactgggctccaggccgggaccttgggctgtcactttgctggcgtcaccctgtgacttatccacgtacacctcgaaggggctcttggcgatgtgctggccagcaaagagcacagtaacctgtccccagaagggtgggccgtgagggtagggctgggggcctccagccactgcctgaggtcacaagcctcccccctggccaagggctcaccttatgagtccccgtcacctcggggacgtaccagacggagaaggtgcggttcttgtcgttattggcggtcacttttgcctgcagtgggaaggagcctgtgagcctttgctaagagcagccccactgaaagggagcgctgcggggcctctgctgccagcagctggccctacctcctcctggtgtccggccgggtcctccacgtacaccagcacctctccctggccagcacttctggtctccacagtgaactctgcccgcttcttcaccatgttgcctgtgggctcgatgcctggcaggggaaggcgagccaaccacgggccagctgttaaggccacagcctcacccctccacccttcagccctccctgctggcccctaagtcaggcacattccaaactgggcaagttcattcagtgtgagctgtggcacagagcctggcctcgggacccagctgtgctctcgctgctgggacaggcccagcctgttttctggaacattcattctcaccgcactgggcccttgttcctgtgtgagccttgactgggttttaggtccctgttactgagacctggttcatctccatttataataaagaccgctggatgctacctccccgaggaccccacgcagcaggcttctgtgactggaggaacctattagcattctcttgtcgttttcactagtcccaaaaacccactcttgtctgactcttgggtggcttgatcacctagccgccatgtaacccaagacccctggggaccgccacgtttagatgggacactgtcttatggggaagacgttggcacacgggtgcacccctggtggggctccctcacctggcccgtaggcacgggctttcttcgggttcagtttgggccgcaagggagcccctggcttcagcttggccttggggaactgggacaggtaggtcatgacagagtgctcgtccacgttggggtccacaatctcctcgggggtgatcacctgtcacaggcagaaaacaggagccatcgggcctccgagtctctcccaactgccgatccggtcccctacagctgtagccaggccgggcgggtgtacctgggggatgcccagccagtcatccgcctgctgcatggcctctcgcgcattggtaacgggcttgctggcgtcccaagagtcccagtcaggacacaggcctgtggcgcaagggaggctgtgagtctgggggccgcagaaccccctcaagggccacccatgggtgaccccagcccagtctctcctgcctctgcgccccctcacccggggcacagctgtccaccagggcgcccagggcccggccgctctgccagtcccggctgaagttggtgatgggcagctgcggcagcttgttctggatccagcccaggagcctctgcttgggggtctgcttcttggcctcctcatcctcctcctcgtcccacatgggcatggagatggagtagtgcaggatcagggtccagatgaggcccaggatcagcttcaggttcccgtccacgatggccttgctgtctgtgagtagaagagtggccacgctgggcacacggctgtgcgggaggggccgatcccaggctttggggtcagggtctggcagcacggggtagcaggggccaaggaggaggtagacaccccctcttggccagtggtaggatgtggatgaggccctctctgcccagggtcccagggggtgttcagaggtgaaggagactttggggtgagggcagatacacacagacacacacacacgatgccagcagggtatgattactgccagaagccctgggcccagaggaagggcagagggcagacccagcctgcagatgggcagctctggagaacagctggacagtgtccacagctgccagagcaggggtccgccacacacctcaggggcctatggggaaccaggaggaggaggctgactccagctggcccagaatccagggcccatgacctggagtggggctggggctgaggaagaggaaggtgggtggccctgggtggttgggaaatacaactgttgttccagggtgggtggggtgaggcaggggaagtgggggagttgggcaaacgccctttgggtgagggattgtgacccccgccaccacccccacttcctctaccacctcgaagactcaagcttggagttgggaggccacaggcctagccaggggaggggcccagagcccaaaggaaccagcagttgggccacatggccctgactcactggggcccatcgggagatgccggggtggcagcaggagacactgggaacccccttgccacccactgcctgacccacttgccacctaacgggcctctgggcctcggcaggctcgccacaggggaagtggttagggcgggtccctgacaccccccatcaccatggcaaccctgctgggctctgggccccacccaaggctacttctgggtctcaggctcaaggcaggatggctcatctttagaagccctgtcagcctcccccataatcagacaaaatacttctctggtgagtcaactagggggcgggcctatgaggaggggctgggctgtccatggcagctgcttcccagcccagcaggcagcacctggagggccaggtgagccgctcagagtggcctccccagttcccaggttggtcctggccccacgaggctgcctttcactctccccaaatggcagcagggagggggactcggagaggaccaagggtgcagggccagggaacaaggccagccagggcttcccatcaggcccccaccccagtccagcctcagacccctcaacgacccccacacggggagcaaccaggcccaccaggtccatgttaggccagcctactccgtccccatccccctcccaaaagagagagggaaggaccagggcccagggctgggagactgtctggctggatggccccgccccatcccacccccctttccccagcccctgggccagccaacccctccctcccctaatcactgctgctttccaacatttttttgccttatatggcaaagctctgggaactaggcctgctccagccagctcacaaggaggaggggagctgggaggagggaggagaccccccctaaagagctggggtgtggcccgcctccccacatccggtcgccccccctaccatccaggactgagatgactcagcttggctagactgaggctgggacttgtgggggtgggcctgcccctcgcctcaactggcattccaaagaaagaactttggttcttgggatctgccctctgagtggctgggggaacccaagtcttggtccctcactttcttgggttcagcaagggccattccagggctgcagggtaactggaaggcctctcaattctgaagaagagaagactcatcatccctctcctctccctgttccacatcacccccgagtcacccattctggggcctgccctctcatgcagcccctatcttgagaacgaattgggctgctgcagcaggcctggtcaatgccagcctctccagtccagtgacacagacactgggctggcacaatgcacgctggagcatctaccaaccaactcctgcgtgctacacgcagaaaagcaaggcctacatggaagcaagagtttggcccaagatgaagagaaaagttggcgtccaagtagtctacaagccaggtctctcagtcaaccacgcccaactcaccccgggtgcagttttgctaactatgcttctttctggcccccaggttgcctgtgtgtgtgtgggggggtagatctaaactggtggttggagccatctccgatgggcgacccatcctccagggacacaaagagcccagagccccagacaatgggacgcacgagctccaacccacacttcagaaccaacgggcctctgaaggccagagggccctctctaaacagctgtggggggagagcccgggcctcctcctcctcggggacggggcgcagggccaggagcctgcccagtgcccgaccccccaggcccactcccaccgcgagcacagccgcggaggcgcggcctgcggaggatgtgagttcagcctgggcgccggccagccggggcgcagcgggcgggggcgcgtagcggttcgcacgcccggccggccagccagccagcccgcgcgcctttgttctgcaggcccgcgtggagcagagcagccggaggcctcgggagttgcgctgcggcccggaagggggtggtttggaggggtccgcccggggagatggaaggacgcacggagtccccgcccccgcccgcccggcgcttcggggcgtccctcaccgatggacaccagtttgatgctctcgcggtccaggaactcgagcgccaccgacacgttctcaagctgcatttggcggaaagtgggccgctggttgtgcttgcggtgcatcttcttctggctgagcacctccaacagcgcgataagccgcagcccgtcgctcaggtccgtctgcaggttggcgatgcgcttgctcacgcacttcaggtgctcgttgcaccagcgcgtgaaagtgttctgctggatcttcttccacggcgcgtcctccgccaggtccttctcggtggccggcatctcggcgtcccgcgtgtcgacgccgccgcccggagccgcgcctgctgcgctctggcccgcccgagagtgggagctactcattttgaggcgcgagaagccgggggggcggtgctgcagcctcggcgaggggacggccctttaattaaagtcgcaggcacctaggcgcgcgggaggcgaggcagggagcagaggttgcgctgcggagagagcgagccctttaaatgcgggaggagggcggggccagagggcgggcctcctgcggggaggggccgtggggtggggcttcgagggcgcgcctgccccaccccgccccgcccgttggaatgcccccactaggcccccgggttcggctgatcagacgcgaaacccgggctccagggtgggtcgctgggcagtggggtgggcaaggatgctcccagccccgcagcctcgcgttggcgctgcaggaaacgcgccctagagcgaggaaaggctgagcagtgtctggcgcgggactgcttggcctgcagccggcgcgccttacaagggactttccttccccagggcccctgcggggggtggggtggctctcttccctaagtcacttgggctctgccccgtccctgcacatccctaccccccgccgtcatcccccttccccgggcccccagggcctagggttccccggcggcatccccgtccgccggcccggcagcggcgggaaggggccaaccctaagagcgaacccctggagagcggcagccccggaccaggcactgccgagggcgctttgtgtgctcatcacctgggaagcggctgcagggcaaggcctgcgcctacgcggtccccgcagaccccctgccacgggcccgccttcccagtccgtagggccctcgcccgcgcacctgtgcccgctgcttcccaccgcctccctctctgcttccctccacccgggaggatatggggcactgggccaggaggccgccggcactccaggagcaagcagccttcgaaggggtccgggcatgcccacgggcacgccagtgggcgcgggcagagggcgccgtgcgatgcatgcagagacgtgtgcccgcctaacccttcatgccagttcacccggggcactggggggagctgaagcggggggtcctctcctgtcggaaagtcccctcagcccagcgtggccagggcagggggcaaacacgggagtggcattccagacccagaggggcctgctcagaggttcccataagacttgtcaggctctgagcacctgggtctgggtgggcttcaggtgtggtggcaggtgcagaggaggcctgaggacagggatcaggggcctggggggttgtgtccccagagctgtgggggctcttcactcaaaattttctggtagataactctggagatggtgcagtggctgctgtgccgagatgtagactgggaccaggggacggctggggacgctcactgctactatcttcagtcagaagccagcctgcctatggcttcctccccattgtgcactcccctccctctcagtcctcggtacctcccctctccagaatgtttcctcctctgagtgttttttttttttttctaggaaggcaggtatctgtccctcctgttcaattctagtaataattaatttatctgctaaagaccagtgagagatggaggccctgggttggccagcacgtcatgcccaaatatggttgactctcctgtagccctgggtgtctacatgacacgtggtggggctgtgatccgcccagcacattcacttcggggcagcctgtggccccactggtttttcccactagtagtggtgttagggggtgcaaatggcattttccagtactgaggccaacccctgtatattgtcccctctcctgaccactttgagacacacctgcaccaagtgcgcctgggcgtctgggagctggggtggaggtgggagggagggctgggaagggggaacccatacagacccctccctgcacgggccccattcaagacgggcttgaagttgtccttctggtccccctgccccactggaaagcaagttcccaggcacggaattccatcaataattgactctctctccactaagggccattgagctgggttgtctgggttcattccttaatcttcagagctcagggaaactgagtcagagtgaccagtggtcaattccagcagaaagagtgtcaggaggtgggtgccgtgtcttccagccctagcttttccctatttagaggaaacaaggaatgggcgtgtagagggttcttgtccctagaacatagtatcaaccgccagatgtcgcccgatcccaaagccaccagatcgggcagtcctgggaagccaaaatccagctctttcatattttcccttatttggagtagattcttggatgttaggcacaccccgcccaccacaccacccctggccctcagaccccaggccagaccctcccactgggaggtatagcccaagcccaggagctgttcagctgggatccctaaggagctgtttccaggcctgcgtagccagggggcgcaggagggaaggaagccgcagactggcaaggtgagaagagacctgtgctggcaagtccaggtgcggcaggtgaggtcgcccattcccaagctcccaccttgacggtgcactcggagcacttacaaatgggtctgccagtggattttaacctattttgcctggccccaggtggcacgggaatctggggacattgttggttatatcctggctggcagtgcgcatccaactcagagccaacctggcatagggcccagggcccaaccaaggaacctggcctggtctcatcctcaccatggcccccatggagtagagcagccccagaaccagctcccctgtgcccaaagcagctggtgccctgtggactcgagccagcaagggacacgctgtccccctcccagtgggcacactggctgagaagtgtccttccaggtggccactcgccctgagtccacacaagttcctggtgtcagggcccttctctctcaggcatgcagtggtccgttcatgggcaagtgcccagacaccctctctctctcggggaccccccatggcctcaggctcccacattcgtgggcacagacatggctcgtgggtcaactagggaagctattctctggacactcactcccagatgccaggggagcctccatcggctcacgcatcccagctgaacctggcccggacctgggcgcgagctggcgcctgcgttttccggcctctctgcccgccttctccaaccccgcccccggccgacgaggagcgcggcgaccctacggcgcgaagccgggccgcggagacctcacctgctgttcctgagagcgaccggtgaccgatgaccgcggggtggcgcccggatcgccttcgcgcccgcgcccgcgccaggcgcctcggggattctgtcggcgtccgctgcgcgcgacgcgcctccacgcgaat

SEQ ID NO: 1420 - DNA, 26107 bp, Homo sapiens; identical to SEQ ID NO: 1419

SEQ ID NO: 1421 - DNA, 11911 bp, Homo sapiens
ggattgtcgggaggaccctgggcaaagacgcctaccctgccatgctgcgccatctgccctccaggctgccagtcaagatgtggggcaggactttggagaaacaggtgaacaagatggcccctggggatctggggcaagggtgttggcactgaaactggtctagtaacctgtttcccttctctgcgggctcccatttcctgtcctcctctctccctttctctttcagagacaagcagagggcagcagaggcccatggaaaggcccggctctaagccatggagggccctgtgctcaggtgtgcagggctgggccggggctgagggctggctcctcccccagtttagccagggacaggtggagagatacaaaggtggctcacgcagggtgcccccaaagctgtcatgattaaggccatgtggagagaggctaggaaacacagcgctgaccttgagctttaggagaggaattcagaggcccctggcaacctgaaggggaccttgaagaggaccctgtaggaagacagaacacttccctgtagaggaggccaaaggaggaaggacatggtgttccgggcactctgactatagggattttatatgctgtggtgagaaataaaatggattatatttttgtagagtgtgtaaaacggggcttggcacacagtaagccttgtgtgattactatgtctttttttttttttttttttgagaccgaggtttgctcttgtcgcccagggtggagtgcagtggtgcaatctcaggtcactgcaacctctgcctcccaggttcaagcgattctcctgcctcagcctcccgagtaggggattacaggtgcacgtcaccatgcccagctaatttttgtatttttaatagagacaggatttcaccatgtaggccaggctggtctcaaactcctgacctcatgtaatccacccaccttggcctcccaaagtgctaggattacagacgtgagccactgcacccagtcctttgtgtgatgactatgtcttgatcatcattttataaagcaggctttgtaacttcacctccaagagtctgcaggatccagaccctgccttgccctcccacttatctctcactcactcttgggttctgagctacgctggccttcctgttattgaagacagccatccctgctcgtccttgaatttgcaaggatggagctccgagtctgcaaagcaggatctggggagtgaatctaagctggcagggaagaatagaataatgggaggaataggtggagtttatttctaacagactatcaaaatgatgcagatgtggccaaagcagtgcttagaggaaatctatagttctaaatgcacagatcagaaaagtagaaaagttgaaaatcaatgacctgagcttccctatcaagaaactgggaaaagaatggcaagtggaacctaagaaagtagaaggaaggaaattataacagcagaaactggtgaaatagaaagcaaagatacaataaagccaacaatgttaaaagttgattctttgaacagattaataaaatactagcaatgtctattttctctcgagaaattaagaaaatatatggattgccaatatcaggaatataaacagggtattgtgacagattctacagatgttagaaggttaataagggctgggtgcagtggctcatgcctgtaaccccaacactctgggaggctgaggagggaggattgcttgagcccaggaattcaagaccagcctgggaaacatagtgagccctcacctctacaaaaaaaaagaaaaaagaaaacaaaaaatagttgggcatggtggcacacacctgtaatcccagctactagggaggctgaagtaggaggattgcttgagtccaggaggttgaggctgcagtgagctgtgatcatgccaccatgctccaggctgggcaacaaagcaagaccctgtctcaaaaagggaattaaaaaagaaagttaataaaatttatttcaacatatgactttattttcaatggagccaaaatgtcggtcattttctctttctgcagttcctatgtccatgtggatcttttgtatccaccgggagagcaaaactcagcaactttgctaatgcctcctccactcaggaaaatagaatggtacaggattttttttagctggagctcagtgaaatcaattgtttaaaatgggctggtttcaatggaactaaacgcagtggaatagaaaataataaaatagcaaagggtagaacagaatagaatggaatccaatggaatcgaatcgaacagaatagaaactagtcagactttgtgccaagcactgtccctagttgttgcagtagatatttatttattgaacaaatatgattgaactagttgtttgggaaagagtggggaacaaaacagacagaagtccctgctcttatgaagcttacattctagtcagggagacaggcattaccatctgcaaaggcccataaatgaaaggtacaagggtggtccttatgaggaacaggctaaaggacagtgtagattggagttcaagagcaatggatgaggctgtagagatagggtgtcattgtaactggagtctagattttaacaagatgaccacacatcatcatcatcatcaatcgttttatagcacttgatatgtattaggcattgttctatgcccttaaaaacagtacttttttaaaactctcacaataatcctacatgtataaaatcatgctcattttatagaaggggaaaccaaggcacagataaattagataaattatttaaacgtcaatctggttccagaatcttcttttttttttttttttttagatacagtcttgctctgtcacccaggagtccggttgagtgatcatagctcattgcaacctccgcctcccaggctcaagtgatcctcccaccccaggcccccaagtaaccagaactacacgtgagcgccccacaacctaattttcatatttttttgtagatacagggtctcactgtgttgcctaggctgatctcaaactcctaggttcaagggatctgtctgcctcagccttccaaagtgctgagattacaggtgccaccactagaatctattcttttaagcattatactccattgcctatagtgccagaccacaggtgctttataatcctgtagcatagatactataaatattcaaattactaaataattcaagtcaagagaaagatctgatgggaagtgtgctgagggcgggaaagtggaaggttggggagtggtcctccctctgggtgtcaaggtggatctgtaaacacgcacgcccagaaaccttcatttcttctgagatgcccccttcttgtcttgttctctgtgactgaagctgcagaatgggaaaggagggggctgggtaaaattggccaattcacaggactgggcctcctctgtgtcttgtcacttcttggaaaagagatgaattctatttagggaaaaacaggggagggcattgtcttggtctccactcccctaatcttcacttctggaagaggagaaagggaacaagaaggctgggtgcagtggctcacccctgtaatcccagcactctgggaggccgaggtaggcagatcacttgaggtcaggagtttgagtttaagaccagcctgaccaacatagtgaaaccccgtctctactaaaaatacaaaaattagctgggcgtggtgacacacacctgtagtaccagctactcagggggctgaagcaggagaatcgcttgaagctgggaggcggaggttgcagtgaggtgagattgtgccactgcactccagcctgggcaacagagtgagactctgtctcaaaaaaaaaaaaaaaaaaaaaaaaaagaaaaggaaacaaggaaacagtggaaagtggtcatggtagacatgtgggctctcatgaatccacacatgggcagtaagactctaccagtaagtattctctcaggcctttccccttgaaggggggtgaggaggaagtagtgtaattggggaggtagggggaggtgaggagaagaaaacacaggcgttgacaagtggcaatgtggtctcttctgacttttttttctttttttagtcatggagggacagcagtcagacccctcccccatgtcttatccgtagacttgaccacatcgtgatgacggtgaagagcatcaaagacaccaccatgttttattccaagatcctgggcatggaggtcatgacttttaaggtaagcacttccccaaatgccaaaattcaggtgggctaaaatttgttgataacactttaacatataacttaactctaaaaggaaaaccacaggaaatctgagagaaaatataaagagatcaatagaggagattccaaactgaatatttggacttccagagagagaatggagaaaaaagagaggaggaaattatcatagaaacaatgcaagataactttgcagtctctacatggaaaaggttaaccaagtatccagcatgttgacacttaacatggatccttctaaaattatagaacatcaaactgaaaaagtagatcctaagagctttcatagagattaaaaagtagattatctacaaaggaaaaaaaaacaaatatcagattttccaagagaccagagaccaaaagataaaaggacaccttcaagattctgaggggaaaattttccacctagaattctatgtccaaccaaactattaaccaaaggtaaatgtaggggccaggtgcggtggctcatgcctgtaatcccagcactttgggaggccgaggtgggcggatcacttcaggtcaggagtttgagaccagcctggccaacatggcaaaaccccatctctactaaaagtacaaaaattagctgtgcatggtggtgcacgcctgtaatcccagctacttgggaggctgaggcatgagaattgcttgagcctgggaggcagaggttgcagtgagctgagattgcactacagcactctagtctgagtgacagagcaagactgtatcaaaaaaaatcaaacaaaaatgtaaatgtagaataaaagcattcttagtcatacgaagtcttacaaaatttcccacttgctttgaaaattacctgaggctatgctatatcaaaatgggggagtggccgggcacagtggctcacacctgtaatcccagcactttgggaggcagaggttgcagtgagccgagatcgcatcactgcactccagcctgggtgacagagcaagattccatctcaaaaaaaaaaaaaaaaaaaaaaaaaaaaaaaaccaacattggatgactatgaatctgggaatatggaagacatggaagtcaggccacaatggatcccaagaggaagatcccagaaaggtacttagagaaccatcagtccagtttggaacaggtgtaagaaagaccccaggaaagacagatccaaggggaaaaaaaagaggtttccagagattgaactacccttgagaatttggaataacttcaaaaaaggtaaatgcagagaaagcaaaaaatgccttactaagatgtgcttcagtaagtgaatggatgtatcaactgtggcacatccagacaatgaaatattattcagtgataaaaacaaatggattatctgccaggtgcagtggctcatgcctataatcccaacactttgggaggccgaggcgggtggatcacctgaggtcaggagtttgaggccagcctggccaacatggtgaaaccccgtctctactaaaagtacaaaaattagctgtgcatggtggtgcacgcctgtaatccctgattacgtggatcacctgaggtcaggagtttgaggccagcctataatcccacacaggcatggtggcgggcgcctgtaatcccagctactcgggaggctgaggcaggagaatcacatgaacccaggaggcggaggttgcagtgagccaagattgcaccattgcactccagcctgggcgacagagcaagactccatctcaaatagataaattaattaaataaaataaatggactatcaatccatgaaaagacatggaggaaacttaaatgcatattactaagtaaaagaagtgggggaggctgtgcatatgtgggggcaaggtgtatatatccctatacctcctgttcaattttgctgtggacctaaaaccgctctaaaacaattaagtacacatgaacacccctcccacacacacatataacttaaatagaaagggcttgaggaatcgcaaacaggagaagaaaaatttttttagacagtgtctcactctgttgcctaggctggagtatactggtgcgatcacagttcaccacagcctcaacctcccagactcaggtgcttctcttgcctcaccctcctgagtagttgagactgtaggcacgtgccaccacacctggccaattttttctatttggctaaaaatgttaaatctaacatggaaccttatgcagaaatgtagtattatgcaacatcagactggatgtgtacacagcaacacggacgggtcttgaaaagaacgtgctgagtgaaaaatgaagaaacaatcaggtctacagcatgctacccattacaatacacacacataaaacagtaacacactttttacagcaatttatgaaaaccaaaggatacacatcaaacgcactataatggttgcctaaggtggagatgggaatggataatgaacagaaaaagataaataaaacaagagatagtccttgcgtgggccaatggtgataacgaggtgtatgatgcctcaacctctgtacttggacacaatggagtgaaatttcagaacattaggattaagaaaaatcctaaagctgcagtagtggaagatggatgtatcaccaaccaaagaataaaacgcagatgaacatcagacttcttaacagcaacaccacatttggggaagacaatgaagcaacatatttaaaaggctatgggaaaataagctgcaacctacaactgcacactgagccaaactatcctcaagtccaaaagtgaaataaagttggccagacgtggtggctcacgcctgtaatcccaacactttgggaggctgagatgggtggatcacttgaggtcaggagttcgagaccagcctggacaacatgctgaaaccccatctctactaaaactacaaaaattagccaagcatggtggctcgcgcctgtagtcccagctactcgggaggctgaggcaggagaattgcttgaactcaggaggcggaggttgcagtgagctgagatctcgccactgcactccagcctgggtgacagagcgagactctgtctcaaaaaaaaaaaaaaagtgaaataaagtcattttctgattgaatggatgtggtatcattcatagtgatataaaagagatagaaaaagaaaaaaagaaatggcacatgttgagaggtccaggagagggaggattcatgaagaacatggcagggctgtgagttaatctgtagttgatctacaaaaataaacttgcagccaagcgtggtggctcacgcctgcaatcccaacactttgagaggatgaggcaggaggatcgcttgagctcaggagttggagtccagcctgggcaacatactgagactactgtctctacaaaaaaaaaaaaaaaagttttataattagccaggcgtggtggtgcgcacctataatggaatcccagctactcaggaggctgagacaggaggattgtttgaggccaggaggtcaaggctgcagtgagccgtgattgcaccactgcattccagcctgggtgatagaatgagactctgtctcttaaaaaaataaataaataaacaaaataaacatgcaaatgggttagttaaaaattgttaaggagctaaaagagaaactaaaaacgataatcaaattgtattggaagagatagtaatgtgaatgagctaaattttcatttgtcatagcagggagttgctaaatcaagaaatagtggtgcagccgggcacactggctcacatctgtaatcccagcactttgggaggccgaggcggggaacacttgagccaggagttcaagaccagcctgggcaacacggggagacccggtctctacaaaaaataaaaaaaaattagccaggcgtggtggggtgtgcctgtggtccctgctactcagaggctgaggttgcaggatcacttgagtctgggaggttgaggctgcagtgagccgtgatcactgcactgaaggctgggcgacagagcaagactctgtctcaaaaaaaaaaaaaaaagacgccaggcacagtgactcacacctgtaatctcagcactttgggaggctgaggtgggcagatcaccttaggtcaggagtttgagaccagcctggccaacatagcaaaaccccatctctactaaaaatataaaaattagctgggcatggtggcgtgtgcctgtagtcccagctactccagaggctgaggcacgagaatcacctgaaccagggatgtggaggttgcggtaagccaaaatggtgccactgcactccagcctgggcaacagagcaagactctgtctcaaataataataaataaataaataaataaacaaacaaacagtggtgcatcagttagggactttggaggcatgtaggagaaaactcaactaactgtgggttaaacaagacaagagttttcttttcgtttcactgaacaaccagtccagaggtagttagtcaggtcatgggcagtggctgggaagcaagaggaagtgaatgagcaataagggccagcgcagtagggttgggaggttcccagaagccccatccacacctctgcccccatctcattgcctggtccagctaacgtggcctccggacgtgctgggaaatgtaggtttttaaagttgggtacacggttgaccccactgaaatttctgttgtgtttataagaaataaaggggaaatgtatactgggtaggcaaattgctatctctgccttgagtggtataaacactatttggagatatggaaataatttcaaggagaaataaactcgtacacttgcctctagggaatgagccttgggtggggcaaagggctgttgtgtagtagccccattctagtttttattttttttaaaccttgttgggataggtggaaaggcttcatctcacactcatcttggaggtttaattctaggctgttttctctgcccctccccaccaagtaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggtgagtgggacttctcttctttttgcaaaagctgctgcaaacgcagtgaaaacagaagaatgacccagagaggtaacaagttttaccacaaccagataatgtctgcacacagttatgtactattttgactgacaattctttcatgtaaataaatgtgtttaaaaaggaaactgtgcattcccattgtaaaacaaacaaacaaacaaacaaacctacatttatgcactgaaatactttttttttttttttttgagacagagtcttgctctgttacccaggctgtagtatagtggcttgatctcggctcactgcaacctccacctcctgggttcaagcgattctcctgcctcagcctcccaagttgctggtactacaggtgcgtgccaccacacctggctaatttttgtagttttagtagagacagggtttcaccacgttggccaggctggtctcaaactcctgacctcaagtgctccgcccacctcggcctcccaaagtgctggccattacaggcatgagccacgtgcccagccctaaatacatttatataaaaagaaaacgttcatccaagtacatgaaaaacccattatatcttggcataaaggaaaagtaactgtaaaaaccaacagctatgaaagcataacaatgtcattagattctagccacttccgttccctgtactccctggccctgacattacaaagggagatatggcaggtggttaaagagatactaagaacttgttagcatccaccttctatgtgtaaaaagaaggactgaaagaagattggagagggaataatttctgatttgttgttatttaatccagtgtctctgtaatacttaaaatgatgtcatctagaagaggcattggttgggcacggtcactcacgcctgtaatcccagcactttgggaggctgaggtggcaggatcatttgggccaggagttccagaccagcctgggcaacatagtgagatcccatctcttaaaaaaaataaacagagtagccaggcatggtagtgcatgcccgtaatcctagctattcaagagggtgaagtgggaggatcacttgagcccaggaggtggaggctacagtgagctatgatcacgccactgcactccagcctgggtgatacagcaagaccctgtctctaaaaaattaaaataaggctggggcacagtggctcatgcctgtaatcccagtgctttaggaggccaaggagggaggatcacttgaacccaggaatttgagaccagcctgggtaacatggcgagaccctgtgtctacataaaatacaaaaaaaaattagccagacgtggcggtgtgtgcctgtagtctcagctacttgggaggctaagaggtgggaggatcgtttgagcccaggttgaggctgtagtgagctgtgatcgcaccactccattctagtcagtgtgacagagcaaggccccatctctacaataaataaataaaaggggttttagtttcccttttgcagaacacggattgaggtcttatatatattctgtgcaaataacctagactccttctttgggaagtgtcagtgaaaaagactggtttggaagtaaaatgggtgaagcataggggttaagagtatggtcgttgacccagactgcctaggttcgaattctggttctgccatttactagataatactaggtactattatccttcccattttacagatgaggagatcgaggtacagggtagttaggtactgtgcccaaggccatctagctgataagtggctggaacggagtgatggaggggaggatggtaggagatgaggtcagaaagatacagcggtgttctaaggtcttctaggccactataaggaattaaattttacaggccaggcgcagtggttcatgcctataattccagcactttaggaggctgaggcgggcggatcacttgaggtcaggagttcgagaccagcctgggcagcacagcaagacctcgtctctatgaaaaatagctgggcatggtggcatgcgcctgtaatcccagctactcaggaggctgaggtgggagaattgcttgagcctaggaggcagcggaggttgcagtgagctgagatctcaccactgcactccagcctgggtgacggagcgagactctgtcacaaaaaaaaaaaaaaggcattaaattttggtctcacacacacattttgacgaacgacttttgtcttttcttcccacttcaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatgaa

SEQ ID NO: 1422 - DNA, 14429 bp, Homo sapiens
ttgattttcaggttttatttgcctgttataattctgatattatgtacatatatatatatacttttgtttttttgtagagggcttatcagtagaccaagcacaggcatacagggaggctgtggctgctgagcagtgctgggagaaccaatctttcctttttttttgtctgtttttatttttcctgggatgggttcatcaaagctaattgctatcaatcctagaaaccacctagggactcagacatctgcctacacactagtggcgtaaagggaaggacaggggtacaaactttcaaagtcacggtgtatttacattcccaaggtgggggcgggaggaggctgaggaagacaactgttcagacgatagggagggcagggctgctaaggggtcctggggggtgggggcggctggaagaggccggccagtgggcagtgggaggaggtgtgcccgccccgcagccaggtagtgacggaggccacttggatgttgtgtggtgggtaccgaaggcagcgtgtgtatggagctcctgaaagccggccatggggtgggctgggcggcgggaagaggcggtgctgccagagtgcgatgctgggagtggggggactctgggctctccagatggcctcccctgcccccgcggccagtttgcccggctcccatcccggttggagcagagatggcaaagaaaagacagcagatggtggggacaccgagttctgttcccagtcccagccaggctggctggggagtggctgggggagggggaaggtgccaaccctggtcctgaggagaccccaccatgtctgcccccagtcagggagcaagaaagacagcatttcggagaccctttcgggccacccctacttcttctcccccaaaccacagcctctctgcccaaatgggctggcaaaacagcacccaaaggcccctggcatgtgggagatctgcccaagctggggcagagcagcgtgtgcccaggaaggggtgcagctgggttttggcaataaagtggggaccgggtggtaggaaggggatccgaggcagcaagttctcctctgccccaactccagcctcccatgggcctgctggagagggaggggcctggatcccaaggccaggggcacagcatctcctgtcctggactccactattctagggccacggcagggttgatgggggaagtggcccctgagctgtcattgccccctgccgcctccttctccttcttgccactgtactggccaatgaacgaaccatcctcgttgaactgaacatccacgctgcccccataatcggccaggctgtcgtcactgcccaggggcttgatgtccccgttgagcgatggctggctgctgccaaaggccttctcctcgttgtcactgcagaggcacagggcaggtgcgagtgagagcactgccgagcccctgcaggagcctggctgggggtgaggcagacgcccgcctgccttccatttgtttagaatgcgctcagaaagagcagctctggccaccctggcaggcaggtctggagctgtcatctttgggcattccccagatcctggggactgtgagggagaaaatgtgcgctcggccaggggattatggggcctggttcctgtctgggaagctgtctggggcctcccttggggagaggggagcagtgaaggtatctgtgtggagaggaggggctggggcgtgttggcctctccctgaaatgaggagctgccgggcctgggggctgggaagtgagagtcctgtcagagccccggcagccaggggacaatggcacaccaggcgcacattgtctatagggagaccttgctgttggcccctccccaccgcccctgccttacctctccagggacctgaagtcacccggcagcacagagaagagagagagggggtgagatgtgaaggccagggtggagctgagtgccagcacccactcctgccccggctcacctgtactcgccgaaggtctcatctttcatcggtcgggcctcagagtccacctgggtgtcctccttatccttcactggagacacagagagggacagcttcttctcccgccccagcctgacccggggctccaggcccctctacgccccgcacccccagcactctgtctcaacagcgcccagaggcaagaggccttgaaagaaaccgctcaccccctgcggtccagccaccacttgcctgttgccccaaccccggcctgggaggatgatccccctgcctgcccccaccatgcgcctgtcatcttgtggggagctcggggaatccaggaggccttgcagaagggtggaaggggcgaggtgctcctctctgccctcggctccacccccgtcacgtggggctcagaggctacctgagtatttgccgcccttgctgcgcttgatgaagcagaggatgagcaggacgaggagcaggaggatgatggcactcacaaagccgatgaaccagccctcagtggcgaagccagcaggagggagcctcacgcggcctgagggtgagacaccagccccccgtgctgccgcccaagccagaacccgacctgaggccctgaagtatgctcttaaagttggggccctctggggggctaaggagtgacagggacagggaaaagggcatctgcggaaagggtatgaaagggggctgattcggggacacccagattctgggaggagaagcagacaggagccgtggagggagcctgggcagtagtggccattcaggggacagaaggacatgaattgtgcagcccccatgcttccctggcaggtgatggcgggcccccggcgcctcacctgtgccattggtcttcacagccatttggtgccggaacatcctctccttaaacaagtggatctcgtagtcagtgtcaggctgcaggtcccactgcgtgtaggagctctggttgtagctgacatactgtggcgaaagggaagccccacccttctcttctgccagggagagagggtggcagcaggggtgagtcggagtgccaggcaacccctctggcccagagcccccttccccaccacgccccaaggccccctttcacgcttacctcccaaggctttgaacaagatatggaacctgaagttgcactggccctccttggggacccaggagacgacactgtagttttcacccgctgtggctgagatgttgccaaaatctgagatccctggggggatgcaggggaacgaggagagtgtggcagctgccaggaagtctaaggccctccctcctggacccggctggccggggcctccctgttggcaggtcattcctccagcttaccagacaaggccatagtgcctccttcccgtacgatggcttcaccagggccctctttggtggtggcctgaagctggaagcggtaccgcaggtgggggctgagatcggtcaggttgtgtgtccgaagttcggggtcccgaaggttgaaggacagttgccccttgcccccctcatccactgtggggacagacaggggttggctgtggctgcagctctgccccctccccgtggcccctccacctcccttccctgctggggcggcgcacgcacgggggtggtaggagagcacgtagccggtgagcacgccgttgtggctgagtgggggctgccagcgcagcagcaggctggtgttcgactggcactccaggtgcaacgcctcggggtggccaggcactgcagggcacagaaccgagtggcaggtaggtcctcgcccaggtctggggaggagggcaggggatgaggcgtggggtgcaggactcacctccctctggggtgctgaaggtgaactcgctggcgggccccgatcctcgcccgttaaaggcctgcacctccaggtggtaggagctatagggccgcaagccactgaggatgacactggtggtgttggcgggcaccaccacatggtctttgtggatatgtctcttgctgtgcttcctctgactgccctccctccagtacgtcacctgcacaagcgaacaggagacctcgcaggggcagaaggcacccagcagggcccccagcgcacacccccaccacccttaatggggaccctcctctcaacccaagtcttccaggagagcggctggcaggtggcaaagccccctcaccatcctgtcgctttacctcagtgatcaccctcctgggcccccatgccttcaacccttacattgtatccgcggaggtggcccttgacctgggccaggtccaccggccgccacttgaccagcacggcacttgagttgaggatttcaatgccttccagctcagggattgcctgggggtctggaaaccaccagtgacttggatagagccataggctctcaccccagccctgaggccaggcccaagcccctacacacagagaagacgaattcggatattttatgaggtacagtttgaggaggagaggtgtgtttgcatggtctcaagatctcttcctggactgcttattagttgcaaaggtgaaaatagtagcttatacaaaggagaaaccatggctgggcgtgatggttcacacccgtattcccaacactttgggagacagaggcgagtggaacatttgaggtctggagttcgagaccaacctgatcaacatggtgcaaccgcatctctactaaatacgaaaattagttgggtgtggtggcgcgtgcctgtaatcccagctaatcaggaggctgaggcaggagaatcgcttgaacccgggaggcagaggttgcagtgagccaagaccgctccactgcactccagcctggatgacagagcaagactccatctcaaaaaaaaaaaaaaagaaagaaaagaaaagaaaagaaaaaagaaaagaaaaaaaggagaaaccagaaaaaaaacttgaccgggtacttcaagttaccatctggtcatgttccagattcaaggaaatgaaagaagcagcattggctgatataactggaataccgctgccaattatagaaatgtgaagtgtggggaatttcataacgtcgctctggttatgtaagagaatatcctcatccttaggaaaggcgcacaccaatgctgagaggtgtggacatgggctggggtggaagcaggcgagctcaaccgtgggcgaggggccctgccggatactcacagtcctctccagagtagccgatagtgacctggggctctggtcccttgccctggctgttgacggcctggactttgatctcatagggcacgaaggtggacgtgttggacaccaccaggaaggggtcgctgacaatctgctcctgccagggccctcgtgtcccctgagggcgccactgcacgcggtactgaacctggggggcgttccagtccatccaccggagcggctggaggaggccagcagaagaggagttggttggccaagaacaccagcattctttggcccgccccccagcacaaaccagcatccccagacatcagccccttcctttgcatagccaagggggagcaacagacacccaggtcatggcctcatgtcccccaggcagctcagcccagggactctcaccttccacgtgatgaccatattggtggtctcatttccttcccccttcacatccacagggttcttctctggggctggaaaggaaagtattaacacatcaatgctgcagcctcttttggagagccacgaggaccgagggccaaggaacaaatggctcattctggcaccaagggagtccagccccctcgcgctccccctggaaatttggaagcagaggaacttgggcatggcacctctctaagccctcccttcacagcccggagccccttccaggtggcatgggagtgggtgccaccctgactcacctgcctcaggtgtgaccacagtctcagagaccgggctgggctccccggggccatatttgtttatggcagtaaccctaaaggtgtagtggacatagggcgacagcttgagggtggtagaggtctggttccctggaaccttgcccagactgtaccatttttcaggcgccatttccttgtcctcaaattcaatgtcatattctgccaagaaatgaaccgacaatggagtgatcagcatgtggctttgggggaagggctgtggaggggttgggtacagtctgggtccctgattacccaggccaactggcatctccagattcccatgaggaaccgtgagtccccccaaaccgtgtccccccaggaaggctccaggaggagggaggaccccaggaggggccagggctggcagaagtgacggtggggtggcactgagctcaagcctcttactctcaatgggggcattgtggtcttctgcaggactccaggacacgcgcacctggctctgcgtcagcaggtgcaggtcggacagcaccagccgtggcaccggcccagggctccctgagggtggggagggtcggtgcttgaaagggcccagggatgtgagccccggccttctggagtggaggcttccaccctaggacttacccaccaccaagagctgtgccctactctccaccacatccagttcggtactggccacgcagctgtagttgccctggtcgctgtagtccaggctgtggatgaccaggcgcccatcctctatgaagtacctgcggaggagccgtgtctgtctttcctgccatctgggctcttctcccctcccatccctccctcctgtctccttcccccgctcctgtcagagccttccccatcaaagcaaggacgaggccaagaggtctggacttccagcttttcccactctgccccctttcaccgtcactgtcctcacttgtcactgtccccaagctcctggaggtctcgaccgtccccacgccaggtgatgctgggctgcaaggaggggtcaaaggaggcctggcacgtgaaggtcaccctggaacctttcttctcgattgtgctgcggggcccctgagtgatctgagttgcatctgagggtaatgcgtgcgtggggaagtcactctgttgtcctccagaggcccagaccctccctcccagaggcactgccagccatgtggcaagggttgcctgacctttaaccttcaggttagccatgatggtaacattgttttggtcattggcagccaggcagaagtagcgtccggtgtcattggcctggaggtctcgaatgcccagggtcccattggcataggggaagaagcgttcgtcctgaagcactgttgtcccatcctcgtccagcctggagggagcagggcgggcctggctctgactggctggcctgggctccctgccctccctggctccctggccactgggacacgacactcaccactaccaggacgagacactcaccactgaacactgggcacaggcgctccgaaggccttgcacagaaggtaggcagtgctgccctggacagccatgtacgtctgattgtccgcagtcaggatcttggctggcagctctaggggaggaacagcctcaggagacagggcaggacttgggaccacagctgggccaggagccagggaccctctgcacggcttcctcgggcccccaagagccctgcaaatcttggttccctgctcccagctgaggcccccgccaggctgtgtctctctctgccttcagacactgccctctgcctcagatgcgcctctggtcacagccacccaacttttacgttattccaggcctaactgacagtcacctctccccagaagccttcctggcctagtccccagccttccctgaagttccaggagaggtgccacctgggctggccttggtcacatcctgtggcacagcggtccgctcagtcacagtgacaagacctttcccctcttacatctccctcggctatcgtgaggctgagtgagatggggcgaagggtgtcagcaaggagaaaggtcggcgccagcctggtaggccgaggacacatcagctgccagctgagccactctggtggcctggcccagtgggctgcagggacagactgggagttaggaggtaaggaagggagggcactcacggacaacgtagatgtaggcattggccagcaagagcccgtgccggttgcgggcctcacattgggtcaccattgtgtcactgggctgcacgttgctcaggatcagggcgccacgctgaatccggtacttctggtctttggccagctctgtgcatgcagcaggtgggcccatgggccacagcccggcattgagctgcgttgaggcccttcctcaccctcctcttcctctcccccacagcccccagggctcgccacactccccactcctgcctgaggccctgctcaccctccacagggatcccgttgattctccaggtgacctctggttggggcctgccctggacttggcagtccaggcgggcagtctctcctggcccatatagatggctctggggcttgtgcagccagtacggggcagctgggaggaaggggagagccgccctgagcccgcagccagcagctggctcttgacccggcgcagaccctcccctcccccatgacagtgggcatcacaggccactgtcccaggaggtccataccctccacggtgacatagtacgcatgccgggcactgcccagtgagttctcggccaggcagcggtactcgccatcatcctcctcgcccactttcagcagctgcagggtcttgttgtggttctggtaggtgacacggtcggctggcatggggccactggggcgcagccatttgatggtgggcgtgggactgcccgggaggcaaagggaagagagcagaagggagaaaggacaaggccaatcaccccagccccctataccccgcggtggtctgagctccctgctagggctccgccaccctgccctgccctgccctgccctgggttcccagactcacaagccctcggcgatgcactccaggaccaatggctgcccctgcaaggccaccaggtggctgctggagttggtggggaagagcaggcgcggcttcctgtcaatcatgctgttggctgccaggagaaagtgggtgggtgggctgcccactcttccctccaccccagaattgcaaggctgagggactcgacactccagccagcccccggggcctctgtgtcttcctccattaaggagagtgtcctgtctctgctctcgacgcctgggaaggggtctgggcagggtagaggtgggagccaagctgttcttgaggaagcctggagttgtcagatggacctatggtgggaagggccatgcctgagggtgaaaggagtcagggagagagtgcagagcctctgagactcactggccttgacccggaggtcaatgggttccttctgaatgatggtcctggtgcctgggaagtgggcgtggcagatgtagtctgagtggttgtcggaggtgagcacattggcaaagtagaggttgccgttctggcccatcgtcacccgctcgtcctgcttgatgtgcaagatctctgcagggggcaaggaggccgaagtcatgaccccgtccaggaagacacccccgctaacaccccgaccccacgaggcagccgctcgccggcacccactgctgttcatccagtagatccggagaggctctgcacttgggggagggttgcaaggcagaaccactgactccccttcctccacctccacgggcttcactgtctcctttggccacttgggggcacctagaagggacagacgggctgacactctcctcctggtccagatggtgctaggcaggagaagggaggtgggggcaggggggtggcgggctacaccagggatggacgagggggcgagagggtcaggccagtagaaacttcacagaaaaggaggcagacactctggataccttctggactcatagcagagactagcacttagggaggccagggtgagcaggagaccaggaggccaggaagggttaaccttccacggttctcagctctccctgcccaccctaggaaaggacgggtggggggaggctgaggctgaggtgcagtgatgggggaggggagctgtggagggatgcaggagtcacagacccttccatcatcctgacacagaaaccatggcaacggttcccaaggtaactggaggggtggggaggggagaggagagcgctcaggaagcagaaagctcagggaggatggaatgcaaagggaaaaccccagggaaaaggcgacacagatcaagacagagccgtggagcaagagagaccaagtcggaggtggaggggaggagatggagagccaagtggaaaagccagagaagaggggccctgctaaggagtgcaggtgtagacagagatgactgcagtgactcaggcaggtctgcccagaatcagtcactccccccaccagcccgcccccccctccccccgccaccttcctgctcagccatgaggcaggcaccaggaaagcctgagggagtgaaagggcatgagatgaccggaagtgcaatggagacagagacagggcaaaggaggagactgcacaagaaacaagatgggccaggggagaagctggggtggggtggagggctggcaggacacccaggcccctcgccacgagacaactggctgacagcagcttccagcccacaatcccacacgaactccgggacctgccctccctggtccctgcagcgcctcgcaccctcggccatgagccggatctcatgggacatggcggtgcccagcttattgctggcaaagcagcggtagatgccctggaacctctgagcaaagttgctgttgttgcccgtgatggtgaaggagccagagtggggcgactggtacacggtcacacccagctcttccttgggtttgaagtggacaccatccctcgtccagcggaacctgtgggcggaaaaaggcccagaggcctgaggccctggaacccaacgggggctggaacaggctggagggacaggtgcaagcagccagggcccccaggggatggactgggagatggcgaggacttggggtgattagcaaggtttggggcttctgggcttagaagttaggcagtccagggaggcacaaggccggggtcagtggcaggcaacaggggctgagacggcagagatcactcactgcacttcgggcttgccactggcctcacacttgaggctgatgtcatctgtggggaagacaaccaggcgccgtggagactgttccgtgatgacaggtggctccatcactgaagacagggtggagagagcggtggtgagggtgctgcctggctggtgtcatagcctcagcacctgtcccatcgtgagggaagcagggtccagagcccctggaggccccatggccacagggggacgaacggaggggaagaacaaaagaggcttgtgggacatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgtccttcatctgagaaatccaggcaggcagcaagggagggaatggagagaaatactgacaggcagccccagagtggggcagatggcaggggacatagtaagctcctgcagcccccccgtggagagggaatggcaggagaggaggccctggcagtggcaacaagggggcacacgctgggctggagcagtggcaggtcaagcccagggagatgggacagagagatgcccagggagaggagctccactggatagacacacagggcatgtagcccagaggcagccaggccatgcctccagctctagcagacagggagagagaaattcttgcctttaacaaggagtgtccttgcagccccctggcagggcctggcagggcctgcagaactgaccccacccattcaggatgccttggaaggcaccgtcccctgctccagcctgcttccctcctaatccaattagcacagctgagtgttttcaattaccagggcccagccttcagagccctgctgccccctccccctgaaaactatcccaaaggccctgctgcctctgagtttccatagcctgcggggttggcgccagccctcctcttctccctccttcctcccagacagccaccaagctctctggggcagaggccagagctgctgtcccagccccaggactctgcagagcactggccagggcggcctcgaggaagggagaagagggagggagggagcagcaggctgcctctgaaagctttgtctctgcagaagacctcagtgtgaaggtccagggagggaggagggggctccctggggacactgcagagggccctgagctggggagggagatggtgacagggatgacaggatgcagaaagccaactaggtggaggaagcaggaaaagagacaaagggggctggagtggctggggagggagagatggaagacaggttccaacagggagggccggctgcctgccactgcccactgtgtcgtatcagggtcaagaacaagtgctggtcagtgaccagggcagccttggagctgccatggccttttggcctagttctctctccccactcccatctttctgtagagaatgcacggcttgcattccactgtacagtgttatattgtgtatccacctctgtgtcctctgggtctaaaagcctcactggtgtgtgtttccacctgtgtggcctctcagcggctctgctccttcatccctgcacctgccttgtcttcatgcacctgtgtgcatgtgtccatgtgcatctgtaccaagggagtctgcctggccctggccctccatgtatgtgtctaaggggccagcccctttacctcctccaagccctcactgcctcccaacgccaggtgcctccccagcctctctctcgcagcccctgtcccactgctggcacagacagtcttcccaacccctatccgccaactcgtctctcagtgacactggcctcctccttgtccaggcccagagacaaaggtgtcaaggtgaggctgggaagggactggagcctggtagctcaagagacacaaatgccctcacacatgataccctgtgacatgcccctcacacggcctgacagctacttacaggagaaaacaccatcacggtaacaccccccacacgcaagtgtgtacttacattcagccccactcacacatacacatgacccaatgcaatcaaatgtcgtggtcaaatacctcccgacctccacaagcctggccagtaagtaacagagtgactcacacagtcacccatgtaaggaagtcaaaatcacattcacgaatatctacgctcagtcaatcacaagaacacacagacatacacagtgtatccatgcttaatcacaaccctacggccacactccccaacatccactcacctgcttgtgcccccaacaaatgttacaaccatagacacatgctccagcagccctgcccccacccccaccaaataactacacacaaaaaagggtccagaaggctgctgggctgggaccagggtttttcaagccaccttttcctgtctcagttcagagacagggtgaccaagggcccaggaggggaaagagaaatggggacaagacttgaacacaggcctttgcacaagccagctgagggctggggacgaccccattctcctgctgccacacccctgtggtgggggatggaagcggaggagtcggagtggggcgggcagagatggggcgggctaaggagagcatggaggaggcccaagacctcggggccctgctccaggttcgctgtccctggtgctgaaatcgccccggcggccgcgcctgtccctgtccatggtcctgacacgccccgcaccttctaccctgcccttctctccgggggtacccaacgtcctggctatctcctgcccaccctgtgcccaggaaaggccagggagaggagtcagggtccggaacagggagaaggtgaggaggtagaagataaagaggggcccaacatagcggcgaaggtaggcgcccaggctcccttcagctactcacattcctcggggatctggataagcaggcaggggctgcagaggaggagaggccacacgtaccgcagcgccacgaccatctttcccggcggcaccgcgcagcacagccagccgggctcggttcaggctccggccggaggggaagggggctggtgggcggcttggggcgggagttgggagtgggggca

SEQ ID NO: 1423 - DNA, 14429 bp, Homo sapiens; identical to SEQ ID NO: 1422

SEQ ID NO: 1424 - DNA, 14429 bp, Homo sapiens; identical to SEQ ID NO: 1422

SEQ ID NO: 1425 - DNA, 78253 bp, Homo sapiens
acgcctatacaccgccaaatcgctaggaagccacgtattcacgaagccacgcagtgacgtcgccacgcacgtacgcacgcacttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaggatttttaagcccagagctgcgagaccagcaggaaggaactgggagaaaccaatggggaggggatgggggcggggctgagaggaggagggcggagctgggggaggggaagggcgggagtgaggaaaccgctggggcggggttgagagtggggcggggacttgaggggatggggcggggacttgggatggggcggggactcgagggggtggggcggggctgagagaaaccattgggggcggggctatgggcgatctgggcgaggagaggctgcaggaggagctcgcggactcctgagaaccagcgcggggagggagggggctggtgagaggaggaaggtggggctgaaagaaaccagtggggaggggttgggggcggggctttggaagctggtgctggagaagcagggcagggctgggggaggagtggggcggggcggggttcggggggggctggggctcggggaggggtggggcggggctgagggaaccgccggggaggggctcgggggcggggctttgaaaacagcctttggagaagcggggctgggggggcggggcagggccgaggggaacctctggggtggggctggggggtggggtttgcacgcagccacaggagaaacagggcggggctcagaaaagggttggatcgggctgagagagaccgctgaggggggtgctgggggcggggctttggaagcacccgcgggagaaacagggaggagatggggagaggcggggctcggcgcggggcggggcttcggaggcagccgcgggagaagcaggggggggttcggggcagggcgggtctgagcgaagccattggggagcggctgggggcggggccttttaaccagccgcaggaggagccgggtggggctggggcggggcggagctgagagaaaccgctgaggatgggctgggggcggggccttggaagcaggcgttggaggggcggggtagggccgggccgagagaaaccactggggagggtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatcccccctcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagccaaacactctttgggttcacgctgtgctgttcagtcactggtccccaccagcctgctgttccaggtctccctgctttgcaccggcggttcccatggccttgtcctggtgcgctcctggcctccttcaaggcacaactttaaagtcaccttcacagccccactccgagtattagagactttcgtctccagctctgatagcattttgtacctcccctgtccccaccctacgttaggctcttgcaacccagggtggtaattgctctgtaagactgtggctgccgcagggtctcttgagttccttgaaggcaaggccggtgttttactcatttctgaaactgggtgcccagggcacagtatctgcttagtaagtgttgaatgagcaaagggcagctttcttgttttttctagtgagatgcgcctacttctccctggagaagcttgaggaagcagaaatgctggagatgaggtgaggaggagagggtccctctttatgggatgtaggccgtagggctgcaggggaccttcagatcaccagttccaagtcctatgtatgctagcatcccctcctgggttccttccccacaagaatggttgccagcttctgccgaacaccccagaatctgcttagagtggtttcagatcatgaatgaggatccccgggatggtgggtggccgttgctcctcccgtggcctcttgtttgaagaactagaactcgcataatgagctggatagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactgaactgacccccactcctggggccagcggtgtgtctcctcaagttctgcttgcttcttcaggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccggtccatcctggtggccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctagagctgtcccttgcgaatttgccatcaccttgcctctctgtgctcagcatccccggctgtgcagtccttctcttctgcccacatgctcccctagagaagcattctttttgctcagactaatttccgtgcaactcctcctgttttctgagcctgtcaccgccttcctcttcctttgcctccccactgacactttccagagtgcagccacctctcctcgctgtgcttttttgactctgaggcccaggaggaagttgcccttctctggagatggttcacgtttgatcctgcctagtgttccggggcacggccagtctgggaccgctttgaccctgattcatggtttcccttcagatgctttttggtcagcctgctttcctcgtctaggaaatggcttttgcccatttttctttttctttctttctttttcatttttttttagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattgtaagtaaccccagagatcatggagtgtcccactgcccctccatctgaaggctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagaggaggaggagtaacaaaggaggaagaagaggaagaggactagaagagcaagtaaggaggaggaggggggagtaggaggagaggagaaggacagaaggggaaggagaggcagatgtggaggagaggaggtggaggacaggaggggatgagaaagaggaggagaaaaggagaggagagggatgaggggggaggaggaagagaaaagaacaggaggagaagaggaggagaaaaggaggaggagtgaaagaaaagaggagaaggagaggagggggggaggacggggaggaagggagaaggagagaaataggaggagggaggaaaggaggagaggacgagaggaggagcagaggaggaggaggagaggaaggggaggagatttggaggaagaggggaggtggaagaagaaaggagaaggcggagaagaggagaaagcagagaggaggaggctgaagaaaggaggaccaggaggagaggacgaggaggaaaggaggaagaggaagagtggaataagaggagcagaggaaaaggaggagggggttggggaggagtggagaggagaggaggaggaacagagttggaggaggtgaaagagaaaagaggagaaggaggagaggaagagagaaggaaatgagaaggagaaaagtaggaagaagaagagagaagaggagaggatgaggaggaggagaggagaaggagagcaggaggtgggaggaggaggagagtaagaggaggaaatgaggaggaagaaaggaggacagaaggtggagaggaggaggagaggaggagaaggaaacgaggaggaggacgaggctgcaccacccttatcaggttccagttctcggtgcgccccgttctgcaagacactctcctgtggtcagccctggtctgcagaggattcccgcgctggatctctgaaggatgctggcgccctctctgcagcacattcctgatgcccttgctgacacgtgtcctctgggccctctcctgaaacctgattctccggggtgtcttctggcctcacctcttctgtccagttccagcaagctcactttgcttagcctttgaatcccttccttcactgtctgccatgacagttcaggcctttcaccgtcactcaggcctggaccatcactgttgcccatcccatgccatcaacaggtttgccccatcccttcggctccctaccagggcattcagttgtgttgagcagcagagtgtctccaagtccccactggttgagctgcatccgggtcccatcccacagggaccccctggccgctgcagatgcatgctgatcctgcagctcctcgagggtgtcatcgctttcccccttcccagacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggtaggtgcacactcatgtctttgttacttgtaagggggcatcttacaggcaagaggagttaggtgaatgtgaagaggaaggaactactctgggcagggggctgggggacgcttcgtagaggagggggtgtttgagctgggccttgaaggtcaaaagggttttgttaggtgggaaatgggggaaggacagtctgaaagggttaggtacattcaaggagcccagagaaggttcgtggctggagcagacgcattcgtagagtgaagtcatgggagagaagaggctgggaaactagattggttccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttcactcgagagatgaggacactgaaattcagagaggggaagtgatttgcctcagcttgtactgtaagtgatcaaggcaggactcaaccagtctttttgaccctgactatggtgatttgatctctacaccacaagatggtggtggaatggtggaatatggtaactagaaggccctttctagctcaggacacatttgatgctgtgactgtttgggaattcagtcctgaccaatttaagaggttgtgtttcttagctgtctctggctcctggtttgcccagtttgattctgtgcctgcctagcaaaacctctctgtctgtggtctaagaagcctgacatctctgaactagtcctcttcctgtccactcaatatcgacagaatctcatggtatgtcctcctggctcagccatggaataaagccagctctgttgtttttgtccttgtgttgtgccccagcttaggaagaataactcttcaggctgcctctcccatgctaggtcacatgcaggtcacacattcccaggtaaattttgcactttgtttatctggaatttgtcttaatttccttgtccttgtttctgattgtgtactctcttcccttctgtctcattatctgggccctatgtcttttctcatggtttctcttctgtaagtctctagacccgatgcaagtacacagtgaagtgaatgaagttaaagataaagcttcagtgtctcttgcttgaacagccctggaaggagccctagcattatggtcctacagttgtatggtttggaaaatctacaaaagatattttaaccacagttggttcagggaatctttctttccactatgctgtctctatccctcttgcctgtgtgttgggtagcaatgcaatgaccatggtcatattgagaattcaactaaggggacattaagttgggattcatttagtttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacttgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaactataacaaacaagaaaagcaggaataacatactatagaagtgcatgaggcagttaagtactaaagataagtagctatttatgttatttttttctaaattttcagatgtttctaacatttgtcaacgttttcaaatgtgtgttcttttgttttttttttctcactttaaatatttgcttttgttcccaattttatactggtaattttgcattcttatacttaaagaaggccccagatgttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagtttgtaaaataaaggggctggatttagtgctctttatagacctttctctctcagatatttcctgagtttttcattctagaaatgctggaatcatatatttgtaactgaaactagtaatcttcttgttcttgagtcttcttcatctctaaagtggacataaaatacatacctctcgtggttgttgtgaagcccgtggcactattcatggtagagcaggtgatcaaaagtcgcttgcatccttctgtccaattgggaacaaaagctttcatgtataattctcacacctctcccttggaatcagacaatcttatcagaaaacctaaaaatttttttcaatcaatttagaagtttattttgccaaggctaaggacatgcctgtgacactgcctaagaaggtcctggtgacatgcccaaggtggtcaggccacagtttggtttttagggagatataagacatcaactgatacatgtgagatgtacattcgtttggtctggaaaagcaggacaaatggaagttggaggacttccaggtcataggcaggttcagaaattttctgactggtattaataattggttgagttattatctaaagacctggaatcattagaagggaatgtctggtttacgataaggagttgtggagaccacagttttatcatgcagatgaaacctccaggtagcaggcttcagagagaatagattgtaaatgtttcttattagacttaaagagtctattgtatcagtcttaaggacagtgttcatgttgatggtaatgaggcatgtccgactcccccttcctcatcatgtcctgaactagtttttcaggttaactttggaatgcccttggccaagaggaggggtccattcaggtggttggggagcttagaattttatttttggtttacattctttccttctggccaggatttgccagaggcaacatcaatggacaaacttttattttgtcccatagcattgtggaggtggtttggctgcctgccccaggtccatcctgtcccttggtaggatctctatggccaagagacttacagccaaaagacttatagacagtttaaatgttctaggccagacaggaatggacgtggacaggcatttattactccttaacaattttgaagtaatgtaaaagccaacaaacagaaagtaaaaggcgaggttacaaaattgccttatctatctttaacttctatgcattgagctactgtagtcttggttttagttacagatttttagcaattggctatataagcaagcctaaattttaaaaagaagagaaaatgaagcatacatttaaaagttcttaaactttttttttgaaacagggtttcactttgtcactcaggctggagtgcagtgatgtgatcatagctttctgcagccttgacttccgggctcaagtgatcctcccacctccgcctccttagtagctaggaccacaggcatgcaccagcacacccagcaaattaaaaaaaaattttttttaaagatgagatctcactatgttgcccaggctggtctgaaattcctgtcctcaagcaatcctcctgccttagcctcccaaagtgctgagattacaggcatgagctaccatgcctggcctaaaacatttttaatggaagtataatttgcaaacagaaaacatgcccaaatattaagtgaatgcactgatgaacattcacaacttaacaagatagccagcacttaaatcacaaaatagaacaccgctaggacctctttgtaataccctccaagtcactacttctgcccaaaggtaatcgctattttgcaacattttttattactttatataaatgagatcgtacactgcgtaatcttattactgtctggatttttatattaaatattgcttgtgagattcatccatgttgtcatgtcagcaatactttattctcattgccatatactattccatttttatcagtataccatgatatatttacccattctgctatttgtacatactggaattgttcccaggtttttgtaatacaagcaaagctgctatgaacatgcttggatttactttctttggtgaatatgtattactgttatgtacatgtctagaggtaaaattgatgatttatgggatatgcatatgtttaattttagcagatattgaaaaacagatttttaaagcggctgtagcaatttacattaccaccagcaatgtgtgagttccatttgctctccgtccttgacagcacatgttgtcacttaggtgggtatgcagggggatccttttttggcatgtttacttatttttttacacagtgcaaactggtgtggtgtaccgttttatggcttttgcctaatgccatcactaaagttaccaaacaattccatcacctcagaaattgctttgtaccgcctcttggcattcatccccttctccattctcaaccctggcagccactgatctaatttccattcccatagttttccagattatcaaagaaacagaatgatatggttgtaaccttttggatgtagcttctttcaggtagcaaaatgcttttgagatttaactatgttgttgtgttttcagtagttcattcctttgtgtgtgtgtgtgatagtctgactctcttgcccaggctggagtgcagtggtgtgatctcagcccactgcaacccctgcctcccacattcaagggattctcatgcctcaacctcccaagtagctggaactacaggcgtgcaccattgcgcctggctaatttttatatttttagtagagacaaggtttcgccatgttgaccaggctggtctcgaactcctggcctcaagtgatgcacctgcctctgcctcccaaagtgctgggatgacaggcgtgagccactgcacccagtccagaagttcattgctttttattgctgggtcatattccattgtatagatgtatcacattttgtttatgagtcctatagttgagggatacttggtttgtttccattttttctctattatggatacattgttataaacatttgtgtacagggtttgtgtgaacatagtttttatttcttttgagtaaataggagtgggattgctgggttacttggtaaattgctgggttatagttctttttgagaacttgtcaaacttttgctgagtggctataccattttgcattcccactaggagggcttgagagttccagttgttccacattcttgccagcacctggtactgctagtttttctgtgtgtgtttttgttttgttttgccactctaaggtgtatagtggtatctctttctggttataatttgcatttctctaatgattattaatgttgaacatcttttaacatgcttatttgccatccatctaacttctgtggtaaattttctgtttatattctcgtccattcaaaatattgggttgcttgttttcttatggttaattttaaaagctttatttggaaataattatagatttaaaggaagttgcaaagaattgtattcccttcactcacccttccccaatgttaacatcttgcctaactatggtacaatattagtatcagaaaattgacattggtacaatccacagaggttattcagattttaccagttatacatatacttgtgtgtgtgtgtttctatgcaattttatcacatgtatagttttgtgtagcttccacgacaatcaacatacagaactgtgccatcaccacaacattcctctcatattacctctccacagcctcacccacttcctactctacatcccttacccttatcaaccactatttggtttaccatctgtataatgttgttattccaaggatgttatatacatggaagcatactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgctgtggtgcattctcggctcactgcaacctccaactccctggttcaagcgattctcctgcctcagcctcctgagtagctgggattacaggcatgcgccaccatgcccagctaatttttgtatttttagtagtgacagggtttcaccatgttcgccaggatggtcttgaattcctgacctcataatctgcctgccttggcctcctaaagtgctgggattacaggcgtgagccactgtgcctggccaatccatttttagtgtttaaagaaactgcaaaccaccatggcacatgtatacctatgtaactaacctgcacattctgcacatgtaccccagaatttaaagtataataaataataatactaattttttttttaaaaaaagaaactgccaaactattttccagagtgattgtgcagttttacattttgaccagcgatgtcagtgatccatttgctccacatcttcattagcatttggtgttgtcacagtgttttattttagccactttgataggtttctagcaatatctcattgtggttttaatttgcattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcatggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattctcttaagagtgctctttacaaatatctttcttttattaatttccaatatcgcctgataacgttctttttttttttttttttttagacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttatagtgagccaagatcgaaccactgcactccagcctgggcaacagagtgagactgtgtctcaaaaaaaaaaaaaaaaaaaaagcacaaaggactgttcagtacttttacattagctaagaactaatttacgctaacttcttttttatatgcaaaagatagtcataggatcttaataagttgtgtaatcatgttatttgagattgtatactatatgtagctcatgtcacattagttattttcacctaaggataccttaacattaggcctacagaaaattaatataatacctttgttctctgcaaaaggctacaacaagtgatctctagaggtgttttctgactctcaaatctctaactcttggattctgcctcatccagaaaggtttgggttaccaaagcaaagtaccataaactggatgacttgaaaacaacagaaatttatttttcatagttctggaggctggaagtcttagatctgggtgctaatatgagttctggtgaggaccctctttggggttgcagatggccatcttcttgctgtgtgttctcacacagaagaaagagagtgagctagctctctggcctgttcttataagggtacttatctcatttaggatggtcccaccctcatgatctaatcaccttccaaaggacccatttcctaataccatcaccttaggggtcaggatttcaacatataaattttgcggggacacattcaatccataacagattctttcctgttattattttagaatgacatggactctttcccagtccatttgggttaggattcttattcagcctggaggcagagccgtaccctgtatggcctatcacattccttttagcctgggtctctggttacttgtagaacccttatttataattattgtctaatgctgggattctccagagtgctgcttggagaaatttagcctcttagagacagttgcaataaaagaattctatcaaaaagaattcactgaattgtgatcacaaacaaaataactttgtggggataaaatgtactccaacaagggaggcttatgtttgtttttcagcctctcctcccagtgctgcacttctaatctctctgcagaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcgggagaactgtaattgatgttcattttggtatatttccctccagtattttttccatatggttttatttttaaaaattttaccccatatatatatacatatatatatacatactaactactcacaaaattaaaaattaaaaaaattaaaaatgtataaaatgaaagaaaaaaattagcctcattttgtatttactattttataatctgcctttttgcttaatcttctttgtcattatatgttcttctacctcatgatttttaatagctgcctagtattccattgtatagccatagttatttcatactttataattgctattgctagacatttagttggtttcctttttttgcttttataataatgtgtgttcctatacataaatcttgtaaatgtctgattttaaagataaatttctagcagcaaaacttcttagttaagaacatatacattaaaatacactcttattatatttttctttaccaaagtaatatatgtttattatagaacatgtacaaaatcacagatatacaaaaaaaacagcatataagttacttgtattcttcccactcagagacagccactattaacattttattgtaaccatccagccttcttttctctgtattctacatgctctttcataagctttttttattgaatgtattcagaatacctaagttcattgttcttttttaccttcactggttacatggcatttcactgaatgaacaaaccagaatttgtttgatgaatcttctaatgctggacatttcagttactttctgtttttctgtactataaacaatgcagaggtaagtagtgtgtgactacacctttccaagtccttgattgttccctgtgaagaaattcctagacgtgcaactgttgtttcacctgtatgttaatttttaaggcttttcatgggtattactaaatgttcctataacaatttttatcttagaggcagaatattggtatatcctttttttcccaaattcttgatattactattttgccaatttgactacaaagaattgattatcatattttaaaattaacatttatttaattacaagtaaaactgaactatttttttcttttttgcccaattttatgttttggtataggtttttccttgtttattaatagatttaaaaaataaatttgaaatattaatttcttgtcatttgttcaggttttctccttcaactgattgttgtgatgagttatatgtctagacttcctgatagtaaattgcactcctgaaataatccctccttgctcataatgtcttgccagatttggcttgctggcatttcatttaggatttttgcatctatattcctaagtgacattagtcttcagttttctttctctgtgtatttgtgtgggtgttcgtcaggttttgtgatcaggataactttaattttataaaatgaatgggcttattccttcttttattttataatgagaaccgcttttagagcatggaaattacctgttctttgtaaattaaaaagaacttgctcataaagctgtctgggcactgtaacaatcatcagaggaaaatgtgtaacaccctatttttccccacgttttctacttctttgtgattccagttagctaattttcctagaaaattgtcctttttattgagattttcaaactcgttaccatctttacagttttattgagatatgcatacaagtcacccatttaaagtgatttttagtgtattcagagctctagaccatcaccacaaccaccacaatagattttataacattttgaaaaccccagaaagaaaccccatgcccattagcagtcaccctctatttccccttaattcccccccttgtcctagataaccactaatctactttctatctccatagaattcccctattctggacctttcatataaatggaatcacacactgtatggtcttctatggcagccttctttcacttagtgtaacgttttcagagttcatccatactgtagcatgtagcagcactttattctctctcttttttaagttttcgtttttgattaacagactactttttagagcagttttaagtttacagaaaattgagcagatagtacagagaattcccttatactgccctcctctccactcctgaccataattttgcccacaaacatcttgcattggtgtggtatatttgtcataatcaatgaattgatattgacacattatgattaactaaagtccgtacatttgggttcattctttgtgttgtacagttctatgggttttgacaaatgtctaatgtcatatatctaccattacagtatcatacagagtagttttgatgaaaaggtaaaacacaggggacttttagggcagtctttccctcctccctgtgaacacctaccaaccactgatcttttgatttgcctttcccagaatgttatataattggaataatatagcatgtaatcttttcagaggcttctatcactaagtaatatgcatgtaagcttcttccctgtctttctttggcttaatggctcatttctttttatggctaagtaatattctattgtatggatttaccacagtttatcccttcaccttttaaagaacgtcttggttacttccaatttggggcaattatggataaagctgcttcagtcatttgtgtgcaggtttttgtgggcacataagttttcacctgatttaggtaaataccagtgagcatagactatgtttatctttgtaagaaactgccaaactggcttccaaagtggctttgtaattttgcattctgaccagcaatgtataagagttcctgttgctttacatcctcgccatcatttggtgttgtaagttgtttggatttttgtcattctgataggtttgtactggtagttcatggttttaatttgcaattctctgataacatacgatgttgagcatctttttacatgcttatttgccatccatacattttctttgatgcgatgtctgtttagatatttttcccatttttaaattgattgttttctttttttgtatagtggatacaaatcctttatcagatatgtgttttgaaaatatttctcacactctatggattctgttttcattctcttaacagtacctttcacagagcataaggtttttggtttaattttactaaagtccagtttctttttatggctaatattccatcatatggatataccacattttgtttattcatttatcacttgatggacacttgagttacttccttttggctattgtaaataatgttgttatgaacatttggtagaagttttttttttgaaacggagttttgcccttgttgcccaggctggagtgcaatctccgtgattctcctgcctcagcctcccaagtagctgggatcacaggcatgtgtcaccatgcctggctaattttgtatttttagtagagacggggtttctccatgttggtcaggctggtctcgaacacccgaccaaggcgatccacctgcctcagcctcccaaagtgctgggattacaggcgtgagtcaccgtgcccggcctggtagaagtttttatatgaatatatgttgtcatttctcttgagtagatacccagcagtagaactgctgagtcatatgataactcaatgtttaactcttaaaaaaaaaataaaaaaaaaactgaacaacttttccaaagcggctgcaccattttatattgccatgcctcctacattgctagtggcattttacgttgtcactagcagtgtagacgggttccgttttctccatatcctcaccaatgcttgttatcagtattttttgttatagccattgtagtgggtgtgaactggtgtctcattatgattgacttgtatttccataatgactcatgacattgaacatattttcatgtgcttattgaccatttgtatatcttctttgcctcttcacttttgatattcttttccatgggaatttcatggatttcactaaaatctttgtgcagatgatttccaatatttacttccaactttgacctttctcctgagattgtcgcagtttcccatctgtttcttagccattaatgccctaattgcagaatcagtgtgtcacaactgaaattcatcatctttcctcccaatcaatttattcttcctctgtgttccttatttctgttaatcatagattaactaatcttctaatgattagactattcttctaatcatccagactttcaatttggcatcatatttacatgtaagagaaatgagataggaaggaatcagtttgttgccaagttccacattactttcataatattttgcatatgttttctctttactttgtattctctccttcctgatctctatcctcttctgacttttttgatcccttactcttctggttctcctgtctttgatcgttttatttcaggttattcttatctgccccttaaattacctatctgcaagatctcagctcactgcaacctccacctcctgggctcaagtgatcctcccacctcagcctcctgagtagccagtaccataggtgcacaccaccatgcccagctaaagggtttcaccatgtcgcctaggcttgtcttgagcttctgaactcctgagctcaaatgatccacctgccttggccttccagagtgctaggattataggcatgagccactgtgtccaaccgtccacaatcttttacaaatcaatgtttaccttccttcttggctatttgtatgtagtcttaagatatgaactatcacttacacacataactcccaaataaatatttctagccttggaatattctgagaacttcagacacatatatcaaactatctgtaggacagatgtccaactggatagatggacatttgtagaatagatgtgcaattggatacatgtccaaacttaactctccccaccttagctgcccccaaacttgttcctcttgtcatatttccagtcaatggcatgaccatccatctgggttctcaggacatacatctgaccatcattcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatcaaaataagaacaagtacaacaatatttactgtctctctggtggctgcttacttttctaaaggatatagtttaagctctttagcctgtcatattgtactgctccctacctacttcttcagctttgtctcttgtcactccagaaatattcttctgtcttttaatgtgttccctctgctcagatgcttcttcctgccttctttacttagtgaaccaccatctgagatttcttggaggtagacacgatcacatggctggaatccaaaagggatggtcgataagaaccggcttcagtgaatgtggatttacatactttctgggagctctgtatgtaaaggaaatgcttccagcccttcctcgcttggctcttggcatataacttctgatggctctcctgctttagtagtcacttttggagcaatgagagatcagattcctttagtggcctgggaatgatgtcacatggtgttattgatagaagcctgcagagcttgggattctgagaagcaatcttcagactagaacttaccccaagagaatgagcaactctatggtagagggcgagagcctcgaacaggcccaataacctctagtccaaggactttgggaagttttatggtcccttctaggcctacaggatacaagcactcagggatagcagtgtttttgggtaaagaacagtgcggggctctgggctcaaattcctgggggcaaacaaatcaatttggctcccctcagctctgtgggactaaactttaaaactgcccctgggagtgacctccccaggataatctcagggtactcagtactcacctgagtagacaagccccaggaagacctggatgagtctttggaagtcatctttttagctcagttttgcctgctccaccaggatccacaccctttactatggaaatctgagtacgagttagggcagatgtcagtgaggagaaggattggagctcagtgacctttcctcagtagtgcttacttgtgaagcctgtgtccttaggaaattagcgctgcctctgccaaagtggctttttactgtgttatcctttcccagagtgcacttccagtctcgtttaggccagtgtagttcctgttgagttaagtggctgtgaaaaaaatgttttctgaaaggaattcggaggaaagataccttattccagtgaacagtttgcgaactcaggagacacagccttttgtataaaaggaagttatgtttcagagaacaaagagagtgtttgggttttatagcaaaagtttctgcctgagttcctaatcaggtttatttatgcaaatgaaatattgaaatgggcttagttctagttggttgatgcagctaagttctgattggtaaatacagctaagccctaattggttggtataggtgagctctgaaagtcccaaagttaaagagaggtgggagtttttgggaaactcagagtgacctttagtcagcaaatggctgcctggctgtattttaaatttaggcccagttagccacttgggatccatcttgaaggattgactcttttaggttcatatttgttcacatgtggctttcttcctctgataccttggtgagcctaatggagactaaaagcttagttaactttggctttagggaattaaattatttctggctgagacactaagtagaagctaaaattgcagaaatatctttataatactatgtgagagtttacaaaaactctcacatacattattcaatttattaaatcttcacacaagctagtgcctgtcccttagtaatcacatgtttagtgtatgaatgaacatggaggtttttgttttattttgctttgtagagagacagggtgtctctcactcttgcccaggcaggagtgcagtggtgcgatcatagctcactgcagccttgaacttctgggctcaagtgatcctaatgcttcagcctcccaagtagctaggactaaaggcatgcaccatcactaatgcctggctgtttttttttttgtagagacagggtttcccgggcatgtcttgaactcctggcctcaagtggtcatcctgcctcagcctctcaaagtgctgggatcataggcatgagccaccacacctggccaaacgtggggatttattgtgcctattttacagtttggcgaactgaggtctaagcagctgaattgagtttcctaaaattcaactctacagttagccaagtatggagcctacacttgaaattagatccatttcaggtgaacatttactaagcatctactaagtgacaggtacttatcagtgatgaataaacatgttccttggttttgagagcttataggcttgtcagaatatgagcaaataatttcaacacaatatgctaagtgtcatgatagagaactttgtgtgatgccgtggagtcatacggaggggcacctaatccagtctgataatgttgtgaaagactacctgaagaagtgacacctcagttaagttttgaaggttcattggagattggccaagggtaaagatattctaggctgagagatcagccccagtcagggcacagaggtgcaaaccagtatggtatgtttttaggattgctggagtattccttgccaaggggaaaatggcagaaatgatgacttagagaggtaggtgagattcagatcattgagtacgtagactttgctttgtacaccattagttactacacattgctgaattattgaaatcatctggggaacttaggcattttcttagttagctagatttgagagtcacatgtggaggcaatgagtgacatagactgccctgttgcatcactctggtgacagtctacatggaggcaggtagatttgaaagggatgctactagacgcctagagaccattttgaaggtcactgaattcatctaagagatatggtggactgtataaggcagtagcagtgaggacagagaggaagaggcagatgcaaaatggtgaaactcttacgatgttgtggggaggattggtgagggagagaaaagtgtctaaggtaattctccaggtttctggcatggctgtctgagtagatggtggtatttttgaccaagttcaggaatgaacagtggagatagaatgtacaaaaaaattggataaattcagcttggaacctgctgaatttgaggtactgtgggacttccagaggggagagcagctattttgttctggaactcaggatgtgtctaggctggaaatacaggtcaaggcctctatgtctgggcagtttaaacccaagtgaatagtaagacatctctcagagagaatgtgtggagagtgcatcttcaataattctaccccctttcgacttcaaaggctgttcccatggggaagcagaagcagcgtatttctctctctctctttttaatgtttgaggcaacaagggatactgaaaatgctataaaaggtggagttagaaaacctgagttcaagccctgcttctgacacttcaccactctgcaaccgtcagtagttcctgagcctctcttagcctccaggtcttcatctgtgaaacaagggtagtaggaataactgcttcacaggattattaagatagtccaatgagaatgtgtatgtggaaagtgctgtgtaaagaaccatagaaacatcatttttgttgttgttgttgtttgtttgtttgttttgtttttttcccctagaaacttggaccaatatgtaggaattacggggagacagatttggtccaatataaggaaagactaatactttgactgttggatgatgggaagagctttgggagatgggaagctctgaggctctggatatccttaagcaaaagccaggtttctgggcatatgctgagcgttttgttgtcaggggttgggtcatcctgcatgacctctgagttacctttcaggctcagatagagtttgagttactagaacacttatctacctattttctgaaattttctacactaagtagattttttaaattgtaaaagcaatacaagcgcatggtctttccctttgactctcttaaagtactgggcattttggatcctaagtggagacttggtttatataccctgaataatggggcaaactgcctcatgtcttactgcatgaggcatttatggacagacattttcttaatgttctttaatgagatctctttaaaataataatttttttcttattttcaagcagaaatgatattataaaaagctaacaaaatattgccaagtagaggtcttgatcgagtatactccaatgagtaggtaaaggtcatttgaaatcagcacactaattatttatatgcaaatgaatttgttagagagcttggaaagagttgttctctgaactgggttaaacatcccctaagagctcatgtttatactcttaatttactcagaaacctgttgttgctctttctttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagctctttctttaattgatagaggaaaggtgaaatatgccagccatgactgagttatcacaaatttagaaatggcatgaattgaatttatactttcctgtgtttattttattgccaatcactgatgtgacacacatttgctaaacaagttctaattttctgggtaactttccctacagaaagcttatttcgctaaatgaaagatctctactcatgccatttaatgaggaattatctttatgattgttgaggtgtcttcctggctctttgaaaaaatcacaaaaacaatagccccaaataatagtgattttatacctagaaaatattctacaaggaataagttgctgtaaaccatatagaggtgaacaattttgaaaagtcaagaatttaggaaagtacattcagtcttaattatggtagaataaaatttcatcttcctgatgcttccataggcccttcaagatgtttgcaaagcccttggtcagcttttgattattttttcattgtactgtatctatgaaaaaggttgccattgggaaagcataagtaggttgtgttttgcaattccttcttgtggaaggaaattgatagaaccttctagttgattttttgaaaaagtaaagatgtttaaatactcttgccttccctaccttactccacacttctggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgctgcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagtcttcagccaaattacgagtacagcaaattaacacaatttgttaatttcctttttaattacactacgaacaggagtatttctgtattttggcttttttttgacatagagacttcatcttaaaagcagaaagactttaatatagctaaatctatatctataacaaataaagcttgtttcattttccttacccagctggctaagatttatacattaattattcaaccgatgcatcttaaacatcctagttaaaatacacactgttggccagaaattgttaaacctccagcatacttttgtttgcctgtaaggaataaatacttagaactgtaaatgggtaaacttaatctttccatgtggtgaggtcaacagaactcatggtgaacatacaaagaataggggactaattattattgagattcaggtaagtgatttcttaggcattttagctgtcatgctgtggaataattgtaaactcaccaggaaggaattgcaaaacacaacctacttatcctttccccagtggctatatagaatttttttctgtcctgcagtttgtgccaactctaatcattaaaaggaatgttattttaagtattgcttcctcaataacagtgtttgacagaaactctacagaatggtggctttgcccagagtgtggcttcagtatgctagtgtgatttaggcaatcagagctattggtaatggaatgcagatctctgtagcaattttatttaaagttttgcctagttaatattatatccaactaatgtaaccatctgtatccggccccatcagtgacaatataaaactgttaaacaccatttcataggcattaagtgctttggctttggtataattttatgatcatgtcttattcttattgtagtacttcattactatcttttttttttttttttttttttgagacggagtctcattctgtagcccaggctggagtgctgtggtgcaatctcagctcactgcaacctccacctcccaggtcctggttcgagcaattctcctgcctcagcctcccgagtagctgggattacagacacacaccaccatgcccagctaatttttgtatttttagtagagacggggtttcaccatgttgaccagactggtcttgaactcctgaccttgtgatccgcccgcctcggccttccaaagtgctgggattacaggtgtgagccgccgcgcccagccactatcatttaaatgtcagtaacagcagcagcaagtattctaggcatagcacagagaccaaggtaatgggtctcccagccttgtgactaaattcttcctgcctctaggtcttcacgtagtctgttgccttgtccaggaatgcccttcaaaccttggtttaaaggccttttcagataagtctctctttttccccctagtattcttgatcactgtacctatttgtcttctccatagtatttatcacaatttaaaattatacttgtattttttaaaaaaacttgtctcccccactagaatgtaagctatacaaggacagagaccatgcctatattttatttattattttaaaaaatttttattttttaattgtaaattaacaaattgtagttacatatatttatggggtacaaagtgatgttatgatttatgaagacaatgtggaatgattaaatcaagctaattaacatatccaccacctcaaatattaacccatatatccttttgcgtagcaaagtaaatagggactgtaaatattttttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggatttaaataggtgattctatgttgtaaaagttttaaaaatgactgtgcctcaggaatacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactgctgtgattctcatttttgagttccacagatttgggacggagattttatattggcaaatatttctgaagagacaaataattgcctctggaaagaggcttcttttctcttccaaaaattcatatttgctggtttaaattgatgtgactattttttggctagaactctgcagtatttcactgagcagtaattattcctttggtgttgcaggagttttctgagagaagggaactaaatctaagagagcgaatccatctggtacatatgttgaagctctctatgaggccactgacactgaaatgttaatgctaggtttctataaactggtatcatttagatattgatacaatatgagctagtactctgggtcactgaaccaaaggctgaattccatttccttatatggcactggattcctgcaccagtggattgatgactcttggcagagtaccatggtaagatagaccctgcattccagtcctgtcacccgattgtcagactctggctgtcccagccccaatcaggagtagacactaaaggccagcagctggcaaacttagtgtctcttagtacctcaagcattggtaggtaactaagcttgacgggatagtagaagtacctacacatagtaggtaattaattctagattagtctgataccttaagtgttaagtgcccctgagaagaacccctggggcccatggagactcactaatctgcagcttttctttttacattatggtgtgggtgaaaccaggatgtgttccaggactgaactggtggctgtcctgcttgggtggggatctggcatccagcctagccattgctaggtttttccctggggtgttggactctgtttctccaccaaactgccaactaacattcaattcaaataaaatgtcttagaaatatggtgctgccgccgtatgtaaggtgcagggtggcagcaccatgtttccaagattagtattgccactgtgcaaggtctttcctagccagattgttcagcttgcatttatcatgattttttcatctttgtaacttggatagccagtcagccctcttagggacaactctggggctctccaagttctgattcttcttgatctgtgctcattattctttttctgctcttcttacattgaagtcttggaaatcccaaccattgctataaaagttctgttgcaaagaatggaaaatagcctattttatcccatagcccagttacacatacatagggagctatggacatctcactgttcactttgagttgaacttgaaattcctgcctctcctcttcgggaagtattaaccaaagaagccacaaggggattcactagtctcctatgaaataaaatgctatcagataccaaacagctaactgtccagatttttcagcaaaaattggctgctttagttttttgaaattttttcctctctcctctgtagttcagtatgagagactcttcagggcaaattgtcagtgggaggaattcagagatgccatatgtcatcagtacatggctgaggagaagccaaaaaagtattaccgccgttttcccaaaaagctattagggaaggttattgattgttttccacacaccttccaccttcatcacagggtattgtgataactaaaaaggtactttcatgtagctcttaaaaacagttttctccttttttgttttcttaatatccactgtgcccaggtcacttcacagagctccaaagtgatgctcctttctttctccataggatttgtccttgcccttctggcaaatggacttgaattgctactgcttctgtcagctggtggctatgtttacttcaaggtctttgagtaggccagacaagtccaattacataaatcattattgactgctgtcaaccccctgtccctccctcttacacttgtttttctacccctacctccctctgctttctatataggattggagatgccatttttttccttcagactttcaggctttttaataaaaatggtgcttaaaggtacatgtcagcagacttttgggtgacctttaaagtagagtggtatttggtctgtacaaaataacccattctctatcatttatagattgtccacattatacctaattttaaaattcttgatgacatctattaggcttaagcccttaaactagttcatgagggtacaagggtattgtagcattaatgccctgtaggtaaagtgaatgttggtatttgatctttttttttaacattcttaaattattattattattatttattattattatactttaagttttagggcacatgtgcacaatgtgcaggttagttacatatgtatacatgtgccatgctggtgtggtatttgatcttttagttggtacctggaccatccttcagtggggctttcctgcttttcccctttccccttttgtgttgttggattaaggtatatttcatttattcttattctgtgttcatttcaacataagcatcacagacccattaattaagaacagctggctatgttctcctgccacatttctaatttctcaatgcccagttgacaaacagaatcctatctagagcaaagtcatttgttccaggctcagaacacatggagggcccagaaccatacgttgcacttttgtttcagttagaagtcttccatgggcttttcttccagtcacactaaagtagtatttgcagaaatgaagtttctttgggtcttgttttgtttttgtttttgaagatggaatctaagatcatctcagtttagttctttgcctttttgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccatttaggaacacactggggatgataggagctattggttacagtgcaccctcatccaggcacatgtatcattaccctctggcccatagccacaagtatatccttgtccccaacccaccatcttccaaatgcacactatgattataacagggagcatggttggattgatgtggcagtccacatggaaacacagattttgccagaggtcctctttcctgatgttgtttcaccttcactgtgggctgtcattcatgttgcttcatatctatgttgctttgctgtaagatgcatgggtctttcatagactgctcttccttttttgctattggggtgtgaaaggtattgctcctttaaaaaagtacagcagggctgggcgctgtggctcacacctgtaatcccagcactttgggaggccaaggtgggcggattacctgaggtcaggagttcaagaccagcctagccaacatggtgaaaccccgtctctactaaaaatacaaaaaattagctgggcatggtggcaggcacctgtaatctcagctactcgggaggctgaggcaatagaatcgcttgaacccgggaagcggaggttgcagtgagccaagatcatgccattgcactccagcctggacaacaagagcgaaactctgtcttaaaaaaaaaaaaatagtacagcataaatccttccaaacatgagtagagaaactctctaaggaagaaaaatctctggatggaggtgccagggtctacttgggcaggtgttctattgtgacatagctgtctttttttctgtttagcccttggaaaaatgtgtgttttcttggattcaatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggaacctgtcttaagggtcaagagatagttgagttcctctattaaaaacaatgaaggctagaccctgtcttctccattaggaatcctgagcattggtgaggaaattcatactaaaaccttgctgctaccaatctcttattccttatactggatctccagtaaaatgtgcatatatatatgcatatatatatgggtttaaaattatttttatcaatgcaataatatgaataatttttgtaatcaggcttataataacatcaacaaaaccaatcaggccggtactgcttcctcccaatcctgctcctcttgcttttggtacttaccttcatattttatgtaatatgcttatgctgccattacttgattcattattttagatattgtgtgtttacttcttgtgatgatagatgagaggctggctgtctcatagtccctatcagtcgagtatggctggtctgtgctgcataacaagacattcctagttaccaggggctttacagaacagaagtttatttcttgctcatgctacacattcaacttaagtgggcagggggcctctggctcatgttggtcactgaaggatggacatgggatgatggaggctccaactcaacacctgatcacatgatctatgaaatgggcaaataaagagttaattgcctgctgcctctcaaaacttcttcccaggtatgatataaattaattttactcacattttattggtcaaagcaagctacatgactatacttaatctgaaaagaggcctggaagtacaaccctaccatgtgcctgggaaaagatgctctggaatatttgtgaacagccctaatgatgaccatacagcctctccattttctttcctccattactccagtataagtaaatcatgtattttttcaaaattggtattcagtgtttgttattatagctttgcatttatgtccagtgccaagccaagcaatgcattatgctttcacttccttttttgaataatattttattttccccagagtcaataattgcctaatttcttatttgcttagttttctttttactcatttcttattttctgcacaacattcatcagatttatcaagtagtcctcagtattattttttgaacactgaaatatatcagataacctaccaattttattttttcttggagtcttccagcctcccgcttcagccttggctctctgggccttctgtacaggaatcatcctccctttgccagtttcctgtattaggaccctagtttttgggtcttttgtctcctttttaaaaattatttgcttacttgttttgctggagcacgtgctttaatagcttcctaaataaaggtttatgacaaattatattagtcagctttttagtaggctatgccgtggtgcaaatgattccaaaatcccaatggcttatacaagatttctttcttactggtatcctatgtctttcatgggttagcagtagttctagccaggtctttttcactctggcacctaggttaagggagcagcccctctctaggagaagcagttctcatggcagaggaaaaatagcactgattgaatcagtgttggctgtcaaagctgctgctctgaagtggtacacatcacttctgttcacatgtcattggaaaatcaagtcttatggccaagcttgatgtcaataagcctggaaaataaaaataatccttccacaggtaaaattatatttttgccaaaggaaataaatagctgtgttgcgtataaaattatgaattggtttttcgcagaattttgaaggcattgctccattgtctcctcgttttcagtgttgttatttaaaaggctgatgccaatctagttctggtataagagtcttccgtataagcattgtttttttcctttgctctgaaaccttttaggttctttttttttttagcccttataattcagacatgttttgacagtgtgacttggtatagatctttatgcattcattttactgatccttccttaggagctttaaatgtggaaatttatgtccttatttttcttacattatgactttgataattttctccccttcgttttttctttctgaaatttcaattatttggatattagacctcccatattgttcctctgcttttcttgtcttttcctctcttggtctttatgttcttctttttgggagattttcttattttaatccttttacttttttgcagtttgattatcatattttcagtgtccttaaattcctttgttttctgtgtcttcctttttgtagtatcctgcttatgcttatggatataaattttctcttatctctgaggatattaattatagttttaagttttcttctgttattgtatcatctctgttttctctgtttgtttgttttgacttctctcatattggaagagttcctcaaatgttttgtgatccttggctgtctattcatattgaagagtggaactctcttgtttcctggggacaaagggagaggataaaatagttatctaggtagctgcatgctgaaaagtatatatgggagcctgctgctccctatacagagttttaattcctgttttcctgtgtcttatcccaatttctgtggtacttggtatttctaaacccttaagccttcccaggattcaatggggactaattgtttcacttttcattggcatgtctttctgcaagcacttaggttctaacttgcttttcctttactctctgaaataaatattcgttcttcccatcatttcctgtcttcgaaacatttatggataattcttgtccactaatgtctccttccctgttttcttagtctgcgtggacttaacacctctttctctctgtctttctcttctctctctctctctctctctctctctctcacacacacacacacacacacacacacacacactttttatttgcattgttttaattccattaatgagacttcgggagggagagagataatcatgtgttatcagtctgccatgtttaaccagaagtcaagctgtggtagaattttttaaatgtagttttctttacctcatgctaaactgagcatggccttaaaatctacccctgttctttgaaataaaactagccttatacttggatagatgacatgctttcaccaccaaattttaaagacaaaacttgaatgttgatggaaattaaaatgtgtttagcactttctgacactatgcatggtaaataaataaatgaatgaatcagtgaaaagaaaggaaagtcaccataatggatactcttgagtttcccactccagctgcactctctacccttccttaccctgctctgggcccctggagactgacttctatgggctgcatcaaccaggctcccttgtcctctggcttccagttaggtttgacaatgcaacgtatcagtgggggagggagaaaggatcagagggttgagaggaaagccagatctcagtatttacttctccagcttcttctctgccaggtcacatttggcagtggctgtgttccactatttcatgccatagcttgtgttgggttgtccctctctgacagcctcagcttttaccaggttctggtaaccattactctccttctcacttcaggtcgagagatggtagtggtttcttcctgctactgatccaggaccaatgcaccttaccttataggttcccttaaccctgcccctaccttcagttacaccttttgaatgtgctgtgtttcctgccaagaccctgcttgatacaaatgttatggtagcactgtctcattatcatccatgtattcttgaacaacatactccacatcatgggcctcagtttccatatctgaaaagtactaaggtggcgataggtggtctggtctgtcatgtaagaactccttcctgttctgacatctctggttttatatgatgcagcagtggtcagtagccagctctagctctaagttctcttttatagactttgtggaccattgtggataattctgagtggtggatgatcacaaaacaatttcttcctgtctttgggaggcagtttgctggagcaaaaggattatagactttggagtcagaccagggttcaaatttgagtgtactactttcttactatatgacctttaatccattactaaacctctctaagtctcacattcttcatcttaagattagggtatatgatggacactgctagttatctatcctagccgttttcttttcccttgctaaaagaatactattttccattacatatgtagctgaacatttagttggatgttttgataaatgcagtttgcatagacataactagtatttactaccatctgattctctccttctgaaagcatgaaagactaatttccaagcttcctatagttaggtgggatcatatgattaggtctggccaatgagctgtgagggaaaattacctgtgacactttggggctgaagtagaaaaaagcaagtgtgcaatctctgtgtgctctcttacccctgctgaggcaatggggaacaatctccatggtggaacttccatcaatcaagggtccctaagtgactatatggaacatagacactcataaacttgcaggcaacatgtagcatgagtgagaagtaaaccattgttgtgttaggccattggggttttgtggttgatttgtcagctaatccacagctgaaaagcatccctacagttataggacattatctttcttgtagggttgtatggaacagactttctagatttgattcctagctctgttatctattaacttgtacgtccttggtcaagttacttaacctttctgtgccttggtttcctcatctgtagaatgagattaataataccttttcctcatgaggtcagtgtgggtactaaggaaattaatatacaggaagcacttaaaacaaggcctggcaggtagcaagtgctatgcagcattttctgtcagagatcatgtatttcagagtgtcaaatacagtgtctggctctcaccaacaacttaatgctttattacctttattgctgtcataagggttagaatgatccatgtaaagtcttcacatatggtggccacttaacacaatggcactattatttgatgactgatttttgtgcttaattctggatatatgcccctcattttttagttctcttaatcattgccctctaagatttccttcacaacatgggaggtagttaagtgtatggatttccaagagtagttctgaatacgaagttaagaagatgttgaaatggcagcaaagccttaatttaacagggaaggcattcatcaaaagtgttgttatccataagtttgaaaccaaggcgacccacagagaagctacacttgtgaaaatgagccttggataatgagtatttcattatatttgccatttagagcccttacacactgtctgtccatgctcttcattttgcagatgagaaaacttaagcctagagaagggaaatgaatagtctaggataacacagtcagttaacagcataagcagaactagagcccaagtacactgattcttgatctgtatctacattttgcatctgtaaagctatacaatatttccttctagtacttgaataagaaagtcattggcttttcatctcaaaactctcaaaagcttagcagaaactcagagatgtggtttcggaggaaccagaggaattcaggtgagcagtgtaaggtagaaaaagtcaggtttggtcttgtaacatttgtgccatttgaaaactgttgtcagacaactgcaaccctagactcaatgtgaaaattaaagtaactttgcttttatgtgctgtccttttcagagctcatcatccattttgttggtgccattttgctcatgtctttgaatacatcaaaagtggcttgattttctctttcctttgctgtctattcactggctgcaagaatgtcctgtccattccagattttggatgggctgtccagaatcaccacagacttcgcttcttagccagctagaggaaggcagaaatgaaagagccctgccagcgtgtttcctttctgtaagtttccttggacacgaacacaggagcagagtttctatggagcagctggtctccccattttggattttgctgaggcaggtagttgaactctttgaggaagtctgggttttctctgtcttgggaaattactgataacatcagagccagaaggaggtgagtaaaatggaaaagaaaattcataagagtcgtgccaagattgagatttccaaccccacccaattcttccccagctctcctttcagctgctacttgcttcccaggaagcaacaaacaataggctactgattgaatttaggtctgaacttcatacaattaaaggtgaggcaagtaaaacatagttacatttagaatcaaagtctccgtgtttccatcaggaggcacagtctgtatgtatactttagaaagtgggtctggttctgaagccaaacttgaaagcccattcattttggtaattattttcttttttaaagcaagaataatctttattccttggaaactaatttataaaattgttatcaataagatgaaaagattcatggtaattattttcttgttcatagtttcttgctggcttttttttggaactaatcacttccaggaaagtgcagaggtcttacagtgaagagaaggaaaagcatattaattgtagctggactgggtctagatcatgagagctggaatatcctaagatctgggacaaagggacagccattgggcagctgtactttatggtaggcaacatagcacaaagattcagttgtttcttttttaccccctccaggacaatttaaatgtctactctggttagtttctgagagtaggtaccatgttacttaaaaaattctactcattgtaaatgaagttgtatcaacacataacaactgccacttggaaatcatctttgtctttccctgatgtccctttttcgtatccttctctctagtactcattccttcagtcagtgaatttatgctgcaacttgactacatgccaggcacaacaccggcaccattgatataatgttgactaagacagtgttccacttgcttattgctgtgtgataaaccaccctcaaaacttagttgcttaatgtaaaaaccattttactatagctcacaattcagaaattcaggcagggctcatcttggtgattcttttgatcaacacggattacccagtgacactcagctggtaaatgcgctggtatggtaacctcctctctgtatccccctctccagtttcacacacatgtctgtctggtgctttggcaaggatggcaggaaggctaggctcagctggccctgtcaaccagagaacctacacacggcctcaacagcatggtgacctcagggtggttggacttcttatgtgtcagctcagggccccaagggctagtgttccagcgatccaagtggaaaatgtacaaccttttatgactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctcctgctcagcattacatatcatactagaacaacaaccaactctgctggcaaacacacatgcacagggcacagtgcgtagtcctgtctctacacacagctgctggtttcattcggattggttaaaatctaattgtttgaatgaattcaggggttgctaagtgattagtacttatttaggctagttcagtcagaactggcaattggcattgttgttccatctgctgaggctgttccccctcttcttcctcttgctaatgctgctcattcttttgaattcagtatgaggagccccttcttcctggaaaaaaactttttgaccaccctcatcccaatttaatttagatgcgttcctcttgactcccaagcaccacccaaaaatgtactgttaatccagcagacatatctgcaacgggaatgtcaactattgaccaggttcttgctgagagagctacagatactggggtgattcagactgatacagtcgctccctacaccagtaaatctcccagtctggtggtgaaggcagatatcaaacgaatcgttaaaaatgtattgaatgttcctaataatgcctgactcagagtcacatgggtagtgatagggactgtgccatcttttctgttgttgtcatggtgcctggcatataataccatatcagtaaatgttttttatgtgcatgaatgaattttggtggtatatttattgaacatgtggataaagttatgtcagtagaatgtcatttatctttttattagagcccttctaagattttaccaggctgggccatgatgccttccattaagaaacagtggattggggtggagggagggagagcattaggaaaaatagctgatggatgcggggcttaatacctaggtgatgtgttgataaatgcagcaaaccaccatagcacacttttacgtgtgtaacaaacctgtacatcctgcacatgtaccctggaacttaaaaattaaaataaaaaataaacattggagacagggcctacatctggatccagtcgatcctttttgctgccagccaggttatgccagcctcctctcatcccttggtcagtctgatatctggggggctgcaaagtggtacctcacatatcaagttttgaccttcttctctgttaacctttgactttagctatcatgaccctatcgatagatgaacctgtttcctgctgcccatcatatcctatcctttggaataatttgtggcagtacttgactagggcttttctgacctagacctgtcctgagcagacacatgttgtcctctgccatgttctggggaacctaactggcagctaccttgatccttcctggttcacttgccttccaatattggcttttccctaatatgatttccagatcccaaggttgttggttagttttttgttttgttttgtttttgtttttgttttttttttaggcaaggtctctgttacccaggctggagtacagtggtgccatcacagctcactgcagcctcatctcctgggttcaagcaatcctcccacctcagccacccaagtaattgggactagaggcatgtactaccatgcctggataactttcttattttttgttaacacagaatctctatgttgctcaggctgttctcgaactcctgggctcaagcgatcctcctgccttggccactcaaagtgctgggattacagatatgagccaccgtgcccagtaatcccaagtttttagaacaacaacaaaaaagtatagtccttggaactagacataattgattttgaaaggatttctgtatttgctagctttatcattctgagcctaattttctcatctgcaaaaatggggataaaaatcgtgacatcacagggttattttaagtgtagtacctaccatgtaattgctgagaaagtggtagttccctcccatatcccatctcaatgtattgacttttgtattcaaagaagacattattgattactttctctccagtaccttatttactttagggtacttttcctagatggggatagtggcttgcttccagggctggccttgaccacaccgttatcagagcttctggactccaatgacatgactacctgactccctcacttggagaatctgggtcccatggcttctggcacaatgacttcactatggctgcagttctaccttttccctccaaccgtggctcagtgccaggatagaaggaaaatgcgaaagagtttgacaatatttcagagaggagacttttagcagaagttatagctttgctgtcctgggcagtgttatgaaggagctttcccacacattcctctggatcctaccttcatctgccacctttactcctggttctttcttctaagaggatacagtagtatatttgggtggcttgtgacatgacagtatctcttattttgacctcccatagcatttaagcatttattgtctgtaaatgtttaattatgtttttctctctgtgaatttcatgtatgattaaagtatgctagtcataaatcattcaagataacactaagctcttcaatggcaagggttatgaatgaatagcccagggcctgaacacaacctgagaactgctattttttttttttttttttttttgagacagagtctcgctctgtcgcccaggctggagtgcagtggtgcaatctcagctcactgcaggctccacctcccgggttcacgctgttctcctgcctcagcctcccgagtagctgggactacaggcgcccaccaccacgcccggctaattgtttgtattttttttagtagagacggggtttcaccgtgttggcaaggatagtctcgatctcctgacctcgtgatccacccgccttggcctcccaaagtgctgggattacaggcatgagctaccgcgcccggaccgagaactgctattttagggcataggatgaaaagagaagtcaatgaagaaaactgaggagaagtgagagaagcaggaggaaaaacagcaaaatggaatgttaaagaaccctgatgaggaaagtttaggagagacagacaacaggatgtaagcttcaggatattttggagggttttgggcacatttcatttacagggtcataagggtagtgaagttggaatccagcactgttctcatcagtgtcaaggagggcaggaccagctttctctttatgtaaaccctcaaactttaatgggcactagaatccacaatcctgggccttacctacagagatccggtttcaatatgtaggaccaggaactctgtattttaacaaacatcacaggtgatcatgatgctggtggttccaaaaaaaacatgggtctccggttaacaaagtagtccaaggttgtattggtagtttgacagccctatcatgtcttgtgatgaggtaaagtccctaagtcacaaagtcagaatgatagaagggcccttagagggatgatctaccaacgcaactcagtgggggcactgtattagttcgttctcacactgctataaagacatacctgagattgcgtgatttataaagaaatgtttaattggctcacggttctgcgggctgtacaggcttctgcttctagggaggcctcatgaaacttaccatcatggcagaaagcgaaggggaagcaagcacatcttcacatggccagcaggagttgggtgaggtgctacacatgtttaaacaaacagtgctaggaggatggtgctaacccattacaaactacccccatgatccaatcacctcccaccaggcccttcctgtaacactggggattacacttcaacatgagatttgggtgggggcacagagccaaaccatatcaggcactattggaattttaggtgggaccatgcttccttgcaggggactgtttgtcctgtgcaatgcaagatgtgtagtacactttgttcccaccaactagattccagtagcacccctcagtcattctgatgaccaaaaaaccccaaccccatatatttcctcattcctcctaagggggcagtaccatccccactgagaaccactgccagtataatcccttcattttatgtgggagggaaatgggtctcagagcaggggaggaattcttcaaagtccctcagtgagcatttttgaagtaatatactctcaagtctgttattcttcatcctgtatttctgtaactaagtttgggaacctaaatgcaggcttgcctccccagttggatggtcagctttactagaaaagatagagacagtcatcttactaggtccctgttgtctctgacagcatcaagtatcatgctggctacacacaggcacctcccagatactcactgaactgaattgaaccacaaaactctgtggagctccttgaagatgaacaagattcagaaccctcctaggcagtaagtcttctttcaggagggaccgaattgtttgtttagattgcactttgaagagaaacattaactcattagcatattcttggtacatcaagaacattcatctggaccctgagccccgctagagtgtacatgccaggagggcagggaatgttgcctttcttcattgtttatcttcagctcctagactggtgcctggtacatagggagacactcagtaaatatttatgtatgaagaaatggctccaccttacaataaaagattgtttactttcttcagacaagtataaaataagcaaatgttttcaaggattattatgtccttggtgaaaagtaaaaagtaaatatgagttaaaagaatatgagtaccttgtatttgcaaagaagatttctaaaattcaaaggcttttctcatctactaaggaaaaggtagagaaatgtgccctttttgaacctacagtgaccgatgctgatggctagactaatgtcctcagagagaggctgctggtgctggtgctcagcacaccatcccttcctctgacctgttcagcactgtcaagagtgacatggagagaccaccgatggcctgtgaggagattcacagatgggggagctgggcagccaagtgaaggcatcggctcacacagtcattggctgtcagaaagtaacagtaaaccaaacccaagaggatgaaatgtaacagggaaatgtgggtttcaaaccccaatgaaccacgcaagagtgatctgctttaatagcaccaggtaggaggaagccttcagggtttcaattgatagaaagaccagcagtacctaacaggttgatgttgctgctccaaaagactgagtgacctcaaaccaccttactgaaggctagtgcctagagtacaagaagcagtggtccatacctgcacacacctgttctgtttacttcttacttgtgttcctgtcatacaaggcacctagacaaatgagagtccattcagaaagttaccaggatgtggatgactttgtaacctggttgtatagagaacagtggaaataactggagataatttactttaatattatgagaggagtctggggaccattatagcaacttgcaaagatttgaagggttgacatgtagggcaaagaacagtctggttctgtaatctcctgagaacagaatcaacactaacggattgaaatgcctgcaagtcagattattggctcaacacaagggaaaaccttctaatgactatgctatccacgacttcggtgggctagttcatttggtagtgagttccttgtcactggaagagttcaagtagtgaactgaccacttacctggcagggaagccatagagggggtttaaacgtctgatgagattgaactttatgacttttaacatttcgttcaagcctgaacacaagcctgttcaagtttgggttttgcattttcaaggtgataagtgaatctgattcaatatatgtgaatattatctatattgaaatattcaatatagattcaatattatatagatatctgtaatatattatatataataatatattatatataatataatatatttaatattatatataatatatgttatatataatataatatatttgatatatataataatatattatatatcatatataatatataatatatgatatataatatatcatatattatatataataatatataatatatcatatatataataatatattattatatcatatattatatataataatatattatatataatataatatatttaatatattatatataatatatttaatatattatatataatatatttaatatatataataatatgttatatataatatatttaatatatataataatatgttatatataatatatttaatatattatatataatatatgatatataatatataattatatattatatatcatatatgatataatatattatatataattatatattttatatcatatatgatataatataatatatcatatatgatatataatatatatcatatataataatatataatatatatcatatataataatatataatataatatatgatataataatataatatatataatatatatactattataatatatataatatatataatatatatactattataatatatataatatatataatatatatattatatatattatatatatctgtcaccaaagtaaggtagagttatgatttgggacataagtgaccatcactctttaaatgcctatcattgtgtagattttagaaaatttcatcaaatctcttataagaacacatgcttaatgtgcactaagaaacctgattatcaaagcagtccctctaccaagaaaaccccctgcactccctagctcaccttctacccacccaggtattttcatttttatctgtgggtgtctagatcaggtttgctcaggactaattcacagcaaggtgagaagcaaactaatacaggtacctgtgatttggacagcactgctctcagggtcagggtcaagatcaagggccttactttgttctctggcctgtcttgtttgcttaggtcagggcagtcttgcttattttctggctgttgagcatcttgtgctgttccttcgacattttcactcttcacagttactaacttgtcttcttttgataggttcttttttttgttaaggtaagacctacatgataaaaatgcaaataaaacagaagtatattcagtggaatgtaaggcccgcctgtcctaactaatcctgtgttccttagttccctcctccagaggcagctgctatgattaccttctttcagatccttccatagtgagtctgtgcaaacataagcactatatagatatctgtgtggtcttaaagcctcccatctggctctgcccaccagtttgtgtgatcttttgctcatcttcagctcctacaatagctcatttatttggagccaaccctctctgctaacctgtcttggcttcactattttctactgctcacctgctctcatactgccactctgacttggtaagaccttaatctgggacagggagaagtagaaatcatcatttaggaagagtaaagcatttctagtttctatttccattccatattttctagccctgtgaaattaaattatgcctgttcatctgctactgactcactatattccacaagcaagcaatttgcatttttcttcacagcagcatctttttcctcaggatgctgtggcaactaatgttttaagattctaagaaaaagtcataataataaaacctttccatcctaggcatctaaaaattgaattgtgaccaaagcataaagaaatattattaaagaagctcaacagtttacaaacccagcaatgccatgttgaagattaaacctcgtaggttgggaattcatttagggcacatttgcattctgtgtttttagatgtggctacatgcacaagtcacctaacacatcaccacagaatacaatgtgtcaaagtatttagaatatgagagcatcacacagataagggagcagtttttatctgggaaggtgagaaaagggagtgagggagtaaattggcccatagaattttagagtttgaaggggcctcaaagatgagccagtagtgtaggctaagtacctttggctgcatcactaccaagtggttgtctagcctatggtttgagtacctccactgacagagtgctcgttatatctcaaggcagcttatttcatcaggctgccctattagaaagcttttctttaggccataccaaaatctattttctactgcttgttcctagattaaacttcttcgggctacacagccacaccaaattctttgcaagtatgaaagctctttatacatgtaaaagcagttttcaagtactcctgtctagagtaagcatttaaaattccttcagtggacatcaaatgacattgtttcccacccatccatcatctgtgtgggcacaaaaccttcacctatggagtaaaatgtgtcagttgcttctcttgtgtcttgtttttggcctaagtaagttcaatgagataaccacgaattaaaagaatcttggaaaggaatcaaatatggaagtatttgagaatgagataataaaggcaagtctggtcatacaatttcagaagcttatgcctttaatcagttaggctaatagtgaggccatgagcatagacatcagaaaactagggataaccctcaccatgatctgcagaatgaagatgttaggaaaccatagactctgtgataggaaagtcctttagcaatcagctaatgaaactccatcattttatagatagggagactgagatttgaagaggccaagagacatgcacaatgtcttacagctacattggcagagcaaacactaattaatccatgtcttttgatttccaattcagtgcttttctgtatgtgttttcttaacttgagacacaagcaacagccagatagtaaaggatatccttttatcaccttctctccagtcactgttaaccaattgtatttcactccaaaatatatttcaaaagttacagagttacgtaagaatgctcttaagattcttggaccgatctccaaagcatccctgccttattcaccaaaaacttagcagtttgtgtctttttgagttttgaattaatgtgagcatcagtgaggataagtccccattactgtgaggaatttgtacaatgagcgtctaataacatggataccacaagggagtattgataagacatttgggaataagaaaggaaatattggccaataatgcatattattgcgtgataaaaccctgatgtcatataatcatgttatggcaacatcattctaaacagaaactcaaaatcgctgaattcctccggacgtgtgtgcaatgtacatgggtcttcacgtgtacattggaaatgcacattaaagtggaaatggggagctgttgctgggattccaggatattggagacagacaaggtattcaccctgcaggcacttcgtggatatttttaatttgaaaaacaaggacaatcccaatgtctagatttcccatttgtgtagccccccaaaagatttcagtagcagacctcctatgagtctaggtccttctcaagccgagggttctcaggtagaaattatactgattgagatgagccgttggccttatttgagaatgacccaagtctggttttgtcagacttgggtcattctatttaaattcaggtatagaccctattttctagaccccattttctagagaatctgtgccaacaaaactttgaaaatttgaagacaaaattaacatttgagagaaaggattatagaaaacctgctaaatgccttcttaaaaatgggcccagtcctactttccaatcctataagatagcatgccatcacttatctatgccataatttatactgtattgattttattgtcacaactttgggaatactctgtcatgtgtatttatgatggcccataaatctttggaataacatttagagaccaagtcactatttggagtcaaggaaatagagggctgtgtagacagattagagcccattaatggacccagtgtgtagacctaagaaacctgcctaagataacttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtgaaataagaaagagagacccacatcccaggatccctggatcagagtggtgggtgacatgtaaagagaactgtgatttccccctacaggcttttccctggataagaaagtgttttctccactcaacaaaccctataatgggcctgttggcttcatgctccttcagtcctcctttccccacaactgggcctatgtgactctcagaatgaggccctgcaccttactccactctacctagcaaggctctgaggccctaccttgtagtcaagagagatctgaaggatccacagtcttaaaagcaggtcatggatgcagtatggctgcaagttgatcttggacttttcccctcagtcctaataaatagattgttgccaccttcctgggactggcacaccttgccttctcttccatatccaggagctcattatctgtctactacctactttctttaattattagagagcctggtccctaccttggctttgtacttggtgtctttttccactgaggactgaaattctgttgtccttttcagtcttcctggggtctgtgcttgtccactgccagaattctctgggatcactcatctgcctatccatggagatatttgtctaaggcttctgtccaagactccacaatgtctcatagcctactagccagcatagccttttgttgcttactgttgatcctcagtgaggctgctggcctgccttgcctggacctctgcctgctgcttattaccagaccctcttaaggtgtgcttcatctgctctgtggggacattgccctctaactcatgtctgggcctacacaacacagattattagtctctacttctcatctcttattggagaccctaacctcaaagccataatgggcctgcctagtctctatgttttagatttccccaggctggtctattctagtcccagccaagtttcagttataacttgtgaagactatatgggcagtccttgggccaggttgccctgcctgggccaggtttgtgggcccatcccttgagatgaaagctactgtgtctagtttctcagtcactatgcaccagttaatgaacaaccttgtaaaactttgcttttgatgaccttgtaggctaatttcaagttaatattctgagatggatgatgaaggagaatttttgtgtctttgtagcctacagtaggtagagggatgctgttgggaatttttgagccaccctgagaaaattaggtgaaggtgagaaatgcctgtgtgatcattttggaagctaagttgcatatgaatctaaggtggcattgttagtagtagtagtacttagtctagtagtattcagctccttgccaaggtgcttctggcttaatgaaatgacccagagcttcagctccatagcagggtcacgtgtattggctagctacatgtccttgtgttgaggacttacactttttgaacctcaattttcttacatgtcaagtgaggttttgtggatgatatctttataagctttcagacaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgaggaagtttgaaggagaggaatttcctgagtggagaggaatttcctgacctagagtacaggggctactggcttctttttgtttggtgcctgctgttgcttgtctggtagcttagactcaagttattctggaagcagttaaagggtagaagaagagcagacctaatgtgtgggactattcttataaggtatgacaggatttagggaccaggcaaagggtgcaaagccagtatcagctagtccaaggtaaacccagttcaaaggagaagagtaaatgacctaagtgagcagcaaaggcagaccatatttggacactaataatggtgaattttatgtgtcaacttgactagcttatggtgcccagttgtttggtcaaatactagtctagatattgctgtttagggatttttttagatgagattaacatttaaatcagcaaactttgagtaaagcattaccctccataatgtgggtgggcctcatccaattcattgaaagctttgagattaaaaaaaaaaaatgtggtttcccaaagaagaaaacatttggcctcaaaaccgtaacatggaaaccctgcctgagtttctaggctgcttgaccagccatgcaaattttggattccagactgtaacatcacttcttacccgggtttctagcctgtctgcatgtgcagacttaccatctcccacaatcatctgaactagttccttaaaatctctaacacctgaaaggaacaggactccacaaagaccaacctctctgacagtcctgctgaaatagtaaaacgatcaagcatagagtttttgtgctaaacattccaggggtgcttatttattgaggaacagtgtttctaatcttcaagaaattttattccctgagaaatttccccatttattttaatttgcttgtgcagtcttttaagtgggttatattactttgtacatggatcgctttgctgtgcttttatatgaaaatcattattagtagtcaacataagatacaaagtgtactgcttctataaagcttatcttacagcatatatatagcctgctgaaaatatattgctcatttgttattaaaaatcctacccaagtaaaaaaaaaaaaaaatctctctctctccctctctctctctctccatacgcagacacacacacacacccccatgcacgcacgcgtgcatgcactatggttggaatgttgtttgtccccttcaaaattcatgttgaaatttgattgccattgtgacaatatttaggaagtggggcctttgagaggtgattggatcgacagggctctgccctcatgagtggattaatgctgttgagtaggagtgagtatgttataaaagggcaagtttggcccccttttgctctctccctctcagctcttttgctcttctgccatgtgaggaatagtgtttctccctctggaggatgtagcattcaagaagccgtcttggaagtggagacagctttgactcgatgccaaatcagctggtaccatgatcatggacttccagcttccagaactgtggaaaacatatttctgttgtttataaattacccagtctgtggtattctgtcagaacagcacaaaatgaactaagacaatgtgtttgtgtgtgtttatgtgtgtgcatgcacatgtatgagcgtgtgcatgtgtgtgagtgtgtgtgtgtatctcctatttgttctctctggataaccatgactgaaacagatatcatgaagatagcaatgcggctttgagcagagacagttgcaggattatggagagccttgagtgagctgtcattatgagttcttttaccccaatagtcataaaatattgagtaatatttgagtaataataattaattattactatgtctactaagtgagcatatattgtgccatagaggttggttggcatgatttctattgactcagatttctgagatgctaatccagagcctgagtggaagtctctcatcttcctgtcagagaagctttactctcctgaagagagcaccaaaagctgggtatcctccatcagggaatggggatcagactagaaaaggcctccagctctgtcaggttaatactgggatcaagaaggactttttatattaatggagtcaatgccattgaaagttagcattcatttagtccacttcttcattgtatacatagggagagtgaacctgagagaagagaagccacctttataggccacacagcaagttggtggcacagccaggcctcacactcacatctcctgacaataagtaaggtagagaagaaaggagaaggaaagagataaaggttgtttgctagaagagaagtctggattccggttgtgctttttctatgagccatttggtgagtaattgtcccaaagtttggaagtgtcccagttttcacaactggatagaatggagggaaaatagaaaagtttgaaaagtaaagtgaaataacatagacaacatatttataagggcccctaactgctaaattacaaaattgaaaatgatctatatagttttcattgatgagtaaatctgctttctggtggacttctctagtggcaacaaggctactgcactcagtctcaccaccttgaccaaaggccaagtttgcccttgttaaaataaaggtacactgtgcttgctgtggggccaggcttccttatttctctcctatatttgttcaggaatttggttctgtcccatgaggatactaaattgcattgatcaatgaaaatggcatctgtgcttgtttgttttaacttgactttgatagcttcatccattaaactttcaatgaagttgtaatttctttaaaaaaaaaaaccctaaatttaaaaacatgctggcagttcataattaccttggtatatatcaagatgaatcagtgaaggtgactctctttcctttgcatttagtattgttgctttgtgcctgtattttctatttaggatttattagtgtaaatcccccttatacatcattgaaagcattaggatttatgtagtgttaaatccatatcaggatttatatggaattaaatccaatctaagagacaggtggataacctagtggggttttgtacccataatttctaccgctctttgtggaaaagcatttcattacaaactttcagatttgggaaggcagtgttctgcaaatggcacctattagtaccaatgtggagcgttttactgcactttccatgtagtccctgggctcctcactgagaagcatcctcatggcaaagcatctttcatggccacgaggaggacattaacctcttctctgctccttccctgtttggagcacagcacagctttgattaactctttaaagagccttctgtttacaccctctcacagatctgcagacagtatttgcaaagcacattgcaatttttgacagcaggcaccactggggtggggaagatacttgtcagctttttcctttggtgactttccttccatttttttttatcttttgagggaatgaaaactgctccaagttggtgcttgctattctccttttttatttcttttctcttctttgtatatgcttttccccatcccatataccaactgatggggtgattgagtgactttcatccattcagtcaagtatttactgagtcctacttcatgcaaagtactgtacaatgtactgagtttttagagttatttctttctggggttgttgtccctttttaaattataaaaataatacatacttatggtaaaaatgcacagtacaaaagcatataaaatgaaaagaagatcctcttccacatcaagctcctagtttcactcctttgtataacatcaataacaatttcttacatatccctataaaaattttctatatgtatataagtgtgtatgtaatgtatacattcatacatatatgtacatataggtaacatacacacatttacttatatatgctttcttagaaaactcagactggagcatggtaaacacaagttttgtacatccacttccatgttgtatcaggccatttgctttgctataaagaaatacctgaggctgggtaatttacaaagaaaagaggtttaattggctcatggctctacaggttgtacaggaagtttgctgctggcatctgcttctggtgaagccctcagaaagcttacaatcatgtggaaaacgaaggtggagcaggcacatcatatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctggaatcgtgggggcattcccaataataaatgtctagatggtgtgtttattccagttccaatccaatccaattcaatgaatatttgttgaatgcctgctgtgaagaagataaagaatgaataagacatggctctcactctccaggagttcacactgtaatgagaaattgacatgtgcactgttaattctcatacaaagaaggcaataataaaggtctatacagaagtttaaacaaggtgttaaggggatattggaggagtaaaaaattatgtcgaattagagtatctggaaggaatgctgtttgaaagaaggtggttttgagctttgtcttaaaggggtgatgagattattataggaagacattgaggtgaaaggtagtttagtttgaagaaccacacactctgcaggtgtgcagtcccagggaacgcatggcaattagtctggtaaggtggagagcagcatggcatacagctggagcggtaagtccgacccagtttatgaagagccttgaatactagactaagagtttggacttgctctgtaggttaaggggactcttgaatacctacccctcaaaatcacaaaggagtctgtttcctgtcatcatagcacttggttcttctcggtagccccttttacagacaaattccttctagttacatttgtactcatttggtgaagattctctatgggaaatacttgactttaaaaaacttgacacatagtttgatgtaaacgactctgatatatcaataatgtattttattcatttatctcccaattgtgtatgtaactacatatactttgtataatcattgactatgattacagtctgtgttgatataacctaagagtggttatgcatgatctgggtggtattgcatctggaatttatcctactctgtaacatgttccattgagcttacaccaaaccagtctagctatgccatcagatttctctttaccagctctatttatggtctttctctgacattactataagaatgtcaggttaaattatatcagatgcttctctctccaagatatgttaactttgctccatcctctttcaccattcagcttgtcattctatcatgaacaggaattagcttcgtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggactttttttttttttaaagaaaaatggaacacagcagtttcatgactcacaacaactcttccataataaccaatgtgataaaaacattttttcagggaaacaaatttcagttttagccttccaaatgactattacgaaaattaacaactaataaaaaattgaaatactaaaagacatcatgtatcctctcaaactatttatttattgtactcatacatattcttaagtgcaataaaatctgcctagaaatcattaatccactagtatatagtccttacttggtgctggcaactgaaaatttggtctttttatatacaaattgttacacgcatgaaaagtagtccaataatggcactttttataggttatttcataagtactcttggttggacatatgctaaagtattgttacaggttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttc

SEQ ID NO: 1426 - DNA, 127994 bp, Homo sapiens
tggaaagtaaaaagctgtttaatagtattgaaaagtgcttctgttgcaatcttaaatgaggtccacagcaagcatacattactttttttgtttttttaagtgtctgttatggaaggagagtatagaaatgtgttactctctgtaaggcaatttctgtaatatacaaattatgcctaactacctctattggctatgcttagaaaaggattgtggcagaccaattctccctgacaatcacacagacaggcctgcatgacagtcacacaggcaggcctgcatagcacctcagttacacagacaaatttctacagagtggccttaacattgagcaaatagtttaaccgagggaaatcgatgcccagacatcaaagctagaaataaaacatatggtcaaggccgggggcggtggctcacgcctataatcccagcgctttgggaggccaaggagggcagatcacctgaggccaggagttcgaaaccagcctgaccaatatggagaaactctaactctactagaaatacaaaattagccgggcgtggtggcgcatgcctgtaatcccagctactcgggaggctgaggcaggagaatcgcttgagtccgggaggcggatgttgcagtgagcggagatcgcgccattgcactccagcctgggcaacaacagcgaaactccgtctcaaaaaacaaaagaaaagaaagaaacatatggtcagtaggaaccttgcatgggcttctctggaacaagccaaaagaatggagacagtcttacattcctagtgccaggacccatcttgggtcaatgaaatctgagacgagtcaaggtaacagaggcagctgcattggagagtccaaggcagctctccggaccaagctgtaaaggagataagatagaaataatcattccggtaccacagtagacaggctttgaaggtactggggcccttttaattggacttagcaagcattttttttgcctctgacattctagttgaagcaaatttagttaccaatagacataggcgaatgctatattgcagtaggcacataaccccaacctatataagcactaagaaaattgtaacactttgagttggtctggtggaattatctccagcgttcttcctgtatccagttacagcaataaattcctgtgtttcctagtttgcctgcttttccgtactaggcctctagaaaatgcagcgggccgggcttcgttcctggaacaggagtaactcccaaacaagtattagtgtaggactgaaaataaatgcagactatcttgagagtctcaaaggaaaatagggtggctagagaggcctttctctaagtcttgaacttctagcattttattctctctcttaagcttggagacttcacacttatcctttcaggtagaaaatctgatactatgggaaagtactggatatagaatgttgagcagaactgcacagattgcatataatgaaagcagaactccatagacaaagtcaggtgtcaattaaatttctgaaataacaatattcctgatgagggtgagtggttttaggtctcagtttgattcacatggaaaacaaaagcggaagttgagtagtaaggcaaggttgcccccaaactggacaaaacataaggcagccatgtttgccggagttttttcagacacgaggggcgggagaagagggatctagacacggcttcttggcgtttctggagcactactgccatcgtgaggatgaagtttcatgaaaccctacgccattacactgttctcgaattctggagaacagtatttttctctctgttggggaaattctgatctgtgggaaggaggaagaggcgtggggctccaagctaggtcttcttgccttctcctctaagaccttaagatagacctggacattggcggtatcttggtgtagaacctggagagtgaggacttagaatgaaccagcccctgccgggcggtcctggcacagaaagtcgtggggcggggcctcggttcctcctctgggcaggactgcaggaacccgctcaaagacaaatgcaggctcttgtgggcatctgtctcctgttcctgccccttggagcaaaagtcagtaggttttcacatggtattatcttactacgggtctttggctctcttgtggcatcagtatccgcgcacaataaacaacgttcttccaggggaggtttacaggatttgctcttagaaccttcactctccaggttctataccaaggtaccgccaatgtccaggtctcttttaaagcctcaaacgagactaagcaaggactcccagcatggaggcgaaccctcttccaccttttaccagaccacacctgccccaacaggtagtcctcactagaactctttaatggcgtagggtttcgttaaacgatatcctcacgatggcagtagagctccagatatgccaataaacctcaccttggaggactctactcccgctcttcttgtgtgaaaaaacgccacccatagacaaaggcgccaccaaacatgggtgccttgtattttgccttctttgggtccacctggtcttactgctgcacttttgcttttgttttgtttttgcttttgtttttgtttttcttttgagacggagtctcgctctgtcgcccagggtggagtgcagtggcacgatctcagctcactgcaacctctgcctcccgggttcaagcaatcctcctgcctcagcctcccaagtaactgtgattacaggcaccgcacccaagtcgagctaatttttgtatttgtagtagagacgaggtttcaccatgttagccaggttgatcacgaactcctgacctcaggtgatccgcctgcctcggcctcccaaagtgctgtgattacagacgtgagccaccccacctggccttgcttttgtcttccgtttgaaatcaaaccaaactctaaaccatgcaccctcgtcaagaatcttattatttcagaaattaaatgtcttcttgatctagtctatatgggtatgatttacgttacagaattatatgtccagtactttccaaggcatcaaactgtctccttcaggggataaattcaatggatgagggcacaaaaaggagaaagttgctagaagcttagagattttcgctggcaaacaatttacaaatcctggtggtctctgttctggctcccctcccagacaaccagggagttcttcatgttgtagctcatgtgttgcattgtaggcaacaatgtggcatgcatgaatcatagagaagggaccagatagctgtcattactgcatgtcaaatatgttccgcatggcaagatactcatagtacatatgttcaattcctgtccaggttactcagtgtttcatctcggggtctcatcatctaacatcaaaacacagcatgttcccatgccattacatattcttcaggtatttcctgagactttatggtgtgtgtgtgtgtatgtgtgtgtgtgtgtctgtctgcattttataatttgtcttttaggtataatgtttacagtattctcccactaattaattaaaaaataatggctgccaaagattcggaaaaatccacatactactaaagaagaaaaacactaccatacaacgtgtcaaggcaactaaccttttggatcatttctgtgtatatctttcaatatatatatacattcttgatttcatgtaaaaaataaatctgtattaaaactggattataggctgggcacggtggctcacacctgtaatcccagcactttgggaggccaaggtgggcggatcacctgaggtcaggagttcgtgatcaacccggccaacacagtgaaacttcatctctactaaaaatacaaaacttagcgggcacctgtaatcccagctactcaggaggctggggcaggacaatcacttgaacctgggaggcagagggtgcagtgagccaagatcatgccactgcactccagcctgggcgacagagggaaactttgtctcaaaaacaaaacaaaacaaaacaaaaaaactggattacattgtacattgtggattgaatcagaccaagtatgtatgttaacaaaggtttgaggagcatgaattaatttgaatgtcatcaatattatatgtcaacattttaagccttcattataaacaaaggtaaatcttaaactatgccctcgaaaacattgctttagaaaagtagacactattttttgtttgaatttttacagatacatcacaatgtgcatattggctctctagaacacatacatgattatatatttggtttaaggttatcacattttagaagtagagtaaaatatactttactttgtcatttaccgtgtggaagggtttaatcctcaaggttcaataatttacttttctcactaaatcagacacagggaatggctgcttatgaggacatagaatgcaattaagattttgtgaggactaaagggattacctggtgcagatgaatgacatgtatccaacctaaatgggaatgataggctcattgcccctccacactatcctcccttgcagaagaaaccaatcaacctcctgtcactaccactgggattcagctaggtgtgatttccttaccaggcttctatccactgcctaggcacacagcctctattaaagatagttagcaaggaatgaataaacaattctttagcctaaggaattctaggtctgagaccagcaacttttctagctttgttacactaagtagctagtcaggtataagcagagcaggtgaggctctccccacccaccaggaatgtcaggcgaccatcaggtgatagtcaagcagttgtcacactgcctctctaaaataataactgggtgcaccctgcaccaagaagcagtttcccaatagataaaaacacctgaaattggtaatcagcagcttccagtaagatctcaggaattggtcaagtgggcttcacattaagaggcaaaatggtggaatttaactggtatatggccttccagggatattgcacggtaaagggaagaatgcctcacctgagcacgtgtacagcttcagtaaatacactgcgcatgcaggcagcctgccgcaatggaagaatcaaaagaaaagggacacaagatgccggaagtaggccaccatataaaatcctaggtccaaggtcaaacggagcacttgaccaagatgtctgcttggccctcttccaagtgtactttactttcttttcatttctgctctaaagcttttgaataaacatcactcctgctctaaaactttccttggtctcttcttctgccttatgcccctcagtcggattctttcttctcagaaggcaggaatcgaggttgctccagacctgtttggattcaacgctggtagcacagataacttcaaccgctaatatatttatacaaacacaacccaaagaaagccaaacaccatttcatagttgacagtgtttactgtatgattgttataccaaataggccaaatatatcatgtttggacttcagaggacttaatatctaaactagtaattatgtcagaaaaaaatataatttataatttaattttggaagctttgtcaaatatcaatggtttaaaacacttgatattataaaatcaaatcccaggtcaccatgagtcatttaattagccaaaacaataactcaaaatgttttaaaacggaaaaaacctttactcattaagagggagacttagctctccaaacaatctgtctttttttctttcccttcttcttcctacagtttattcaaaaggcaaacaaaaatctttcatcatttcttaatatcacatgaaaatcttgttcaagagagaaagccaaatttcaccattgtattagtgcactattgatgtcaaacccaaatcttaatgaaaccttatggacaaatctatccaattttaatgtctgaccataaggtaagattcttataaatcttttataattctttgccaatttttgttaaagagcaaattagtgctgtaagaaaactctgttgtactttttttttttttttttgagacggagtcttgctctgtcgcccaggctggagtgtaatggtgctatctcggctcactgcaacctccactttccaggttcaagcaattctcctgcctcagcctcctgagtagctgggattacaggcgcccgccaccacacccagctaatttttgtatttttaatagagatggggtttcaccatgttggtcaggctggtctcgaacccctgacctcgtgatccacctgcctcagcctcccaaagtgctaggattacaggtgtgagccaccatgcccagccaactctgttgtacttttattccaatgttcaatttatggaaaaattaaatagtacccctttaactttagctaatatgttcacacacagaatttcatttacaattaatttgtcacaagccttccataagtgttcaaaccttcagatttttctacctaacttaaaacattattattttagagaggcagtgtgacaactgtttgactaccgcctgatggtcagctgacattcccagtgggtcggcaagagccctctcctgccctgctcatatctgactagcgacctactataactgcttcagatatgggacactgtctcatatgtagggctgctctcttccacaaaaatggtcagaccaagctatttctccaggaggtagtttagcagtccccagcctttttagcatcagggatcggttttgtggaagataaattttgcacagtccaaggttggggatggtttcagttagattcaagctcactacattaatcatgcactttatttctattgttattacactgtaatatataatgaaataattatacaactcaccataatgtagaatcagtaggcaccctgagccttgttttcctgcaactagatgatcccatctgggggtcatgagagacagtgacagatcatcaggcattagattttcataaggatagcccaacctagatccttgcatgaacagttcacaataggattcatgctcctatgagactctaatgttgccaatgctgacaagaggtggaactcaggcggtaatgcaaacgatggggagtggctttaaatatcagtgaaactttgcctgctccacgctcacctcctgctatgcagcccagttcctaagagaccacagaacagtacaggtccgtggcccaggaactggagacccttgatctagcagatatctaagtctacgttaggtgaaacagcgtggggagtctagatgtcattttgtcatttccaggaatgggggtcattgagaaatgcttcccagagggtcgttaagacacttctatttttgttttgttttgttttgttttgagacagggtttcactttgtctcccaggaagaagtgcactgttgcccactgcaaccttgacctgcagggctcaagcaatccccccagcttagcctcctaagtagctgggattatgggcaggcactaccgtgcccagctaattttgtggggatttttatacagacagagcttcaccatgttacccaagctggtctcaaactcctgagctcaagcaatccacctgcctcagcctcccaaactgctaggattgcaggcatgagccaccgggcctggccgaatctttaaaacattcctgaatgccaatagcatctatgtctacagaccatcaatcaactctaaccagcttgagggagagctaggtacagtcaaggatgtcacaaaagccaggtcccttaccctggaatgcctgcctgaatcttcagaggccaggagaagtcctacctgaagaagatcttgaagcactggaaggtcacactacagtaccagactaatattacatccttttttaaaagattcagatactgagataacaaacaatgaaaaagaatgtcatggggaacaagtcacccatacaattttagccacccttgttgatttttcaattatgagtcatggagtatctggaggtctccacacctaagggtggatatcttcatgaagaactagctttgaagctggtacacagaacgctcgctagaatgagataaatactggtttcctcaggactaaaaaatgccatcattctcagggaatgtccaacggaaaagagccacctatctgccctccttgagagaactgagattaccatcagtgtcctagtatgagaaaagacattcccatgaacttataaagtcacagataatcctggcttgtgggcttagataattgcttaggctttccattacattcttgcttcctggaagcagctagctcagtcctggtccctcactcaccagatacttcactaagactttgcatttgtccattgattgtgccaggcctcagagaaaagggtaggaatgccaacttgtgtcttgggcctgttcagcctccactggcttttccttccgcgacggctagggtttacgtggaggaaatgctcacggcttcggatgctatgaaactacttccgcatgatggcagtattgtcccagaaaagccaagtagcgctaggcgctcctctcccgcccatcacgtttgaaaaaaatgccatgaagggacaaagacaacagaaactaaaactatctaacatttttgctcaacttgcataaatgtattccactcttggcattttgcttttggcttccattgttttttttgtttttgttttttcttttcacagacggagtttcgcacttgttgcccaggctgaagtgcagtggctcagtcttggctcacggaaacttccgccgcccgggttcaagtaactctcctgcctcagcctcccaagtagctgggattacagggacgcaccaccacgcccggctagtttttgtatttttagtagagacgggtttcaccatgttgaccaggatggtcgtgaactcctgacctcaggtgatccacccacttcggcctcccaaagttctgggattacaggtgtgagccaccgcgtctggccccatcggatattaaactgagatctaatccactcaccctcatcaagcatctcctgttttcaagaactcagtattggccagccaggattgctccagtgcactccagcctgggtgacagaataagagtcgggctcaaaaaaaagaaaagaaaaagaaagaaaaaaagaaaagaaaagaaaaagaactcagtatccgcacaaccaagtctttccctttctgctttttcactcagcatcatatctgaagggttttattgtgatatcgaattgtcttgtaatattagggacagacctcagggatccatgcctacggaaacaaacaaacaaaaaagcaacaacaaatgtttacccctaaggtcttggagaatagcaaagctaagcaccaggccatgtggttcttgtcctgaccctctgtcaggcctctgagcccaagctaagccatcatatcccctgtgacctgcacgtacacatccagatggccggttcctgccttaactgatgacattccaccacaaaagaagtgaaaatggcctgttcctgccttaactgatgacattgtcttgtgaaattccttttcttggctcatcctggctcaaaaagctcccctactgagcaccttggagcaccttgtgaccccgactctgcccgccagagaacaactcccctttgactataattttcctttatctacccaaatcctataaaacagccccacctttatctcccttccctgactctcttttcagactcagcccgcctgcgcccaggtgaaataaacagccatgttgctcacacaaagcctgtttagtggtctcttcacacggacgtgcatgaaattttgtgccatgactcggatcaggggacctcccttgggatatcaatcccttgtcctcctgctctttgctccatgaaaaagatccacttacaacctcaggtcctcagaccaactagcccaaggaacatctcaccaattttaaatcgggtaagcggcctctttttactcacttctccaacctccctcactatccctcaacctctttctcctttcaatcttggtgccacactttaatctctcccttctcttaatttcaattcctttcattttctggtagagacaaaggagacacgttttatccatggacccaaaactccagcgccggtcatggactagggaaggcagccttccattagtgtttaatcattgcagggacacctctctgattattcacccaggtttcagaggtgtcagaccactcaaggacacctgccttggtctttcacccttagcggcaagtcccgcttttctaggggaggggcaagtaccccaaccccttctctccgtgtctctaccccttctccgcctttctgggtggcaagaaacctccaaccccttctccttcactcttagcagcaagtcccacttttctgggggaggggcaagtaccccaaccttgtatctctgtgccccgatcccttctttccatgctccgacctcttatatctctgcaccccgatcccttatttctgcaccccaacctcttatatctctgtgccctgatcccttatttccatgccccgacctcatatctctgcgcctcaacccctttcccgcttttctggaggttaagaacccccgaaccacttccctacgtgtctctactctcccttttctttaaacttgcctccttcactataggcaaccttccaccctccattcctccttcttctcccttagcctgtgttcttaagaacataaaacctcttcaactcttgcctgacctaaaacctaaatgccttattttcttccacaatgccgcttgaccccaatacaaactcgacagtggttctaaatggccagaaaacggcactttcgatttctccatcctacaagatctaaataattcttgccgtaaaataggcaaacggtctgaggtgcctgacgtccaggcattcttttacacatcggtcccttcctagtctctgttcccagtgtaactagtcccaaatcttccttctttccctcccacctgttccctcagtcccaaccccaagcgtcactgagtctttctaatcttccttttctacagacccatctgacctctcccctcctcgccaggccgagctaggtcccaattcttcctctgcctccgctcttccaccctataatccttctaccacctcccctcctcacacccggtccagcttacagtttagttccgcgactagttcttccccacctgcccaacaatttcctcttaaaaaggtggctgaagctaaaagcatagtcaaagttaatgctcctttttctttatccaacctctcccaaatcagttagcgtttaggctctttcatcaaatctgaaaaacccagcccagttcatggctcgttcggcagcaaccctgagacgctttacagccctagaccctaaaaggtcaaaaggccatcttattctcaatatacgttttattacccaatccactcctgacattaaataaaactccaaaaattaaattccggccctcaaaccccacaacaggagttaattaacctcaccttcaaggtgtacaataatacaatagaggcagccaagtagcgacgtatttctgagttgcaattccttgcctccactgtgagacaaaccccagccacatctccagcacacaagaactccaaatgcccgaaccgcagctgccaggggttcctccagaacctcctcccccaggagcttgctacaagtgccggaaatctggccactgggccaaggaatgcccacagcccgggattcctcctaagccgcatcccatctgtgtgggaccccactgaaaattggactgttcaactcacttggcaaccactcccagagcccctggaactctggcccaaggctctgtgactgactccttcccagatcttctccacttagcagctgaagactgacactgcccaatcgcctcggaagcctacaggaccatcacagacgctctaggtaactctcacagtggagggtaagtctgtccccttcttaatcaatatggaggctacccactccacattatcttcttttcaagggcctgtttcccttacctccataattgttgtgggtattgatggccaggcttctaaacctcttaaaactccccaactctggtgccaacttaaacaatactcttttaagcactcctttttagttatccccacctgcccagttcccttattaggccgagacactttaactaaattatctgcttccctgactattcctaggctacagccacacctcattgctgccttttcccccagttcaaagcctccttcacatcctccccttgtatctccccaccttaacccacaagtataagacacctctactccctccttagcaaccgatcacgcaccccttaccatcccattaaaacctaatcacccttaccctgctcatcgccaatatcccatcccacagcacgttttaaaaggattaaagcctgttatcactcgcctgctacagcatgggcttctaaaacctataaactctccttacaattcccccattttacctgtccaaaaaccggacaagtcttacaggttagttcaggatctgcgccttatcaaccaaattgttttgcctatccaccccgtggtgccaaatccatatactctcctatcctcagtacctccctctacaacccattattctgttctagatctcaaacatgctttctttactgttcccctgcacccctcgtcccagcctctctttgccttcacttagactgaccctgacacccattaggctcagcaaattacctgggctgtactgctgcaaggcttcacagacagcccccattacttcagtcaagcccaaatttcatcctcatctgttacctatctcagcataattctcatgaaaacacacctgctctccctgctgatcgtatccgattaatctcccaaacctcgatcccttacaaaacaacaattcctttccttcctaggcttggttagtgcggtcagaattcttacacaagagccaggaccgcaccctgtagcctttctgtccaaacaacttgaccttactgttttagcctagccctcatgtctgcgtgctgcggctgccgctgctttaatacttttagaggccctaaaaatcacaagctatgctcaactcactctctacatttctcataacttccaaaatctattttcttcctctatctgacgcatatactttctgctccccggctccttcagctgtactcactctttgttaggtcccacaattaccattgttcctggcccggacttcaatccggcctcccacattattcctgataccacacctgacccccatgactgtatctctctgatccacctgacattcaccccatttccccatatttccttctttcctgttcctcaccctgatcacgcttgatttactgatggcagttccaccaggcctaatcaccacacaccagcaaaggcaggctatgctatagtacaagccactagcccgcctcctagaacctctcattttctttccatcgtggaaatctatcctcaaggaaataacttctcagtgttccatctgctattctactactcctcagggattattcaggccccctgccttccctacacatcaagctccaggatttgcccctgcccaggactggcaaattagctttactcaatatgcccgaggcaggaaactaaaatacctcttagtctaagtagacactttcactgaataagtaaaggcctttcctacagggtctgagaaggccaccgtagtcatttcttcccttctgtcagacataattcctcagtttggccttcccacctctatacagtccgatagcagaccggcctttattaatcaaatcagccaagcattttttcaggctcttagtattcagtgaaacctttatatcccttacagtcctcagtcttcaggaaaagtagaacagactaatgatcttttaaaaacacacctcaccaagctcagccaccaacttaaaaaggactggacaatacttttaccactttcccttctcagaagtcagacctgtcctcagaatgctacaaggtacagcccatttgagctcctgtatagacactcctttttattaggccccagtctcatccagacaccagaccaacttagactgtgcccccaaaaaacttgtcatccctactatcttctgtctagtcatactcctattcaccgttctcaactactcatacatgccctgatcttgtttacactgctgtttctccaagccatcgcagctgatatctcctggtgctatccccaaactgccactctaaactcttgaagtaaataaataatctttgctggcaggactatgctgaatctccttaggcactctctaatcagatgtcctgggtcctcccaattcttagaccttttatacctgtttttctccttctcttattccatttagtttttcaattcatacaaaaccgtatccaggccatcaccaataattctacacgacaaatgtttcttctaacaaccccacaatatcaccccttaccacaaaatcttccttcagcttaatctctcccactctaggttcccacgccgcccctaatcccgctcaaaggagccctgagaaacattgcccattgtctctccataccatcccccaaaattttcgctgtcccaagactttaccactatttcattttatttttcttattaatataagaagacaggaatgtcaggcctctgagcccaaactaagccatcatatcccctgtgacctgcacgtacacacacagatggccagttcctgccttaactgatgacattccaccacaaaagaagtgaaaatggcctgttcctgccttaactgatgacattgtcttgtgaaattccttttcctggctcatcctggctcaaaaagcttccctactgagcaccttatgatccccactctgcccgccagagaacaactcccctttgactataattttcctttatctacccaaatcctataaaacggccccacccttgtctcccttccctgactattttcggactcagcccgcctgcacccaggtgaaataaacagccatgttgctcacacaaagcctgtttggtggtctcttcacacggacgtgcatgaaactctctacccaggttccctgggagttctactctatgttctgacctagacattaggtcttacgtgttgaggggaaggccgctattgctaattagtggagctctaagataagggtccacataactcttaaacttgacagacacaacccttcttgaatgtacacaaatacaggaatgactataaatgctaatcagatggatcgcaggattttgtctcatggtttcattatttaatattggtacagaaatattttccagtgtcatgaaatggcaatggcttaagaccgtgtcctatgactttgctgtgtatgtgtcttattgtttttccgttaggattcaatcctatattttctcattagtagaaaagacgtggaatttgcaaagaagtaaaaagaaactatgtgctgatcaaaagaaaagcaatgtcataaaactgtgtattaaatactgataactttttccatattttgtcccactttcaatacatagataaaagttctacatatatgtatgcaaacactacaataaatttacatttaaattggatttagctatacgtcatgttttagagtgaacattttcacatgtgattcttgaacagtttttgacattgttataaaaaaatttgcaatatctggattttaaacaataaaatatttgcaaagaattacttgattgaacaagtcgttaagaagttcttggccaagtacagtgactcacacctgtaatcctagcactttgggaggccgagatgggcggattgcctgagctcaggagttcaagaccagcctgggcaacatggtgagacgccgtctctactaaaatacaaaaaaaaacccagccaggagtggtgcgggcgcctgtaatcccagctacgcgggaggctgaggcacaagaattgctttaacccaggaggcagaggttgcggtgagccaggactgtgccactgcactccagcctgtgcaacaaaatgaaaatctaaaaatctacctatacatacatgaacacatatataaatacatattacatataatataaatatatattatacatacttatacctcagaattagcttttaattcttctcaaatttttatccctaattcttatcttaaattttatctttaaaatctcaaaagaaatataacaaaattccataaatgatagttgagataggcatctctcacattcagtcacctagatgtgtaacctaagaaaactttaagatggaagtattcacaccactcacatgcagctacaatgtttcattaatgtgtgtcttaatataaatatgaatgatataaatttgttggccaatactatcatattcaaacatgtactcactataacactgaccatgatttaaaatatatggcattaggccaggcatgatggctcacaactgtaatcccagcactttgggaggccgaggtgggcagatcacatgaggtcaagagttcaagaccagcctggccaacgtggtgaaaccctgtctttactaaaaattcaaaaattagctgggcgtggtggcaggtgcctgtagtcccagctacttgggaggctgaggcaggagaatcgcttgatcctgggaggtggaggttgcagtgagccgagatagcaacactgcactccagcctgggcaacagagtgagactgtctcaaaaaaaataataaaaaatgaaataaaaatatatggcattggccaggtgcggtggctcacaactgtaatcccagcagtttgggagactgaggcaggtggatcacttgagcccaagagttcgagaccagcccaggcaatgtagtgagaccctggctctacaaaaaatagccaggcacggtggtgtgtatctgtagttcaagttacttggaagtctgagttgggaggattacgtcagcgcagggaggtcgatgatgcagtgagccacgatcatgccactgtactccagtctgggtgatagggtgagagcctgtctaaaaaatatatatatatgtcattttaaaactgtgtatacatacagacagatatgatgcagatacacagtcccacacacattttactttcaatataattcaatgcatactgtttgcaattttgtacaaaatctttagaacaccttataatatctgcatgaatccatatcaatatatacttttgagggcttgagatttttggattttactctagaagaactttaagaaattataattcaaaaagtatatggtaggtcaaacatagtgagacgaagtaatttaaaatgtctgggccatatattatcatctgttgacgatgcacatataatatgaacttataagccaatgttcaaattatcctgtagtgtaactattaaaacaagttatcttcacttacaaattaagtacttttcaaatataataattaattattcttggaaataataataggttttaaaatattggcactttttagaactgagttatgctaaattctttccttattgtactctactggctaaggaacaaaaaggctcacccggcctccagttatacagttcatggctattcttataaagttcatagaaggctctagagggaacgcatgtaaagcggcaccggtgcccacctaagtaacgccagagacgtctggaactctaagtttggaccccacaggaggatgctctggaagatcctccgtgcctcaaattctccaaagaggatgctttctgcagaggttctaaggtctagtattaagccctccttggaattttctctcagagttgtaatgttccttggccccaaaattgtttagaatctgaagtttattgtctaatgggaaagccggatggtgttgcatgtaaccgggcttttgtgctgctgttctaagtagggggcctcgttaacgtgtgatgccttcctttgttagtttggccccagtgatccttattggagtctggggaggtttagactttaaaaatcaaactgccatggagactgcttacccgaaattttggttcacagccttcattggattatctgttggggcaaagtaaaactggcaagcttgtattgctatctcatggctaaagttgcaagctattggagcctgcagctcccacgcaaggggaagaggaggaagtcctcccctacaaagcgaattcacaaacttgaaagaagcaatttacacaggatgtgcagatctcaacggaaggacaccggaaacatcaaaagcaaggaaacgggatacttccaaaggaacccagtaattctccagcaacagatccctatccaaaagaaattcaagaaatgtcagatagagaattgtgcatactgattttaaccaagattaggggatacaagagacttctgaaaaagaaaggagcgaaatgacagaagcaattctggatatggttgaggtaattaccaaccagatacggagttttccagggcacacagcaaatgtggaactgaagaaatcataggatgaaatacaaagtacactcaaaagcttcaatgatagactagatcaagcagaaaaaaccctcagaacttaaaatctgaaagcctttttctcaattcaaagatttaaagggttgtactctggccattcacgtgaacaaaatctgctgggttaattggtttggttttttttcctttttttgagagggagtctcactctgtcacccagactagagtgcagtggcacgatctcggctcactgctatctccacctcccaggttcaagcaattctctggcctcagcctcttgagtacctgggattacaggcacctgccaccaagcccagctaattttttgtattttcagtagagatggggtttcaccatcttggccaggctggtcttgaactcctgacctcatgatccacccgcctcagcctcccaaagtgctgggattacaggcatgagccaccgtgctcagccactgggttaattgttatagtggggtcttggataatcactaaaggtgaaataaaaattaaaaaaagtatattggtggaataaaaatagaaaagccttcagaattgttgacatacattttgtctgaattttgtttgtctttgccagatattttatttatttatttatttatttatttatttatttatttatttattgagatggcgttctctattgcccaggctgcaacgcaatggtgcgatctctgctcactgcaacctctgcctcccaggttcaagcaattctcctgtctcatcctcccaagtagctgggattacaggtgcctgctaccacgcttagttatttttgtatttttagtagagatggggtttcaccatgttggccaggctggtctggaacttgcgacctcaggtgatctgtggccttggcctcccactgtctttgctggatattttaaaatgtcagtgttaattcaagctgggggcttgggctgagcctgcctcccattccattcaaagtctcactgagataaatgcatatctgattgcttcctttggaaaaggtaatcacaaactcaaaggatgcaaccctttgtctcccacctgtgatctaaaatctcccaagccgcctcctctccagttgtcctgtcttgtttgttttacatatgttgattgatgtctcatgtctcccttattaaaaggaaaaataagtacggtgaatgaggtaaatgttttagataaatttttgtgtaaattaaaatcttaaagttatttttgatcctcatttaatatctgggtcatttccaattaagacagggttgtgatacggggaaacatgtttctaaaattgtggaattgttcttatctataaatgcctatatctgatagttcagaatttattgctgtttagggtttcactgacattttacgttactaaggataaaaattttagttaacaagtaattttgtatgcaaaatgggccagaaagggttacgttattagtggaaaaataataattttgtctaattcagaagttatctaaattttgttcaaattacagttttgaaaagattatttatgaaacaatgtagtaaggaatcattataagtagggaagaaagttgtggaaaagtttaattaataaaatattctttaaaacctgagagaattggagacatttggctaatgaacattctcatagttaaagttcttagtcttgattaaagtaaaataagaagtattatacaaatgtatcagcaacctggagcagtggctcacgcctttaatctcagccctttgggaggccaaggcgggtggattacctgaggtcgggagttcaagaccagcctgaccaacatggagaaatcccatctctaccaaaaatacaaaattagccgggcatggtggtgcatgcctgtaatcccagctactcgggaggctaaggcaggggaatcacttgcacccgggaggcagaggtttcggtgagccaagatcgtgccattgcactccagcctggccaacaagagtgaaactccgtctcaaaaaaaaaaaaaaaaaaaaaagtatcagcagtttgacaattttttttaaaatataggtaagcatgaagctggaattagtgtggagccaatttcacatatatgcttgcattgcttcacactatgttgaggtggcatctgccaccatgccaggctaattttgtatttttggtagagacggggtttctccatgttggtcaggctggtcttgaactccccacctcaggtgatccacctgccttggcctcccaaagtgtgagattacaggcgtgagccaccacgccatttgacatggatactgttggagtacatattggtcatgtgcctaaagtaaatttcttaattgtacagaatatataatgatattggtgaacttaagggtattgaattgtgtatcaggaattaatggagcacaccagctttttatccataaactaactttttggattttaggcttcctgatactctaaatgtgttgagtatactctcacaaatagaatttgagtcatatttctctctctctggctaatttctccaaatttgtaaactatgaatattcttaattcatggcaatgtgtttccttgcatacagtcaagcatggtcaccagggccactcagggagagacaatccagaaacctggcatgcagccaaaagggtaagaattttttaccagtcagtctctggcctctatctctgtgtgcaaactcgttaatctcctctgaaattttaaattactttgtttaataataaaaagaacttaaatcaaatattttgtcagaaaagtagagtgtaatgccttttagttcacataactttagcaatctttgggatataaagatggttttatagattattggtaggagaggtgtggtggctcatgcctgtaatcccatcgctttgggagcccgaggcaggcggatcacctgaggtcaggagttcgagagcagcctggccaacatggtgaaaccccgtctctactaaaaatacaaaaattagcagggtgtggtggcgggagcccgtaatcccaactactcaggaggctgagacaggagaattgcttgaacccaggaggcagaggttgtggtgagccgagattgtgccattgcactccagcctgggcaacaagagggaaactctgtctcaaaaaaaaaaaaaaaactgttggtcagatgcaaggtttgctaagtgttttaatgttacaaactgctttttgggttttgagaactgtctgtcttgcctgcttcacacttggtgacacctggggacatatgaaactaaccacacccttaactaagaaggcaaggcttgactgcacttagcatacaagtaaagcaacttaccgtgttttaccttaagggtaaaattgctaggaattaattgaaactactagaaatagatttacatgcaaggtgtgtaaaaacagtaaaatgtatttttatagtaaaaggttaaatgaaggcatggaaatgtcaagttttgcctagggttaaaggattgttttgagttaaattaggaaaaagctgaaggttcaaagaagtggtggaagaattgtggaaattagtcttgctgaagaggttctctgtgtgaacatgttgactaaattcaaaagggttataaaaggtttttgcttctttaaaatttctgagctatcattttggcaaaataaataacttgtagtaatctggaattcccaaaatcaaacttcagtttcaaaattgtcttccctggcacctgccttttggaatacttcagagggtccctgaagtgtccagaaaagagaggtaaacaggattaggtacatggtattaaatacagtgagttctaaatttttcttcaaagaatcagtatgtcagtatgttcagttctttgttccccattttaaagtttaacttcctcattctcctcgtctccttgcccctggtttcagtaaatgaccttttccatcagttctaatcagtagttcacacctgttcccctggtcacctgctccatcctgagtcacccctggttacccgctctgatctgtcacatttagtcatgtgttccgtaaccatccttcccaccaaaactgctcaccccgccattctggtcatacccctgctctctttaaaatagccaatcagaattagcttagactgtgcagtccaaccctagcctatagggcaacgacacagcagtaggggctacctgcatcagggataagaaccccttcccctcccctgttcaggtgtgctctcgccattgctccatctgtgagacgcacccttctatagaagaaaaattgccttgctgagaaaactcatgttcaagtgctatttcttttgtggcactgaaaatttatttctaacaatgggattgccaaaatgatgcttaatcttctttaggttatatttttgtgaataatactaatatatattccaaaattgtatgggatttctaaaattctaatgtctaaatatatgctaccaatcacaattatagttattatgctgttattgtaaattacagaaataaccaaatttccttgtataaagctactaacccaagtaaatcaaataattaaatataaagaaaacagtgttaaaccagctaatactaaaattgtttaaaatagtttataaccaatgcttgatcccatattcctaggaaaacaattaaagtttcaggtacatttggccacctggttggccatttaaacattttataaagggatatcattcaattgtcatttcaatgcatgttttctggttgtataaaagctttcctatgcaacagagctgatgttctaatagtagattattatgctacagtgtattttcaccaggttaaaaaaaaggctttttatggtttggatcttctgagaacatcagaaaaagactgtccttgccatccacactacaacaaaacttagggaccttgagctttgggttcatggtcttgcaactaagaagggttcctccacacttttggaactgtgcacccattgtaacccttgaggtaaagctaaccagggaaatttctcccaagaagaagatggcatccttgatgtgaatatctttcccaaggtcacagattaagacttctagtgacatgaaactcttctctttgaaagtttttttcttgcttatgtctctgtgaacaatagaagtggaaaagtgtctgttatgtgcactaatagggtgtacttttatttgtgaaggagcttccagccagcctgcaagtgtaaggttacatggataagcttatactttggtagataaaggataaaggccaatgtatgtaagaaactttaatggtacatgcattgcctcataatcagtcaaaagcagaacattggttcattcctcttggcccatttcattggttgaagagaacactgccagagggccttcactcttctcaaagggcatcatttgttaagtcctttttccatgatttggagtaaaagaagcaatgattggaaatatatccctcatgataggttctatagcaaattctactgtaaaggctgcagttgcacagtgattctaaattctcttgtgaaagttgggatagaaatggctaaacagaaaaagtatctgtgcagctgctggcacttgtggcctatggggaaatacatcaaatgaggattataaaaattcagtagtggccaggcataggtggctcacgcctgtaatcccagcactttgggaggacgaggcaggcagatcatgacatcaggagattgagaccatcctggctaacacggtgaaaccctgtttctactaaaaatacaaaaaattagctgggtgtggtggcgggcgcctgtaggcccagctacttgggaggctgaggcaggaaaatggcgtgaacccgggaggcgtagctttcagtgagccgagatcgcgccgctgcactccagcctgggtgacagagcgagactccatctcaaaaaaaaaaaaaaaaaaaaaaaattcagtgatcgggaattgatgaagaaattgcttcattaagtgagtaaactctttatctagctcattctttgatctgtttggttttaggaggtttggtttatggagatcttgggtaaggggcatactccaaattcttggtatatcctctaataatagtctccctggtgtgctgcgttctctcaaaggttttaaatgcttgcatgcagccatctctaaaatgaaatatagtttcttttcaactggaataacaagagccaaaagaatctgcaaccatgaggacaccgtaacctatacctgacgtgctgagaatgaaaacccaaaataatagtaaccaagagtggcactaaggccctaagttttggtcccactctcactcaagtgaaaacctgaataaaggggaattttttaaagaaaattatgggaggccattgttttggactgagctcatgcactaggcccctacaaaccaaaccaaaccaaaccaaaatggagtcgctcgtgctaaaactttagggaaacgcatagattctacaagagaccaggttttgttttttttctcctgcatatctctataaaaaacatttctgacagcataggtatcaaccccctgaagttcccattaaatcttttagccaaattcatttcctctcgcctagataatcatcaagcttcagatgatcatgcaaccacggttccagccagttccaggtgaagacaccacccctggccatcaagaagctaccctgcctccacgagatagagcatggcgagagttccgtgatttccaataggtagggactatgccccaggtcggcatgaagcagttacagaagaaagctcttcagtccctctgcctcacataaagatttatggggatcaagtctctcagcggggagatgaggcaggagaatagggcctggaggcaggggacctaaggctgttttacgctgacttcctagaactaaattgaaaggaaaaccctcactttcaacgcctaagtaacaaaaggaccagaggctactccctttgaccttttctgcactacagatggaaaattggctgtggcaacaaattaggctgacttctggcctagtcttcgtttgcatacaagtataactttgttaacttcaccctagcctctgattggttgctttttgcaaccaatcagatatttgcacaggagtgtgacctttgtaacttcagtttagcctctggttgtctcctttctgcaaccaatcagatttatttcgggcgaccactccacttacatgaggtggccaatgggaaacttctagggggtatttgaaccaaagaagattctgtatccaggcccttgagcctctgctgaggccatctcccacagtgtggagtgtactttcgttttcagtaaacccttgctttcattcttttgttacttcattcttgctttgctttgctgggcattttatgcaattatttgttcaaaacgccaagaacctggacaacttgcaatcctgaccctctacgggtcacaaacccaagttgcacccaactggacaaatctccagtaatccatgttcagtggcgcctttatctctggaaggcgttttttcaaacagaaagggcgggagaaaagggctccaagacagggcttgattgaaaatgtggaaccctactgccaccgtgaggaaatcgtttaaagacggaatacgccatcatggcgtccttctcggaaagcctccctgtgggggaaaggctgatctgtaggcccccaggctatgtcttcctgccttttcctctaaggcctgaaaagagacagggacattggcggtatcttggtgtagaatctggagagtgcggggtttggagtgaaccagcagctgccaggaggtactggcacaggaagtcgtggagcggaaacttggttcctccggtgtggggaggacagtagggaaccagtcaaacacacatagaggctcttgtgggcatctgtctcttctacctgccctttggagcaagagtcagcaggctttcacttgctagcatcttgctatgggtcttggggtttctggtagcatcaatatcgctcacaaggaacacagttattccaagggaagtttacaggatttgctgttagaaccttcactctccaggttctacagcaaggtaccgccaatgtccacgtctcttttaaggccttagacgagaaggcagggactctgagcatggagcccaagcctcttccacctccccacagaccagaccttccccaacaggtagtcctcacaagacgacccatgtaatggcgtagggatccgttaaatgacatcctcgcgatggcggtagtgcatcagatatgccagaaagccctgtcttggagcaccgcccccttctcctgcccttcctgtctgaaaaaacgcgactcatagacaaaggcgcaaccaaacatggatgccttctatttgcccagtgtggagcctgctagtcttactgctgcactttttcattttgttttccacttgaaatcaaaccgaggcctaaagcaccggtcctcatcaggaatccagttcttccagaaattaaatatcctcctgacctactctgtgtgggtttgatttacttcagagttacaggtccagtaatttccgaggcatcaaactgtctccttcagggaatacattcagtggatgaactcacaaaaaagagaaaaggagccgggcgcggtggctcacgcctttaatcccagcactttgggaggccgaagctggcggatcacccgaggtcaggagttcgagaccattatggccagcatggcaaaaccctgtctctactaaaaatacaaaaattagccgggcgtggtggcacaggcctgtaatcccagctactccagaggaggaggcaggagaatcacttgaacctgggaggggaaggttgcagtaagcggagagcgcactattgcactccagcctgggcaacagagtgagagtgtctcaaaaaaaaaaaaagagagagagagagaaaagggctaaaagcttgaaagcttggaaaagaactccagcaaaaaatttaaaaatcccagaggtcttcgccctggctcccctgtcaggcatccagggaattcttcctattctaagagccttatgtggtacatcataggcaacaatttggcatgagccattagaggagaaaccaggtgacgctccttactgcatgccatatatactccaaatgccatgatactcatagaacatatgttcaattcatatcaaggtggctcagggtttcatctcatggtctcatcatttaacatcaaaacacagcatgtgcccgtgccattacatattcttcaagtattccctgagactttatggggtgtgtgtttgtgttcgtgtttgtgtgtgtctctgagagttttataattggtcttttaagtataaggattacagtattctccaactagtaaattaaagaataatgcttgacaaagattaagaaaaatccatgtattaacacagaaaaccgctaccatacaacttgtcaaggtaactcatgaacttatggattatttccatgcatctttcaaaatgtgcatacattaacttcatgcaaaaaaataaatctgtgtaaaaagtggattactgtgtacatagtggtttggatcagaccaaatgtgtattttaatgaaactttcagatgcatgaattaattcaaatgtcaccagtactaagtcttatatgtcaacatttcatgccttcaatataaataaaggtaaatcttaacatacagcctcaggaaaattactttagtaaagtagacaatatcagctctttgattttttacagctacatcactacacatttctaaaaaaaagttcatgaagagacaaagacatcagaaattatggctacctaacattttgctcaatttgtgtaaacaatttccactcttaaccatttgcttttggtttccattggatattaacctgagatgtaatccatgcaccctcatcaagcatctcatctttttaagaactcagtttctgcacaaccaaatcttcccatttctactctttttcactctgcatcatatctgcagtattttattgtgatatcaaatagtcttgtagtaatggggagagaccttaggtttccatgcctaaggagagaagaaaaaaaaaagctcacctctaaaggcttggagaagagcaaatctaggcaccaggccacgtggttcttgtcctgattccctactcaggttccccgggaattttactccatgttctaatctagtcagtaggccttatacattgagggggaggatgctatttagtggggcactaacataagggtacggatagctctcaagcctgacaagacacacacagccctacttgaatagacacaaacacaggaatgactgtaaatactaatcagattgatcacaggattttgtctcatagtttcattatttaacactgaattagaaatattttccagtgtcattaaatggctgtcacttaggactgtgccctatgactttcttgtgtatgtgtcttattgtttttcagttgggaatcagtcctatattttctcattagtaacaaagacatggaatttgcaaagaagttaaaaataaccatgtgctgatcaagagaaaagcaatgtcataaaactgtattaaacaatgatcattgtttccatatttcctctcattttttcaacactcagataaaaagttctatatatacagtcaaacaccacaataaatttacattttacttgaatttagatatataaataaagttgaagaattaaaagtttcacatctgattcctgaggtttttttattctcataagaaagttgcaatatctgaattttagacaataaaatatttgcaaaaacttcttgattggactattcatcaaaacataagttctccattttcacttttatatctaaaatatatgtatatttatacacacataaaatagaaacacgtttatatacaatagaaacatatgtattatacatacttatacctagaaaattaggatgtttaattcttctcaaatttttattcttaattctttccttaaaattttatctttgaaacctcaaaagaaagatagcaaaattcaataaatgatagttgaaataggcatctctcacattcagtcacctggaggtgtaacctaagaaaactgtaagatggatgcattcacacaactcacatgcagctagaatgctttattactgtctctgtttatataatgacaaattaaagttttgaatttgttggccaaaaataccatcttcaaacgtatactcattataacacctaccatgattaaatatatatagcattggccgggcccagtggctcactactgtaatcccaacactatgggaggccaaggcaggaggatagcttgagcccaggagttcaagaccattcctggcaatgtagtgagaccccgtatctacaaaaaatacaacaaataaccaggcatggtggcgtgcaacagaagccccagctatgtaggaggcggagatgggacgaccacctgagtccagggaggttgattctgcagtgacccatgatcatgccattgcactctcacctgggcaacaatgagacactgtcatatatatatatatatatatatatatatatatatatatttttttttttttaatattgttatatacctacagacagatataaatacacacacactcaacacagtttaaatataattggatgtatactgtttgaaatttgtacaaaatcttcagcattgtcttatatgccttgaatatatctacatccatatgtacttttgagtgcttggaatttttttatattttactctagaagaactttaagatattacaaagcagaaaacatgctgggtctcatatagtgagaagaaataatgacttttaaaatgtctgtgctaggtattatcatctgttcactctgcacatataatatggacttttataacctaatgttcaaattcccctatagtacaactgtttttgttttttaatgttggatatggggtttccctatgttgaccagtttgatctcgaaatcctggcctcaagcaatcctcccatgtcagcctcccaaagtgctaggattacaggcatgaggcaccaagcccagccacctcgtagtataactgttaaaacaagatttcttcactgataacttgagtacttttcaaatataattattcatggaaataatgacaggtttaaaattattggcactttttaaaactgagttggtaaaattcatataacataaaattaaccattaaaatgtgtgaaattcagtggcatttagtactttcacaatgcagtgcaagcactatctctatctattggcaaagcactttcattaccacaaaagaaaaccctggacccattaagcattccccattccactctctgcccagcccctggcaaacactcatctactttccctcactactgatcatcacaataagtggtcttttccaaagtcttgcttttttcacttagcgcgtttcaaatttcatgcattggttatctatcttattgacatctacctcttggatatggatcttcgctattgtaccttcatccacccaatttatcacctgaaggagacaatttgatgccatggaacttgctggacctgcaactgtgtgaagtaaatcatacccagatagactcagtgaggagtatatttaatttctgaaagaacaaaattcctgataagcacgggtggtttaagctgaattttgtttttagttggaaaaacaaaacaaaaccaaaaaaaaatcaacagttaagaccaggttgcaccaaactggacaaatctccaggcagctatgtttggtggcgcctttatctctggtttgcttatttcatagacgaagggcaagagaaaggcctcaaacatagggcttccctgaaaatgtgcaacactactactaccgtgaggaaatcgcttaaagacataatactccactagagcctccttcccaggaagcctcgctgtggggaaaggctgatctgttgggaggtgggagaggcttggcctccaggcgaggtcttcttgccttctcctctaacgcctgaagagtgacatagacattggtggtatcttggtgtagaacccggagagtgaggggcttggagtgaaccagcagctgccaggcggtcctggcacaggaagtcgtgggtcggggcctcagttcctcctggtgtgggcaggactgcaggaacccactcaaacacacattgaggcttttgtaggcatctgtctcttcttcctgtcccttggagcaagagtcagcaagctttctgatgttggcatcttgctatgggtctttgggtctctgtgaccaaacaacaggtttattcaaagggaagtttacaggatttgttattagaagcttcacactccaggttctatagcaagatattgccaatgtccaggtctcttttaaggccttagacaagtaggcaaggacgcccagcatggaggccaagcctctttcacctcttaccagaccacacctaccccaacaggtagtgctcagagaactctgtaatggcgttaaacgactataattcgttaaacgtcttcctcgtgatggcagtagtgctccagatatgccaagaagtcctgttacgtagccctcttctcccgcccttcctgtctgaaaaaacgccacacatagacaaagagccaccaaacatggatgtcttctattttgcccagtttggagccagctggtcttactgctgtgctttttctttttgttttccacttgaaatcaaaccaaggcctaaaccaaccaccctcatcaggaattttgttctttaagaaattattctactgacctagtctgtgtgggtttcatttacttcagagttacaggtccaataatttccgtggcatcaaactgtctttttcaggggatagcttcagtgtatgaacgcacaaaaaggagaaaagggctgaaagcttggaaaggaactccagcaacaatttaaaaatcccagagatcttggccctggctcccctgtcaggcatccagggaattcttcctattctaagagccttatgtggtacatcgtaggcaacaatttggcatgagccattagaggagaaaccaggtgacgctctttattgcatgccatgtatactccacatggcatgatactcatagtacatatgctcaattcctgtcaaggtgactcagagtttcaactcatggtctcatcatttaacatcaaaacacagcatgtgcccatgccactacatattcttcaagtattccctgagactttatgggctgtgtgtggttgtgtttgtgtgtgtctctgagagttttataatgtcttttaggtataagaattaactagtaaattaaagaataatgcttgacaaagattaagaaaaatccatgtattaataatgaagaaaaccactaccatacaactagtcaaggcaacttaagaacttttggattatttccaggaatatctttaaatatgtacatacattgttaatttcatgaaaaaataaatctgtattgaaagtggattactgtgtacactgtggtttggatcagatcaagtgtgcattttaacaaacctttgaggagggtgaattcatttgaatgtcaccagtacgaagtcttatatgtcaacatttcatgccttcaatatgagtaaaggtaaaccttaaaatagggcctcacgaatattactttagaaaagtagacacttatcatctttttgtttgaatttttaaagatgcattactatacgtttcaaaacaaaacgccatgaagagacaaagacaacagaaactacggatacctaatattttgctcaatatgtgtaaccattttccactcttaaccatttgcttttggcttccattggatattgaactgagatgagatccactcaccctcaacaagcatctcctctttttaagaactcagtttctgcacaaccaaatctccccacttctactctttttcattcagcatcctatcagcagtgttttattatgataacaaatagtcttgttgtattgggaacagaccttaaggatccatgcctaagaaagaattaaaaataaagcttacccccaaggtcttggagaagagcaaatctaggcactgggccacgtggttgttgtccttactccctccccaggttccctgggagttttactccatgttctgacctagtcattaggccttatatgttgagcgggaggccactatttagaggggctataacataagtgcccatgtaactcttaaacctgacaagacacacacagccctgtttgaatggacacaaacgaatgactataaatgctaatcagatggatcacaggattttgtctcatggtttcattattcaacattggaacagaaatattttccaatgtcattaaaaggctatgactggctgggtgtgctggctcacacctgtaatcccagcagtttgggaggccgaggtgggcagatcacttgaggtcaggaggtcgagataaacctggccaacatggtgaaaccctgcctctactaaaatacaaaaaaattagccaggtatggtggtgcatgcccataatcccagctacttgggaagctgaggcaggagaattgcttgaacccaaggcagaggttgcagtgagctaaggtcgtgccgatgcactccaccatgggtaacaaagtgagactccatccgtctcaaaacaaacaaaaaggctatgacttaggactgcctcttatgactttgttgtgtatgtgtcttactgtttttcacctaggaatcagtcctatactttcttattagtaaggaagacatggaatttgcaatgaagttaaaaaaaaccctttgggaggtgggggcaggtggatcacaaggtcaagagattgagaccatcctgccaacatggtgaaaccccatctctactaaaaacacaaaaattagctgagtctggtggtgcgcacctgtagtcccagctactcgggaggcggaggcaggagaatcacttgaacctgggaggcagaggttgcagtgagccgagatcaccccactgcactccagcctggcgacagagtaagactccctctcaaggaaaagaaagggggcggggggaggggggcggtggctcatgcctgtaatctcagcactgtgggagacctaggagggcagatcacctgatgtcgggagttcaagaccagactgaccaacatggtgaaaccccgtctctactaaaaatacaaaattagccaggtgtggtggcacatgcctgtaatctcagctacttgggaggctgaggcaagagaatcacttgaacctgggaggcagaggttgcggtgagccgagatcatgccattgcactccagcctgggcaacaagagcaaaactacgtctcaaaaaaaaaaaaaaaaggaaagaaataaaaataaaaataaccatgtgctgatccagagaaaaccaatgtaataaaactgtattaaacaatattaaccgtttccatatttactccaattttttacacacagatcaaaagttctatatatacagtcaaacacgacaataaatttacattttacttcaatttagctatatataaggttaaagaactaaaagtttcaccactgattccttaggagtttttgatattctcataaaaaatttgcaatatctgaactttagacaataaaatacttgcagagaacttgtgattggcctattcataaaaacataagatctcaacttgcacttttaaatcgaaaatatgtatgtatttacacatacataaacatataaatacatatttatatacaacataaacatatgtattatacatatttatacccctgaaaattaggatttttaatacttctcaaatttttactcctagttcttaccacaaaacattatctttaaaatttcaggctgggcgcagtggctcaagcctgtaatcccaggactttgggaggctgaggtgggcagatcacgaggtcaagagattgagaccaacctggccaacatggtgaaaccccgtctctactaaaaatacaaaaaaattagccaggcatggtggtgcatgcctatagtcccatctactcggggggctgaggcaggagaatcacttgaatccaggaggcagaggttgcagtgagctgagattgagccactgcactctagcctggtgacagagcgagactccatctcacacacacaaaaaagaaatttcaaaagaaggataacaaaattcaataaatggtagttgaaataggcatctctcacattccagtcacctagatgtgtaacctaagaaaactgtaagatggatgcattcacacaactcacatggagctagagtgcttcattagtgtctctgtttatataacgatgaattaaagatatgaatttactggtcaaaaatatcatcttcaaacatatactcactataacacctaccacgattaaaaagatatggcattggccgggcatggtggctcacaactgtaattctagcactttgggaggcctaggcaggtgcatagcttgagcctaggagttcaagtccagccctgacaatgtagagagaccccgtctcttcaaaaaatacaaaaaatagccaggcatggtgacctacaatggaagccctagctacgtaggaggcggaaatgggaggatcacctcagcccagggaggctgatgttgcagtgagccatgatcatgcctctacactccaccctgggcaacagagtaagatgctgtctaaaatatatatatatgcatatctgtgtgtatatatatatatatatatgtgtgtgtgtgtgtgtgtatatacatatgtgtgtgtatatacatatatgtgtatatatatatgtgtgtatatatacatatacatattcagcatcaccttatattctttgaatatatctacatcaatacatacttttgagtgcttgaaattttttatattttactctagaagaactgtaagaaattataaagtagaaaacttgtggtaggtcaaacatagtaagaagaaataatcactttttaaaggtctgtgctaggtactatgatctgttccctatatatacataatatggacttttataaactaatgttcaaattcccctgtagtataacttcttgttgttgtttatttttttttttttgtatttttcattttagatatggggtttcactctgttgaccaggctgatctcgaaccactggtctcaagcgatcctcccatcttggactcccaaagtgctaggattacaggcacgaggcaccttgactggccaccatgtactatagctgttaaaacaagtttgtttcactgataactggagtacttttcaaatataattaataattcatggaaataatgatagctttaaaagtattggcacttttaaaaactgagtttgtaaacttcatataacataaaattaaccattaaaatgtattaatttcaatggcatttaggacactcacaatgcagtgcaagcattaccactatgtagtggcaaatcattttcactaccacaaaagaaaatcctggacccattagttagtcattccccattccactctctgcccagcccctggcaaacactcatctgatttccctcactactgatcatcacaacaagtggccttgttcatcttgttgtgggaaccaggagaccagagagaccaatgggtggaacaggaggattttactaggtggtcaccgactcagcagattaacatccaaaggctgagccccaaaccaagagagggcttgacttttatacatatatctgaaaagggcccaaaacctgtaaggccggtaagcaagcttacagcagaacaaaggcagtttatcaaacagtgacaggttttacagttcaggcatgtcttgtgacctttgccataactgcacagctggaaaacaggaacttacaaaatccttacaagcttgcagaaacagttacaaaaatagttgtgagagcagaacaaagaataatggtatggggaaagaatttcaaaggggaaactgataaaaagaacttgtttttctttcttttttttttttagatgaagtcttgctcttgtcccccaggctggagtgcaatggtgtgatctcggttcactgcaacctcctcctcccgggttcaagtgattctcctgtctcagccttccaagtagctgggattacagctgcctgccaacatgcctggctaatttttgtatttttagtagagacggggtttcaccatgttggccaggctggtcttgaactcctgatctcaggtgatcctcccacctcggcctcccaaagtgctggggttacaggtgtgagccaccgtgcctggccaaataacttgtttttcttatccctgcttctagagcccactccttctcggcccccactctgctgatagtgctatcaaagtcctgacagagccctacttatcgctgggccttggagtgagtcagcccagcacagagaaccagcttttctctcccttttttttttcttttacatctcctgcttcagtactgcttctttcacttagcgcttcaaacttcatgaattggttttctatctctttgatatctgtctcttagatatctatctcttagatatctttctttgtttttgtaccttcatccatccaatgtatcacctgaaggagacaatttgataccatggaacttccaggccttgtaactgtgtgaggtaaatcatacccagatagcttcagtgaggagtatatttaatttctgaaacaacaggattcttgagaagcatgggtggtttaggcctcattttgctttcagatggaaaaaaaaaaaaagtaaaaattcaacagtaagaccaggttgcaccaaactggacaaatctccaggtagccatattgggtggcatctttgtctctgggtggcgttttttcagacgggaagggcgggagtaaagggctccaagatagggattccttaataatgtgaagcacgactgccaccgtgaggaaatcctttgaagacacaatacgccattacagcgtccttcccagaaagacttgctgtggggggaagtctgaactgtgggaggtggcagacgcttgggctccaggctaggtcttctagctttctcctctaagacctgaagagaggccttaacattggtagtagcttggtgtagaaccaggagagtgaggggcttgtagtgaaccagcagctgccaggcgatcctggcacaggaagacgtagggcggggcctcggttcctccaagtgtgggcaggactgaaggcacccattcaaacacacatggaggctcttgtgggcatctgtctcttcttcctgtcccttggagcaagagtcagcaggctttctcgaactagcatcttgctacgggtctttgggtctctggtagcaccagtaccgcgcacaaacaacaggtttattccagggaagtttacaggatttggtattagaaccttcacactccaggttctataccaagacaccgccaaagtcctggtgtcctttaaggccttagacgagaaggctaggactcccagcatggagcaagccttttccacctccccacagagaacttccccaacaagtagtcctcaggagaacaccgtaatggcgtagggatttgttaaacaacatcctcgcgatggcagtagtgcttcaggtatgggacgaagcactgttccagagccctcttttcccgcccctcctgtctgaaaaaacgccacctatagacaaaggccctgcagaatgggtgccttacatttagcccagtttgcagccagctagtcttactgctgagctttttcttttggtttccagttcaaatgaaaccaaggcctaaaccacccgccctcatcaggaatcttgatctgtgttaaaagtggattactgtgtacactgtgatttggatcacaccaagtgtatttttttttttttttttgagacggagtctccgctctgtcgcccaggctggagtgcagtggtgtatctctgctcactgcaagctccgcctcccgggttcacgccattctcctgcctcagcctcccgcctagctgggtctacaggcgcccgccaccacgccctgctaattttttgtactttttagtagagacggcgtttcaccgtgttagccaggaaggtctcgatctcttgacctcgtgatccgcccgccttggtctcccaaagtgctgggattacaggtgtgagccaccgcgcccacccaccccgagtgtgtattttaacaaacatttgaggatcgtgattttattagaatgtcaccagtactaactcttttttttttttttttttttttttttttgagatagagtctcgctctgtcgcccaggctggcgtgcagtggtgggatctccgctcactgcaaggtctgcatcccgggttcaagggattctcctgcctcagcctcctgagcagctgggattacaggcgtgcaccaccacgcccatggagtttcaccatgttggtcaggctggtctcgaaatcccgacctcgtgatccgctggcctcagcctcccaaagtgctgggattacaggtgtgagccaccccacccggcccagtactaagtcttatatctcaacatttcacaccttcaatataaataaaggtaaatcttaacatagggcctcaggaatattactttagtaaagtagacactatcagttttttgtggaatttttacagatacatcactacatgtttctaaaaaaaggccatgaagagacaaagacaccagaaactatggctccccaacattttgctcaatttttgtaaacatattacactcagcaatttgcttttagtttccattggatattaaactgagatgtaatccactcaccctcatcaagcatctcctccttttaataacttagtttctgcacaaccaagtcttcccatttctactcttactcactcagcatcatatctatagtgttttattatgatatcaagtactcttgtagtattctggaaagaccttagctttccatgcctaaggagagaagaaaaaaaaagcttacccctaaggtcttggagaagagcaaatctaggcacaaggccacgtgtttcttgtcctgacttcctccccaggttccctgggagttttactccatattctgacctagtcattaggccttatatgttgagggaggggcggctatttagtggggctctaacataagggctcagatagctctcaattctgacaagacacacacaaccctacttgaatggacacaaatacaggaatgactataagtcctaatcagatgggtcacgggattttgtctcatagtttcattatttaacattggaacagaaatattttccagtgtcattacaaggctatgacttacaactgtgttctatgactttgttgtgtatgtgtcttactgtttttcagttaggaatcagtcctatattttcttattagtaacaaagacatggaatttgcaaagtgaaaagtaaccaactgctgatgaagagaaatgcgacgtcataaaactgtgtattaaacactgataaccgtttccatatttactcatatttttttcttttcttttttttttttttttttgagagggagtctcgctctgttgcctaggttggagtgcattggcgctatcttggcttactgcaagctctacctcccgagttcacgccattctcctgcctcagcctcccaagtacctgggactacaggcgcctgccaacacgccccgctaattttttgtatttttagtagagacggggtttcaccatgttggccaggatggtctcgatctcctgacctcatgatccacccacctcggtctcccaaagtgctgggattacaggcatgagccactgtgcctggcctactcctattttttcaatacacagataaaaaagttctatatatacagtcaaacaccacaataaatttacattttacttgaatttatccatacataatgatgaagattaagatttccacatctgattcttaaggagttcttgatattctcataaaaatttgcaatatctgaattttttacaataaaatatttgcaaagaacttcttgtttggactattcatcaaaacataagttctgaacttgcacttttaaatttaatatatatatttatacatacataaacatataaatccatatttatatacaatataaacatatgtatgttacatacttatacctatgaaaataaggatttttaattcttcttcaaattttattgctaattcttaccttaaaattttatctctaaaatctcaaaaggataaaaaatttaataaatggtaattgaaataggcatctctcactttcagtcagctagatgtgtaacctaagaaaactgtaagatggatgcattcacacagcttacatgcagctagaatgcttcattagtgtctctgtttatataacgatgcattaaaaatgtgaatttgttcaccaaaaatgccatcttcaaacatatactcagtataacatctaccacgattaaaaatttatagcattggctgggcgcggtggcttacaactgtaattgcagcactttgggaggccgaggcaggtagacagcttgagcccacgagttcaataccagccctggcaatgtaggtagaacctgtgtctacaaaaaatacaaactatagctgggcatggtggggtacaacagaagccccaggtacgtataggaggcagaggtggcaagatcacctgatcccagggagattgatgctgcattgatccatgatcatcatgccactgcactccagcctaggcaacagtgagacagtctcatatatatatatggcatttaaaattttgtaatatatctccagacagatataaatacacacacacttgatacagtttaaatataattggatgcataatgtttgaaatttgtacaaaatctgcagcatcactttatgctctttgaatatatctacatcaatatatacttttgagtgctttaatttttttgtattttattctacaagaactttaagaaattataaagcagaaaacatatggtaggtcaaacatagtgagaagaaataatcacttttccctatgcacatataatatggactttttaaaactaatgttcaatttcctctgtagtataacaggttttttactttttattttagatatgggttttcgttgccgggcaggttagctcacgcctgtaatcccagcactttgggaggctgaggcgggcggatcacaaggtaaggagattgagaccatcctggctaaaatggtgaaacccgtctctactaaaaatacaaaaaattagccgggtgtggcggcacacgcctgtagtcccacctacttgggaggctgaggcaggagaattgcttgaacccaggaggcggaggttgcagtgagcccagatcgcgccactgcactccagcctgggcgacaaagcgggattctgtctcaaaaaaaaaaaaaagatatggggtttcgctatgttgaccaggctgacctcgaactcctgacctcaagccatcctcctatctcagactcccaaagtgctaggattataggcatgaggtgtcatgcccggccacccagtagtataactgttataaacaagttttcttcactgataatttgagcacttttctaatataattaattatccatagaaataatgataggtttaaaagtattggcactttttagaactgagtttgtaaaattcatataacataaaattagccattaaaatgtgtgaaattgagtggcatttagtacattcaagatgccgtgcaagcattaccactacatagtggcaaatcattttcattaccacaaaacaaaaccccggacccattaagcagtcattccgcattgggctctctctctgcccagtccctgacaaacactcatctgctttccctcactactgatcataacaagtggccgttttcaacttccttctttcacttagcttgtttcaaatttcatgtattggttatctatctctttgatatctacctttgttgttgtacctgcatccacacaatttatcaccttaaggagacaattttatgccatgaaacttgctggacctgtaactgtgtgaagtaaatcatacccagatagactcagtgaggagtgtatttaatttctgaaagaacaagattcctgatgaacctgggtggtttaggcctcattttgttttcacacggagtaaaaaaaggaaaaattcaacagtaagaccaggttgcaccaaactggacaaatctccaggaagccatgttgggtggtgcctttgtctctgggtggcgtttttttcagccaggaagggcgggagaaaagggcgccaagagagggctttcttgaaaatatggagtactactgccaccgtgaggaaatcgtttaataacgcaatacgccattatagcttctttccgggaagcctggctgtgggggaaggtctgatctgtgcggtggtggaagaggtttgggctccaggctaggtcttcttggcttctcctggaactcctgaagagaaacctgtacattggcgatatcttggtgtagaacctggagagtgaggggcttgcaatgaagcagcagctgcccagcggtcctggcacaggaagtcgtggggcggggtctcggttcctagtgtgggcaggactgcaggaacccactcaaacacaaatggaggctcttgggggcatctgtctcatgtaattgccccttggagcaagagtcagctggctttcatgtgctgtcatcttgctatgggtctttgggtctctggtagcataagtaccgcgcaaaatcaacaaaggtattcaaagggaagtttacaggatttgctattagaaccttcactctccaggttctataccaaaatatcgccaatgtccatgtctcttttaaggccttagacaagaaggcaaggactcccagcctggagcccaagcctcttccacttccccacagaccagtccttccccaacaggtagtcctcagagaacgctgtaataatggcgtagggattcactaaacgacttcctcgcgatggcagtagtgctccagatatgccaagaagccctgtctttgagccaaggtcttccgcccttcctgtctgagaaaacgccacctatagacaaatcacaaccaaacgtggatgccttctattttgcccagttggtagtcagctggtcttactgctgcactttttctttttgttttgcgcttgaaatcaaaccaaggcctaaaccacctgcctccatcaggaatcttgatctttcaaaaatgaaatctcctcctgacctagtctgtgtaggtttgatttacttcagagttacaggaccagtaatttccgtggcatcaaactgtctctttcaggggataaattcggtggatggacatacaaaaagaaaagggcttaaagcttggaaaagatctttccagtaaacaattaaaaaatcccagggggaagggtgcggtggctcacgcctgtaattacggcactttaggaggccaaagcgggcagattgactgaggtcaggagttggagaccagcctggcctacgtggtgaaactccgtttctactaaaaatgcaaaaattagctgggggtggtggcgggcgtctgtaatctcagctactcaagagtctcaggtaggagaattgtttgaacccaggagacagaggttgcagtgagccgagattgtgccactgcgctccagcctgggcgacagagcaagactcggtctcaaaaaaaaaaaaaaaaaaaaaaatcccagggatcttggacctggctccctgatcagacatccagggagttcttcgtattctaagagccttctgtagtgcattgtaggcaacaatttcgcatgagccattagaggagaaaccaggttacgcacattaccacatgccatatatattccaaatgacatgatactcatagtacatatgtttaattcctgtcaaggtggctcagagtttcatctcatggtctcatcatttaacatcaaaacacagcatgtcaccatgccattacatattcttcaaatatttcctgagaatttatggggtgtgtgtgttcgtgtttgtgtttgtgtgtgtctctgaaagttttataatttgtcttttaggtataaggattacagtactctccaactagtaaattgaagcataatgcttgacaaagattaagaaaaatccatgtattaataatgaagaaaactgctaccatacaacttgtcaaggcaactcatgaacttttggattatttccatgcatatctttcaatatgtacatacactgttaatttcatgcaaaaaataaatgtgttaaaagtggattactgtgcacactgtggtgtggataagaccaagtgtgtattttaccgaatctttcagatgtgtgaattcatttgaatgtcaaccgtactaagtttatatgtcaacatgtcacgccttcaatataaataaaggtaaatcttaaaatagggcctcaggaatattgccttagaaaagtagacactatcgccgggcgtagtggctcacgcctgtaatcccagcactttgggaggccgaggcgggtagatcacaaggtcaggagatcaagaccattctggctaacacggtgaaaccctgtctctactaaaaatacaaaaaaaaaaaaaaattagtggggcatggtggcgggcgcctgtagtcccagctacttgggaggctgaggcaggagaatggcgtgaacccgggagggagcttgcagtgagccgagattgtaccactgcactccagcctgggcgacagagcgagacactgcctcaaaaaaaaaaaaaaagaaagaaagaaagaaagaaaagtagacactatcagctttttgtctgaatgtttacagatacatccctacatgtttcaataaaaaggccatgaagagacaaagacaccagaaactatgactacctaacatttcgctcaatttgtgtaaacatattccactcttagccatttgcttttggtttccattggatattaaactgagaggttatccactcaccctcataaagtatctcctctctttaagaactcagtttctgcacaaccaagtcttcccatttctactctttttcactcagcatcgtatctgcagtattttattatgatgtcaaagagtcttcttgtattgggaacagaccttagtgatccatgcctaaggagagaagagaaaaaaagcttacccttaaggtcttggagaagagcaaatctaggcaccaggccatgtggttcttgtcctgactgcctacccaggttccctagcagttctactccatatctgacctaggcagtaggccttacatgttgagggggaggccgatatgtagtggagctctaacataagggtacggatagctctccagcctgacaagacccacacagccctatttgaatggacacaaatacacaaatgactataaatgctaatcagatagataacaggattttgtctcatggtttcattatttaacattggaacagaaatattttccagtgtctttaaaaggctgtgacttacgactgtgtcctgtgactttgttttgtatgtgtcttattgtttttcagttaggaatcagtcctgtattttctcattattaacaaagccatggaacttgcaaagaagataaaaataaccatgtgctgatcaggagaaaatcgatgccataaaattgtgtattaaacactgataaacagttccatattatgggccggacgtggtggctcacacctgtaatcccagcagtttgggaggccgagacgggcagaacacgaggtcaggagtttgagaccagcctggccagcatggtgaaaccccatctctactaaaaatacaaaaaattagccgggcatggtggcgcatgcctgtagtcccagctactcagaaggctgaggcagaattgcttgaacccagcaggcggaggctgtagtgagccgagatcacgccattgcattccagcctgggcgacagagcgagactctgtttcaaaaccaaacaaacgaacagttccatatttactcccattttttcaacacagagaaaaagttctatctatacagttaaacacgacaataaatttacattttagttgaatttagctatacataaggttgaagaaagtttcacatatgattcctgagtttttcatattctcataaaaaatttgcaatatctaaatttaagacaataaaatatttgcagagaacttcttgattggactattcatgaaaacataagtactcggccggtcgcggtggctcacgccaataatcctagcactttgggaggccgaggcgggtggatcacaaggtcaagagttcgagaccagcctggccaatatggtgaaacctgactctactaaaaatacaaaaattagctgggcttggtggcaggcacctgtaatcccagctactcaggaggctgaggcagtagaatcacttgaacacgggaggcggaggttgtagtgagcagagattgtgcctctgtactctagcctctgcgacagagtgagactccatctcaaaacaaacaaacaaaaaataagtactcaatttgtacttttaagtataatatatatatttatacacatataaacatataaatacatatttatatgcaatatgaacatatgtattatacacacttataccgctgaaaactgaaatttttaattctccttgaatttttattcctaattctttccttaaaaattgatctttgaaatctcaaaggaaagataacaaaactcaataaatgatagttgaaataggcatctctcacattcagtcaccttgatgtgtgacctaagaaaactgtaagatggatgcattcacacaactcacatgccactagaatgcttcattagtgtctctgtttatataatgatgaattaaagacacgatttgttggccaaaaataccatcttcaaacatatactcactataacacctatcaggattaaaaatatatagcattggccagacacagtggctcacaactgtaatcccagcactttgggaggccaaggaggtggatagcttgagcccaggagttcaagactagtcctggcaatgtagtgagaccccgtgtctacaaaaaatccaaaaaatagccaggcatggtggcttgcaatggaaaccccagctacttaggtagtggaggtaggaggaccacaggagcccagggaggttgatactgcggtgaaccatgatcatgccattgcactccagcctgggcaacagagtgagacgctgtctaaaaaaaaaaaaaaatatatatatatatatatatatatatatatatatatatatatatggcatttaaaattttgtaatatacctacagatataaatacagacacaacacagtttactctaaatataattggattcatattgtttgaaattttctacaaaatcttcagcatcaccttatactctttgaatgtatctacatcagtatttacttttgagtgtttgaatttttttcatattttactctagaactttaagaaattataaagccgaaaacatatgataggtcaaccacagtgaaaagaaataatcaattttccctatgcacatataatatggactttataaactaatgttcaaattcccctgtagtgcaactggttctttttctttctttctttctttttttaaattttagatatggggtttcgctatgttgaccagaccgatctcgaactcctggcctcaagcgatccacccaactctgcctcccaaagtgctagtattagaggcatgaggcaccaagcctggctgccttgtagtatatctgttaaaacaagttttcttcactgaaaacttgagtacttttcaaatataattaattattcatggaaataatgataggtttaaaagtactggcacttttaaaaactgagtttgtataattcataaaacataaaattaaccattaaaatgtgtgaaatttagtggcatttagtatattcacaatgcagtgcaagcattaccactatctagtggcaaatcattttcattacattcaacttgctggacctgtaactgtgtgaggtaaatcatacccagatagactcagtgagcagtatatttaatttctgaaagaacaagattcttgatgagcatgggtggtttaggcctcattttgtttagagatggaaaaaaaaaaagcgaaaattcaacagtaagaccaggttgcaccaaactggacaaatctccaggcagccatattgggtggcgcctttgtctctgagtggcgttttttcagacgggaagggtgggagaaaagggcgccaagatagggattccttgaaaatgtgaagcacgactgccaccgtgaggaaatcgtttaaagacacaatacgccattacagcgtccttcctggaaagattcgctgtggggaaaagtctgaacagtgggaggtggcagacgcttgggctccaggctaggtcttcttgctttctcctctaaggcctgaagagaggccttaacattggcggtatcttggtgtagaacctggagtgcgatgggctcgaagtcaaccagcagctgccaggaggtcccggcacaggaaatcgtggggccgggccccagttcctcctggtgtgggcaggactgcaggaacccactcaaacacacatggaggctcttgcgggcatctatctcttattcctgtcccttggagcaagagtcagccaacgttctcgtgctggctatgggtctttgggtctctggtagcatcagtaccgcgcacatagaacagggttattccaggggaagtttataggatttgctttcagaacgttcaatctccatgttctataccaagataccgcccatatccaggtctcttttaaggccttagaggagaagacaaggactcctacctagcatggagcccaagcctcttccacctccccacagaccagaccttggccaacaggtagtcctcacggggaagaacactgtaatggtggaagggtttttttttaaacgatatccgcgcgatggcagtattgctccacatacaggaagaagccccggttcaaagtcctcttctcccgcccttcctgcctcaaaaaaaagccacccatagacaagcgttccaaacctggatgctttatatcttgcagtttggagcttgccggtcttactgctgcactttttctttttattttcaacttgaaatcaaactaaaggccgggcgcggtggctcacgcctgtaatcccagcactttgggaggccaaggagggcagatcacctgaggtcgggaattcgagaccagcctgaccaacatggagaaaccccgtctgtattaaaaatacaaaattagccgggtgtggtgacgcatgcctgtaatccctgctactcgggaggctgagataggagaatcgcttgaacccaggaggcagaggttgagggatcgcgccactgcactccagcctgggcaacaagagagaaactccgtctcaaataaaaaaaaaaaaagaagaaagaaagaaaagaaaacaaatcaaaccaaggcctaaaccacctgcccttgttctatcaaaaattacatattctcctgaactagtctgtgttagtttgatttgcttcagagttacaggtccagtaatttccgtggcatcaaaccgtctctttcagcggataaattcggtgggtgaaaacacaaaaaggagaaaagggctgaaagcagaaaagatcttctccggcaaacaatttaaaaatcccagaggtcggccgggcgtggtggctcacgactgtaatcctagcactttgagaggccaaggcgggcggatcacgagttcaagagatcgagactatcctggccaacatggtgaaaccccatctctactaaaaatacaaaaattagccgggcgtggtggtgggctgtagtcccagctactcgggaggctgaggcagtagaatcgcttgaaaccgggaggtggaggttgcagtgagccgagatcgcaccactgtactccagcctggggacacagcgagactccgtctcaaaaaaacaaaacaaaacaaaacaaaaaatcccagaggtctttgacctggctcccctgtgagacatccagggagttctccctattctgagagccttctgagccttctgtggtgcattgtaggcaacaatttggcatgagccactagaggagaaaccaggtgatgctcattactgcatgccatatatactccacatggcatgatattcaaagtacatatgtttaattcctgtcacggttactccgagtttcgtctaatggtctcatcgtttaacatcaaaacacaacatgtgcccatgccattaaatattcttcaagtatttcctgagactttatggactgtgtgtgtttataattatatgtttctctgagagttttataatttgtcttttaggtgtaaggattacagtattctccaaatagtaaattaaagaataatgcttgacaaatattaagaatagtccatgtattaataatgaagaaaaccgctacaatacaacttgtcaaggcaactcatttggattatttccatgcatatctttcaataagtacattgttaatttcagcaaaaaataaatctgtattaaaagtggattactgtgtacactgtgatttggatcagaccaagtgtgtattttaagaaacctttgaggagcgtgaattcatttgaatgtccacagtactaagtcttatttttcaacatttcatgccttcactgtaaataaaggtaaatctttttttttttttttgagacagagttttgctctttcgcccaggctggagtgcagaggcacgatctcggctcactgcaacctctgccttctggtttcaagtgattctcctgcctcagcctcccgagtagctgggattacaggtgtgtgccaccacaccctgctaatttttgtattttcagtagagacggggtttcactatgttggccaggctggtctcaatctcctgacctcgtgatcggcccaccttggcctcccaaagcactgggattgcaggcatgagccactgcacctggcaaataaagataaatcttaaaatttgacctcaagaatattactttagtaaagtagacactatcagctttttgtatgaatgtgtacacatacatgactacacgtttcaaaaagaaggccatgaagaaacaaagacaccagaaactatggctacccaatattttgctcaattcgtgtaaacatattccactcttagccatttgcttttggtttccattggatattaaacagtgatgtaatccactcaccctcatcaagcatctcctcttttcaagaactcagttactgcacaaccaagtcttcccatttctactcttactcagcatcatatctgcagtgttttattatgatgtcaaatagtcctgtagttttgggtacagaccttaggtttccatgcctaaggagagaagaaaaaaaaaagttttacccctaaggtctttcagaagagcaaatctaggcaccaggctatgtggttcttgtcctgactccctacccaggttccctaggagttttactgcacgatctgacctagtcattaggccttatatgttgagagggaggctgatatttagtggggctctaacataagggttcggacagctctccagcctgagaaaacacacacagccctacttgaatggacacaaatacaggaatgactataaattctaatcagatggatcacagaattttgtctcatggtttcattatttaacattggaacagaaattttttccagtgtcattaaatggctatgacttaagactgtcctataactttgttgtacatgtgtcttactctttttcattaggaataagtcctatattttctcattagtgacaagacatagaacttgcaaagtaaaacagtaaccatatgctgatgaagagaaaagcaatgtcataaaactatatattaaacactgataaccatttccatattcactccctttttttcaatacacagataaaaagttctatgtatacagtcaaacacacaataaatttacattttagctgaatttagctatacttaaggttgaagaattaaaagtttcacatctgattgttgaggagtttttgatattctcataaaacatttgtaatatctgaattttggacaataaaatatttgcaaagaacttcttgattggactattcatcaaaacataagttctcaattttcacttttaaatctaaaaaatacagatacatatataaatatatatacatatattaattttttttagatggagtctcactctgtctcccaggctggtctcgaactcctgacctcaggtgatccgcccgccgcagcctcccaaagtgcagggattacaggcatgagtcaccgcacctggctaaaaaatatatatatatttaaacatacataaacatataaatacatatttatatacaatataaacagatgtataatacatacttatacctctgaaaattagaatttttaattcttctagaattcttattcctaattcttaccttaaaactttatctttaaaatcttcaaagaaagataacaaaattcaacaaattgtagttgaaataggcatctcacacatttagtcacctagatgtgtaacctaagaaaactgtacggccaggtgcggttgctcatgcctgtaatcccagcactttaggaggccaaggtgagcggatcacgaggtcaggagttcaagaccagcctgaccaacatggtgaaaccccgtctccactaaaaatacaaaaattaactgggcatggtgacgcatgcctgtaatcccagctacttgggaggctgaggctggggaattgcttgaaccgggacgcaggaggtggaggttgcagtgagccgagatcacgccactgaactccagcctgggctacagagcgagactctgtctcacaaaaacaaaaaacaaaaaacaaaaacaaaaacaaaaagaaaactgtaagatggatgcattcacaccactcacatgcagctagaatgcttcattagtgtctctgtttatataatgatgaattgaagatatgaatttgttggccaaaaatgccatcttcaaacatatactcagtataacatgtaccatgattaaaaatgtatagcattggctgggcatagtggttcacaactgtaatcccagcactttgggaggccaaggcaggtggacagcttgagcccaggagttcaaggtcagctctggcaatgtagtgagacctcgtctatacaaaaaatacaaaaaatagctgagcatggtggtatgcaatggaagccccagctacatagaaggcagaggtgggaggaccacctgagcccagggaggttgatgctgtagtaagccataatcataccactgcactccagcctgggcaacagagtgagacactgtctaaaaaatcatacatatacagcattaaaaattttgtaatatacctagacagatataaatacacacacactcgacacagtttaaatataattggatgcataatgtttgaaattttgtacaaaatcttcagtatcaccttatactcattgaatatatctacatcaatatatacgtttgaatgcttgtaattttttcatattttactctaggagaactttatgaaattataaagtagaaaacatatggtaggtcaaacataatggaagaaataatcacttttgcctatgcacatataatatggacttttataaactaatgttcaaattcccctgtagtataactgttttttatttatatttttaaaaaaaattttagatatggggcttcgctatgttgatcaggttgatcttgatctcctggcctagagtgatgctcccatctcagcctcccaaagtgctaggattagaggcatgaggcaccgtgcccggccaccttgtagtataacagttaaaataagttttcttcactgataacttgagtacttctcaaatagaattaattattcatggaaataatgacagctttaaaagtattggcactttttaaaactgagtttgtaaagttcacataacataaaattaaccattaaaatgtgtgaaattcagtggtatttagtacattcacaatgcagtgcaagtactatctctattggcaaagcattttcattaccacaaaagaaaaccctggacccattaagcagtcattccccattccactctctgcccagcccctgacaaacattcatctactttccctcactactgatcatctcaataagtggtctttttagtcttgtttccttcacttaagctgttttcaaatttcttccattctctctctctgtttttttttgttgttgttgtttagatggagtcttgctctgttgcccaggcttgagtgcagtggtgcaatctcggctcactgcaacctccgcctcctgggttcaagcgattctcctgcctcagcctccccagtagctgggattacaggcgcatgccactatgcccgataatttttgtgttttttagtagagacggggtttcaccatgttggccaggctggtctggaactcctgacctcatgatccatccacctcggcttcccaaagtgctgacattacaggcatgagccatcgcgcccgaccatgatatcttatctcttcgatataaattgggttatctatctttttgtttctaggttttaagagttctttatatgtactgggtattagaagtttctagataattgatatacaaatgtttcctcacattgtgtcaattggcttttcaagttcttgatagtgtatattgatgcaaaaagtttttaatttcaggaaagtccaatttatattttcttttgttaattggtgcttttggtggtatagctaaaaaatcattgccaaatctaaagtcgtgacgatttatccctatagtgtccctgaaggtttcatagctttagctcttacatttagaaatttgatacattttgacttatttttggatataatgtgaggcagaggactaaattcatccttttttttttttttttttttgagacggagtctcactctgtcacccaggatccttaaattttttctttcttttctttttttgagacggagtctctctctgtcacccaggctgtagtgcagtggcacaatctccgctgactgcaagctccgcctcccgggttcacgccattctcctgcctcagcttcctgagtagctgggactacaggcgcccgccaccacgcccggctattttttttttttgtattgtttagtagagacagggtttcgccgcgttagtcaggatggtctggatctcctgaccttgtgatccgcccacctcagcctcccaaagtgctggattactggcgtgagccacagcgcccggcctaaattcatccttttgcatatgcataaccagttgtctatgtactatttgttaaagactctattaattactcataaaatgacctgaataactttgtcaaaaatgaattgaccacaacgtctgggtttatttccagactctccatctcttccattaatcactgtgtgtattcttatttaattatcacactgctttgattactctagcttttctagtaagttttgaaatatagaagtgtgagtcttctaccttggtttttcttattcaaactttacattggttatcagatctctggcaatttaataggatctttagaatttgtgctccttttttacaaaaacaaacaatgctcattgggataataatgattgcattaaatttatagatctcagtgggtagtattggtatgttaaaaatattttgtcttccaacccactaccacaggatgtccttttttaaaatcaaggttatctttaacttcttctccaatattttgtgattttcaatgtataagactttcatctattaactattgtcctaaaaatatgattcattttgatgctattgtaaagggaattgctttcttaatttaattttcagattattcattgctagtgtacacaaataaaactacaactgatttttccgagttaatgttctatcctgctgtgcttgctagatactgttcactagctctaatattgttgttttctggatttttaagcattttttacaagatcatcgtatttgtgaagagaaataatttccattttttcttttcaattgggatgtattttatatatcttcattgcctgacgccctgggctaaaattttaagtataatgttcaatacaagtggcaaaagtaggtgttcttctcctgttcctgattttagaagcaaagctttcagtcgttccctcttgactatattattagctgtaggtttttaattaatgccccatatatcgtgctgagaaaatgatcttctaattatacattattaactgttttgagttgcttttctggagagatggactacagaaagtgtctactgcaccattgtcattgatgtcacttttgccatctgtttttgaatttactgaaacactcatgcttcttcaaaatgtgcctgacacaatagtcatacatgaaaaagtaaagttgttacagttagttacataggcaataagcagggcaggaaaggactctcccccacccaatagaaatgtcacatgatggttcagcaatgatcacattgtctccctaaaaatgataatttggtagcaagggagaggcaatctcctgatggcccacacctgataatattaaaagtgtgaactgaatgcaggccccagggagaagcagcttcttgggcatgcgtattaagacacaaaatggcgaaatatgatgttccgggtacatgccaccagaaaaaggaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccactcaggcacccacttggatctcttccaagggttctttctttcctttctttcctgttctaaagcctgttaaataaacttccactcctgctctgaatcttgcctcagtctctttttctgctttatgaccctcagtcgagttatttctttggaggaggcaaggactgaagttgctgtcgacctatatagatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaagaaagtaaataaacaaaaaataaaaaggaacggccgggcacagttgcttaagcctgtaatccagcacactggggggccgagacgggctgatcacatgaagtcaggagttcgagaccaccctgacccacatggtgaaaccccgtctctactaaaaatacaaaaattagccaaacgtggtggagcccatctgtagtctcagctgttcggggggctgagacaagagaatcccatcaacctgggagacggaggatgcagtgagctgagatcgtgctgctgcactccaggctgggcgacagagcaagactccatctaaaaaaacaaaaccaaaaaacaactctactagaaaatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcttactaactcttgctccaagggacagaacagaacacacacacccatcccccccacacacagcatctaatgtctcaggaaatccctgaagaatatgtaatgcatgggaacatgctgtgttctggtgttaaatgttgagaccatgagatgaaactgagtgatctcgatagggactgaacatagggactatgaggatcacgccatgtggagcatataggccaaggagtaatgaccagatggtccttactctatgacttaaaccaaatttttgcctacaatgcaacacatgaggctagaacatgaactctctggttgtccgagaggggaaccaggtcaaagaccaccaggatttgtaaactgtttgccaaagatcttccccaagtttcaaataaatttttcctaattgtaccttcatccacccagtttatcacctgaaggagacaatttgatgccatggaacttgctggacctgtaacagtgtgaagtaaatcatacccagatagtctcagtgaggagtatatttaatttctgaaagaacaagattcgtgaggagcatgggtggtttaggcctcattttgttttcagatggaaagaaaatagcaaaaattcaacagtaagacaaggtcgtaccaaactggacaaatctcctggtggccatgatccgtggggcctttgtctctgggtagcattttttcagacagaaaaggcgggagaagaaagctcctagacagagcttccaagaaaatatgaagcactactgccaccgtgaggaaatagtttgaagacagaatccgccattacagtattcttccctggaagcctcgctgtgggggaaggtctaatctatgctgaggtggaagaggattgggctccaggctaggtcttgttgccttctcctctaaggtcttaagagaggcctggacattggcggtatcttggtgtagaacctggagagtgaggggcttggagtgaagcagcagctgccaggcagtcctggcacaggaatttccggggcagggcctctatttccccagttgtttgctggacaacaggaacccactcaaacacacatgcaggctcttgtgggcatctgtctcctgttcctgccccttggagcaagagttggcaggctttcatgtgcttgcatcttgctacaggtctttgggtctctggtagcatcagtaccgtgtacaaggaacaggattttaccaagcgacattcacagtatttactttccttcactctccaggttctataccaagacactaccaatgtccaggtctttttttttttttgacggagtctcactgtgttgcctaggctggagtgcaatggcgagatctcggctcactgcaacctccccctcccgggttcaagcgattctcagcttcctgagtagctgggattacaggcgcctgccaccacatccgactaatttttgtatttttagtagagatggggttttaccatgctggccaggctggtcctaaactcccgacctcagacgatccgcccgcctcagcctcccaaagtgtggtctttgaggatagggcaaggatgagcagcatggagctcaagcctcttccccctccccacaggccagaccttctccaacaggtggaaggactgtcttcaggggaaggacattgacatggcttaggcatagggcgtagggcgttgcttaactatgtcctaacggtggcagtagtgctctagatgtgctaacaggtgtcgtggagccttcttctcccgcccttcttgtctgaaaaaacgccacccaaagacaaaggcacaaggaaacatggctgccttgctttttgcccagtttggagtcatctggtcttactgtggcaattttgcttttgttttccatctgaaatcaaaccaaggccgaaaccacccaccctcatcagaaatcttatttgttcagacatttaaaatcctcctaacctagtctatatgattacgatttacctcagatttataggtccagtactttccatggcatcaaactgtctccctcgggggataaatttggggatgaaagcacagcgataaaattgcttgaggctccgagaccaccaggatttacaaatcctggtggtctctattctggctccccttccagacaaccagggagttcttcatgttttagctcatgtgttgcattgcagacaacaatttggcatgaaccatagaggagggaccagatagctgtcattactgcatgccatatgcgctccacatggcatgatactcatactacatatcttcagttcctatcaaggttattcacagtttcatctcatggtctcgtcatttaacatcaaaactcggcatgttcccatgacactacatagtcttcaagtatttcctgagactttatggggtgtgtctgtttgtgtgtgtgtgtgtgtgcatgtgtattttataatttgtcttttagatataagtcttacagtattctcccactagttaattaaagaataatgcttgacaaagattgagaaaaatcaatgtactaataaagatggaaagcactacaatacaatttgtctaggcaataaataaataaatttggattatttccatgcactcccaggcttattaggaagaggaaattcccgcctaataaaagaatatatttccatgcatatattcccgcctaataaattttggtcagactggttgatctcaaaaaccctgtctcctgataagatgttatcaatgacaatggtgcctgaaacttcattagcaattttaatttcccctcggtcctgtgatctctccctgcctccacttgccttgtgatattctactaccttgtaaagtacttgatgtctgtgacccacacctattcgcacactccctccccttttgaaaatccctaataaaaacttgctggtttttgcagcctgtggggcatctcagaacctaccgacatgtgatgtcttccccagaagcccagctttaaaatttctctcttttgtactctgtccctttatttctcaagctggccgacgcttaaggaaaatagaaaagaacctacgtgaatatcggggctggttccccgatatatacacatcattttttttcttttttgagactaaaactctctctgtctcccagcaggagtgaaatggcgagatctcggctcattgcaacctccagttcaagcgattctcctgcctcagcctcctgaatagctgggattacaagtgcatgccactaggcctggttacttggttttttttgtttgttggttttgtttttttttttttttgagacggagtctcgctctgtcacccaagctggagtgcagtgatgtgatctctgctcagtgcaacctccgtctcccaggttcaagtgattctcctccctcagccttctgagtagctgggactaaaagcatatgccacctgcccggctaatttttgtgtttttagtagagacagagtttcaccatgttagccagaatggtctccatctcccaacctcgtgatctgcccgcctaggcctcccaaagtgctgggattacaggcgtgagccacctggaccatccccaattgttttgtatttttagtagacacaggatttcaccatgttggccaggctgttctccaactcctcaccgcaagtgatccaatcaccctggcctcccaaagtgctgggattacaggtgtgagccaccacgcccggctatatatacattcctaatttcatgcaaataacaaatctgtattgaaattgggtcacactctacactgtggtttggagcagatcaagtgtgtattttaacaaagctttcaggaggatgaattcatttgaatatcataaatggtaaatgttttcaacattgcaagccttcagtgtaaatgaaggtaactctgaaaaatatatgctcagaaacattcctttagaaatgtagacaccattcattttttgtttaaatttttacagatgcatcacaacgtgcgtattggctctctagaatacatacatgactatatgtttggtttaaggttatgacatgttagaagtagagtaaaatgcactgggcgcggtggctcatgcctgtaatcccagcactttgagaggccgaggcgggcggatcatgaggtcaggagatcgagaccttcctggctaacacggtgaaacctcgtctctactaaaaatacaaaaaattagccagacgtggtggctggcgtctgtagtcccagctactcaggaggctgaggcaggagaatggtgtgaacccaggaagcagggcttgcagtgagccgagattgcgccactgcactccagcctgggtgaaagagcgagactccacctcaaaaaaaaaaaaaaaaaaaagagtagagtaaaatacactttactttgttatttattatttatcttatggtgtggtaggtttaatccacaaggttcaacaatttgctattctccctaaatcagaggcaaggaatggctgtttacgaggatacagagaatgcaattaagattttatgatggctaaagggactacctggtgcaaatgaatgacatgtatccaacctaaatgggaatgataggctcattgcccctccacactatcttccattgcagaataaaccaatcaacctccttgtcactaccactggtacttggctaggtgtgatttccttgccaggcttctatccactgcccaggcacacagcctctattaaagatagttagcaaggggtgaataaaagatcacttagcctaaagaattctaggtttggggacaccagcatttctaccttcagatatgagacactgtcccataggtaggtctgtattcttccatgaaaatggtcaggtcaaactattcctccataggaggtagtttagcagatgtctaagtctactttaggtgaaatactctggggaggtaagatatcaagggtcatggagaaatgcttcccagagagtctccaagacacttgtgcatgccaatagcatttatgtatgcagatcatcattcaactagacaaagtcaaagatgtcaaaaaagctaggttaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactaaaataataaattctgaggaagaatgtcatgaggatcaagtcacccatacacttttagtcaccattttgattctcaattatgagtcataaagtatctagaggtctccacaccaaaggttggatatcttcattaggaaatagatttgaagctgctacagaaaatactagctaggatgcagtagataatgatttgctcaggcctaaacaatgccatacttaccaaggacatcgaacagaaaagagccacctatctgccctccttgagagaactgagatgacatcggcgtcctattatgacaaaagactttctcctgaacctataacgtcacagaagctgctggcttgtgcgctcagataattgcttaggccttccattgcatttttggccttcatcctctttagcatatcagctctcctaaaagatgatctggcccacataggcatctcagtgtatccttactgctctacagaggtccttctagctataggcaatggtggttagaattttagtgtattgaggaccatgtgagtgacgctgacttcagatagatggttcctggaattggcctgtcattgccagccaacactgctgctataaatgtcacagccccacaacacaaggacaaccaggttgcctaaagctcccaagggcatattcataacataaatgccccaagggtctgtacttggctgtatcattttctagccttgtccccactatgagaaaacaggccctgtcctctacttcctgtgccaaaacttcctggaagcagctggctcagtcctgctccctcactcagcagatacttcacggagactttgcatttgttcattgcttctgccaggcctcagagaaaaggataggaagatcaacttgtgtctcgggtctgttcagccttcactggcttttccttcaattgctagggctcacatggaggaaacgctcacggctttggatgctacgaaactgtttccgcacgatggcagtattgtacgggagaagccaactgactttgctctaggcgctattctcccgcccatcacatttcaaaaaaaggccaagaagagacaaagacaccagaaactagaactacttagcagtttgctcaatttgtgtaaacttattccactcttagcattttgcttttgttttccattggatattaaaccgaggtgtgatccactcaccctcatcaatcatctcctcttttcatgaactcagtatctgcacaaccaatcttctcatttatactcttcttcactcagtattatatctgctgtgttttcttacatcaaattgtcttatagtactggggcagacctcagggatccatgcctaaggaaacaacaaacaaacaaagaaatgttaacacctaaggtcttggagaagagcaaatctaggcaccaggccatgtggttcatttgtttttttttttgagacagagtcttgctctgttgcccaggctggagtgcagtggcgctatctcggctcactgtaagctccgcctcccgggttcacgccattctcctgcctcagcctcctgagtagcagggactacaggcgcccgccaccacgaccggctaattttttttttttttttttttttttttttttttttttttttagtagagacggggtttcaccgcattagccaggatggtctggatctcctgacctcctgatccgactgcctcggcctcccaaagtgctaggattacaggcgtgaaccaccgagcccggccaggccatgtggttcttgtcctgactccctacccaggttccctaggagttccatttcatgttctgatccaggcattgggccttatatgttgagtgggaggctgccatttagtggagctctaagataagggaccaggtagttctcaagcttgacagagacacagaacccgattcgaatggacacaaacacaggaatgactataaattttaatcagatggatcacaggattttgtctcatggtttcattatttaacgttggaacacaaacattttcctgtgtcattaaatggccatggcttaagactgccctataactttgctgtgtatatgtgttactgttttccagttaggattcagtcctatattttctcattagtaacaaaaaggtggaatttgcaaagaagtaaaaaaaaaaaacccatgtgctgatcaagagaaaagcagtctcataaaactgtatattaaacactgatacccttttccatatttattccatttttcaatacatagataaaaagttctatatatagtcaacacaatgaatttacatttaaattggatttagctatgcactgcattttagtatgaatattccatagtatgaatgaagattttcattctaaaatttgatttctgaccagtttttgacattgtcatataaaatttgcaatttctgaattttggacaataaaatatttgcaaagaactatgtgattggactagtcattaagaattaagatctcaccttgcttttttaatctataaaatctatttatacatacataaacacatatataaatatatatattttacatagttatgcctctgaaaattaggattttaaaattattcttgaatttttatctctaattcttaccttcaaattttatctttaaaatctcaaaagaaagaaaacaaaattcaataaatgataattgaaataggcacatctcatattcagtcacttagatgtgaaccccagtaaaactttaagatggatgtattcacaccactcacatgaagctataatgtttcattaatgtctctgtttatgtaactatgaattaaagatatgaatttattggtcaaaaatatcatattcaaatgcatgctcagtataacactgaccatgatataaaatatatggcattggccaggcgtggtggctcacaactctaatcctggcactcttggaggctgaggcaggaggatcacttgagcctgagagttcaagaccaatttagtaattagcaattttggcaatgtagcgagtccctgtctctaaaaaaaaaaaaaaaaaaaaaaaatagccaggcatggtgtcatgcacctgtagtcccagctactcaggaagtggaggtgaaaggatcacctgagtccagggaggttgaggctgcactgagccatgatcctgccactgcactccagtctgggcaacagagtctgatcctgtgtaaaaaaaacatatatatggtatttaaacatttgtatatgcatatgaacagatatgaatacacacagagtaccgcacacattttactttcaatataactggattcatactatttgaaatttggtccaaaatcctcagcatcaccttataatctttgaatatatccatatcaatatatacttctgagtgcttgagtttttttatattttactctagaagaattttaagaattataagcagaaaacatatggtaggtcaaacacagtgagaagaaataatcacttttaaaatgtttgggctacgtattatgatttgttcctttgcacatataatatgtacatttataaactaatgttcaaattcccctgtagtataattgttaaaacaagttgttaaaaccctggacccatgaagcagtcattccccatgccactctatgccgagcccctggcaaacactcatctgctttccctcactactgatcatgacaataaggggcctttttcattttgcttttttcacttagcatgttttcagatttcatccatgttgtaactgataacttgagtacttttcaaatataattagttattcctggaaataatgataggtttaaaaatattggcactttttaaaactgtgttggtataattcatgtaacatataattaaccattaaaatgtgtgaaattcagcggcatttagtacattcacaatgcagtgcaagcactaactctgtgtagtggcaaataattttcattaccacaaaagaaaaccctggacccatgaagcagtcattccccatgccactctatgccgagcccctggcaaacactcatctgctttccctcactactgatcatcacaataaggggcctttttcattttgcttttttcacttagcatgttttcagatttcatccatgttgtaatatatgtcagtacttcatttctttttgtagctgaataatatccatatgtatatatcacattttgtttatccattcatcaagtgattgatgtttgcttgtgttcaccttttgggtattgttaataaatatatacagtgagtatatacatgtacttttttgagtatttgttttcaattgtttgcggagtatacttaggagtagagctgctaggtcatacggttatttctatgtttaaatttttgaaggactgataaacttttccatagcagatgcgcaatttagcatacccaccttcactgcagaagggttccaatttctccgcctccccacccatatttgttctttttaagtaatatccattctagtgggtgttaagtggtatcatgaagtggttctgatttacatttctgaaaacactaataatggaagtatgttttcatgtaattgttggtcatttgtgtatcttctttggagaattgtctatttaagacctttgcctattcttaaaattgatgcattatagttgtacatatttatggggtacacatggtattttgatgtatgcataaaatgtgtgataaccaaaaaaggaaaactgggatactcattccctactgcatttattatttgtgttcgggaacatttcaaatgtgttttatctatttggaaataaccattaaattattgtcaactatagatgtcctaactgtgctgttgaacactagaacttactccttctgtctaactgtatttttgtagccattaacaaacctgtcttcattcccctctcttcctaacttctggtacccaccattctactctatacataccatgagatggattcctttagctcctacatatgagtgaggacatgtgataatttgtctttctgtatctggcttatttcacttaacatagtgtcctaaagttccattcatgttgctgcagatgacagaattccattcttttttctggctaaataatcttccattttatatgtatgccacagtttcttaatccattcatccattaatgaacagttaggttgattccatatcttgactactgtgaataatgctgcaataaacatgagaatgcatatatatatatatatagtactgatttcccagcagtgggattgctacatcatatggtaattctatttttagtatttttgggaaactccatcctgtgtctcatagaggctgtattaatgtacattgcaggcaacattatacaagcattcctctttctctgcttactagccaacacctgttactctctgtcttttttgtaagagtcatttgagctggggaaatacggtaccccactgtagttttgatttacatttccctgatgattagtgatgttgagcattttttcatgtatccgttagccatttgtgtgcctttctttcagaaatgtctattcagatcatttgcccatttgtaaatcagatatatttgttttttttctattgagctgagcttttttaagtttgcaaatatattctctcttactgtaggttgtctcctcactttattgttttctttgctgggcagaagcgttctagcttgatttactctcatttgtccatttttgctttgattgccagtgctttttgaggtctcccacaaaaaaatcattgcccaaaatgatgtcttaaagcatttccgcagtctcttcttctggtactttcatattttcgggtcttttcttatatttgttgagccttgttctgtggcctaacacatgctctatactggagcgtgttccatgtgctgactgatgacaagaatgtatattctacagcaattggatgaaacattttgtaaatgtcagttaagttcatttggtctagagtacagtttaattccaatgtttctttgtctggataagctgtccattactgaaagtggggtactgaagtctcccactattgttgtacacctgtctatctctccgtttagatctccaaatgtttgccttatctatttgtgtgttccagtgttgggtacgtacatattttaaattgttatatcctcttactgaattggcatcttcattttttgttttgttttgttttttttgtttgtttgttttttgagtctggctctgtcgcccaggctggagtgcagtggcgcgatctccgctcactgcaagctccccctcccaggttatgccattctcctgcctcagcctctggagcagctgggactacgggcgcctgccaccacgcccggctaatttttgtatttttagtagagacgggatttcaccgtgttggccaggaaggtctcgatctgctagcctcatgatccgtccgcctcggcctcccaaagtgttgggattacaggcgtgagccaccgcgcccggccggcatctttattgttatacagtgaccttctttgtctctctctacagtttttgactttaatctaatttatataagtctagcctttcctgttctttttccattcctgttcattttcatgttgttgctgatgtcccgctctggtttgagatcttctttgcctgagtaaaagagaagtccccagatttaatgcactggggttgctagcttcaactccactttcagtctcagactaccccctcagggatttttcctcctacaggcagtcaggatgcctcctagggattgaggcaagaataggatccctgcaaaggacaccaaaatgggagagaagctagctctctgccttgatctcacattttacagaggaaactgtgaaccaaggggtacttttctttttttcttttcttccttttttttggtgggggggggagcagggggatggaatctcactctgtcacccaggctggagtgcagtggcgcaatctgggctcactgcaacatctgcctcccaggttcaagtaattctcctgtctcagcttcccgagttgctgggattataggggcacaccaccacgcccggctaatttttgtatttttagtagagacggggtttcaccatattggtcagtctggtctcaaactcctgacctcaggtgatccacctgcctcggcctaccaaagtgctgggattataggcgtgagccaccgcgcccagtcaagggggacttttctacatggtgcctagcagccttgggttggggagtcatggagagagaagtccattagtctttctagctgctcatactttttcacttccttatagccccatggatagtcacagtctcaatgttcagttctggaatattgcttctagtaatcttgtctctacacagctgtttttacttttctttgaggtaaagtcagatcacttctgctataccatgttggtgatatcactctccctttgcctattttttaaaaattgggttatttgtctgtttattgttgagttttaagagttatttgtttttattggatattagaagtttttagataattgatttggaaatatttcctcccattctgtaagttggcttttcaagttctgaattgtgtactttgatgcaaaaagtttttaatttcagggaagtccaatttattttttcttttgtcattgctgcttttggtggtatagctaataaatcattgccaaatctaaagttgtgaagatgtatccctatagtttccctgaaggttttatagctttagctcttatatttagaaatttgatatattttgagttaatttttgcatataatgtgaggtagaggtctaaattcatccttttgcatgtagataaccagttgtctaagtactatttgttaaagactctattaactactcataaaatgaccttaataactttgtcacaaatgaattgaccacagtgtctgagtttatttccaggctctccatcttttccattaatcactgtgtgtattcttatttgattatcacactgctttgattactccagctttcctaataagttttgaaatccagaagtgtgagtcttccaccttggtttttcttattcagagtttacattggttattcagatctcttgcaattcaataggatctttaggatttgtgttccttttttacaaaaaaaatgctcattggataacaataaggattacattaaatctatagatctctatgggtagtattgccacgttaaaaatatttagtcttcagacccattaccacaggatgttctttattaaaatttaggttatctttaacttctccattattttgtgattttcagtgtacaagactttcatctatttagttaattattgtcctgaaattatgattcattttgatgctattgtaaatggaattgctttcttaattgaattttcagattattcattgctagtgtacacaactactactgatttttccaagttaatgttctgtcctgcagttgcttgctggatcttgttcactacctctaatactgtttttctgggtttttgagcttttttttttttttttgactggagtcttgctctgtcgcccagactggagtacaatggcacgattccggctcactgcaacctctgcctcctgggttcaaacgattctcccacctcagcctcccgagtagctggaattacaggcacccgccatcatgcccgggtaatttttgtatttttgtagagacggggtttcaccatgttggccaggctggtcttgaactcctgatcttaggtgattcacatgcctcagcctcccgaagtgctgggattacaggtgcgagtcactgcgcctggcagcattttttataagatcactgtatttgtgaagagaaataatttccattttttcttttcaactgggatattttttatatatcttcattgcctgatgaccccagctagattttaagtataatgtttaagagaagcggcaaaagtgggcatttttctcctgttcatgattttaggagcaaagttttcagtctacctcttgactatattattagctgtaggttttaataaatgccccatatatcgtgctgagaaaatgatcttctaattacatattatagattgttttgagttgcttttctggagagatggactacagaaagtgtctactgcaccattgtcattgatgtcacttttgctacctgtttttgaatttgtaggaacactcatccttcttcaaaatgtgcctgacaaaatagtcacatatgaaaaagtagttacagatagataggcaatgagcacggcaggaaagggctctccctgacccagtaggaatgtcacatgatggttcggcaatgatcacattgcccctctaaaaatgataatttggtagcctgggagagacaatctcctgatgatccacatctgttaatattaaaagtacgaattgaatgcaggccacagggagaagcagcttcttgggcatgcgtattaagacacaaaatggcgaaatatgatgttccgggtacatgccaccagaaaaaagaaaaaagcctcagatgggcatgtgtataactccctaaacacactgcacagtgctcaattccaaagggtaaggagggcactgcgcatgcggaaagctcaccctaaaggaagaatcatgagcaagaggtaagcctataaggtcccatgatcaaggttaaaaggtctttttgttctcttggccattcaggcacccacttggatctcttccaagggttctttctttcctttctttcctgttctaaagcctgttaaataaacttccactcctgctctgaatcttgcctcagtctcttttcctgctttatgctcctcagtgaagttctttcttctgaggcgccaggactgaagttcctctggacctatatggatatgccgcctgttactcggggtaactcggttcactgccaccgctaacaaagtgagatcatgggtaatgctacctcccacagacaagcacttttaaaatgtggattaattttcaatccttttcactccttttgtttcccatccctttatgtgtaacaactccactaaataaataaataaataaatagaatggccgggcacagtggcttacgcctgtaatccagcacattgggaggccaaaacgggatgatcacctgaggtcaggagttcaagaccagcttggcccacatggtgaaaccccgtctctactaaaaatacaaaaattagccgaacttggtggaacccacctttagtcccagttgttcgggaggctgagacaagagaatcccttcaacctgggagacggaggatgcagtgagctgagatcgtgctgctgcactccaggctgggcgacagagcaagactccatctaaaaaaacaaaaccaaaaaacaactctactagaagatgtaaaactttaggtcctttcagtctttagacaactagatgcccttgagactatcagcaaacatactggctcctgctttatcacacctggaacaggcctgtctttggtgttctcatactgctgcaacaaaggactgtgatacagtaacactgcctgaaagcctgctaactcttgctccaagggacaggacagaacacacacacccatcccccccacacacagcatctaatgtctcaggaaatccctgaagagtatgtaatgcatgggaacatgctgtgttctggtgttaaatgttgagaccatgagatgaaactgagtgatctcgataggaactgaacatagggactatgaggatcacgccatgtggagcatataggccagggagttatgactgctatctggtccttactctgtggctcatgccaaattgttgactacaaacaacacttgaggctagaacatgaagaactcctagttttctgggagggaaaccaggtcaaagaccatcaggatttgtaaattgtttgccaaagatctcttcctagtttcaaataattttttccttattgcacttttatccaccaagtttatcacctgaaggagacaatttgatgccatggaacttgctggactgtaactgtgtgaagtaaatcctatccagatggaacttgctggactgtaactgtgtgaagtaaatcctatccagatagacacagtgaggagtatatttaatttctgaaagaacaagattcctgaggagcatgggtagttcaggcctcattttgttttcagatggacagaaaaatagcaaaaattcaacagtaagacaaggttgcaccaaacaggacaaatctccatgcagccagatttggtggcgcctttttcctctgagtggcgttttttcagacataaaaggcgggggaagagtgcgccaagatagggcttccatgaaaaatgtgaatcactactgccaccgtgaggaaattgtttaaagacagaatccgccatcacacactccttcccaggaagctatgggggaaggtctcaattgggccgaggtggaagaggattgggctccagactaggtcttgttgccttctcctctcaggtcttaagagagctctggacattgacggtatcttggtgtagaaactggacagtaaggggcttggagtgaggcagcggctgccaggcggccccggcacaggaagtcgggagcggggcctcggttcctcctggtttgggcaggacagcaggaacccactcaaagtcgaattcttgctcttgtgggaatctgtctcctgttcctgccccttagagcaagagctggcgggctttcccatggtgtcatcttgctacaggtctttgggtctcttgcggcatcagtatccgcccacaattgacagggttcctccaagggaaatttacaggatttgctttccttcactatccaggttctataccaagacaccgccaaagtccaaatctcttttaaggcgttagacgagaaggcaaggaggatcagcatggatcccaggccttttctacctccccacagaccagaccttctccaacaggtagccctcaggggaaggacgttgacgtggcgtagggtgtctttaaactatcaccttacgatgggactagtgctctagatgtgccaagatgtgtcttggattccctcttctcccgccctccctgtctgaaaaaacgccacccagacacaaaggcacaagaaaatatggctgccttgttttttgcccagtttggagtcatctggtcttactgtgtcacttttgtttcccatctgaaatcaaaccaaggcctaaaccacccaccctcatcgggaatcttactccttcagaaacttaaaatcttcctaacctagtctatatgattatgaattacctcagacttacaggtccagtagtctccatggcatcaaactgcctcctcaggggataaatttggggatgagggcacaaggataaaactgcttgaacctcagaggagatcttttccagcaaacaagttacagaccttggtggtctctgacctggctccccttcccgacaaccaggaagttcttcatgttctaccgcatgtgttgcattgtaggcaacaatttggcaagaaccatagaggaggaaccagaaagctgtcattgctacatgccatatgtgctccacatggcatgatactcatactacatatgttcagttcctgtcgaggttactcagagtttcatctcatggtctcatcatttaacatcaaaacacggcatgatcccatgacactacatattcttcaggtatttcctgagactttaagtggtgtgtctgtttgtgtgtgtgtgtgtgtgtgtgtgtgtgtgtgtctatttttaaataatttgtattttagatataagtcttacagtattctcctactggttaattaaagaataatgcttgacaaagattgagaaaaatcaatgtactaataaagatgaaaagcactacgatacaatttgtcaaggcaaaaaataaccatttggattatttccatatatataatatatatatggagtatttccatatatataaaatatatatatggagtatttccatatatataaaatatatatatggagtatttccatatatataaaatatatatatggagtatttccatatatataaaatatatatggagtatttccatatatatataatatatatatggagtatttccatatatatatatatagaaatatatacatatatatatacacatagagaaatatatacatatatatatatatatatatatatacacacatacactttttctctttggggggagcgaaactttttctgtcacccaggctacagtgcaacggcgcagtctcggctcattgcaacctccaggttcaagcaaatctcctgcctcagtctccttagtagctgggattacaagcgcaggccaccagacctgattaattgttctgcatttttagtagacatggggtttcgccatgttggccaggctggtctcgaactcctgacctcaaggcatccaaaatccttagcctcccaaagtcctgggattacaagtgtgacccactgcacccagctatagatacattcctaatttcatgcaaataataaatctgtattgaaattgggttacactttacattgtagtttggagcagatcacatgtatattttaacaaagctttcaggagcatgaattcatttaaatatcatcaatactaagtgttgttttcaacatttcaagccttcaatgtaaatgaaggaaaatctgaaaaatatatgttcaaaaacattcctttagaaaagtagacagtatttatttatttataattttttttttttgagatggagtttcgctcttgttgcccaggctggagtgcaatggcttgatctcggctcaccgcaacttctgcctcccaggttcaagcgattctcctgcctcagcctcccaagtagctgggattacaggcatgcgccaccaggcccggctaaatttgtatttttattagagatggggtttctccatgttggtcaggctggtctcaaactcctgacctcaggtgatctgcccaccctggcctccctaagtgctgggattagaggcgtgagccactgcacctggccaattttttgtttaaattataacagatgcatcacaatgtgcattttggctctctagaatacatatttgactacatgtttggtttaaggttctgacatgttagaagtagagtaacatacactttactttgtcatttatcttaccgtgtggtaagtttaatcctcaaggttctataatttttcttttctccctaaatcagaggcagggaatggctgtttatgaggccacagagaatgcaattaagatcttgtgatgggccaggcacggtggctcatgcctgtaatcccagcgctttgcgaggccaaggcaggtggatcacaaggacaggagttcgagaccagcctggccaatatggtgaaaaccccgtctctactgaaaatacaaaaattagctgtgtgtggtggcgcatgcctgtaatcccagctacttgggaggcagaggcaggagagttggttgaacccgggaggcggaggttgcagtgagctgagatcatgccagtgcactccagcctgggtgacagaaggtgactccgcctcaaaaaaaaaaatgtgaaggataaagggactatctggtgtagatgaatgacatgtacccaacctaaatgggaatgataggctcattgcccctccacactacctttcattgcagaataaaccaatcaacctccttgtcactaccactggaacttggctaggtgtgatttcctttccaggcttccatccactgcccaggcacatagcctctttattaaagatagttagcaaggggtgaataaaagaccacttagcctaaagaattctaggattggcaccaccagcctttctaccttcagatatgaggtactgttccataggtaggtctgtattcttccatgaaaatggtcgagtcaaactattcctccataggaggcagtttagcagatgtctaagtctattttaggtgaaatactctggggaggtaagatatcctttttgtcctttccaggaacaaggatcatggagaaatgcttcccctagcgtctccaaggcattcatgcatgccaatagtatctatgtctgcagatcatcattcaactcaacaaaaccagctagagagagagctagacacagtcaaagatgtcaaaaaagccaggctaccctagaatgccttaccctggaatgcctgcctgaatcctcagaggccaggagaggtcatacctgaacaagctcttgaagcactgtaatgtcacagtgcagaaccagactaacattaattcctttcattaagaattcagatactgaaataataaattctgaggaagaatgtcatgaggaataagtcacccatacaattttagccactcttattgattcctcaattatgagtcatagagtttctggaggtctccacaccaaaggttgtatgtcttcatcaggaaatagctttgaagctgatacagaaaatactagctaggatgaggtaaataatgatttgctcaggcctaaacaatgccatccttctcagggacatccaacagaagagagctacctatgtggcctccttgacagaaatgagatgtcatcggggtcccattatgacaaaagactttctcctgaacttataaagtcacagaagctgctggcttgtgcgctcagataattgcttaggccttccatcacattcttggccttcatccacttcagcaaatcggctctgctaaaagatgatctggcccacataggcatgtcagtgtatcctcactcctctatagaggtccctctagttgtaggcaatggtgtttagaatttttgtgtatcgaggaccatgtgaatgacactggcttcagatagattgtccctggaactgtcctgtccattgcaatctaacgatgctgctataaatgtcacagctgcataacacagggacagccagattgcctaaaactcccaagggcatattcataacataaatgccccaggggtctgcacttggctctgtcatcttctagtcttgtccccactatgaggaaactgaggccctgtcctctatttcctgtaccaggagttcctggaaacagttggcttagtcctggtccctcactcagcagatacttcactaagactttgcatttgtctattgcttatgctaggcctcagagaaaagggtaggaatgccaacttgtgtcttgggtggcttttccttccgcaactgctagggcttacatgcaggaaacgctcacggctttggacgctatgaaactatttccgcacgatggcagtattgtacgagaaaagccaactaactttgctccaggagctcttctcccgcccatcacgtttcaaaaaaaaggccaagaagagacaaagacaccagaaactatggctacctaacattttgctacatttgcgtaatggtattccacttttggcttctgctggatattaaactgaggtgtaatccactcaccctcatcaagcatctcctcttttcaagaactcagtttccgctcaaccaagtcttcccatttctactcttcttcactcagcattgtttctgcagtgttctattatgatatcaaattgtcttgtcgtattggggaccgacctcagggatccatgtctaaagagaaaggaaaaaaaacatgttgacatctgaggtcttggaggacagcaaatctgggcaccaggccacgtgtttcttctcctgactccctacccaggttccctgggaggtttactccatgttcagacctagtcagtaggccttgtatgttgagagggaggtcgctatttagtggggctctaacataagagtccagatagctctcaagcttgacagacacacacaaccctacttgaatgtacataaatacaggaatgactataaatgctaatcagatggatcccaggattttgtcttacagtttcattatataacagtgtaacacaaacattttcctgggtcattaaactgcaatggcttacaactatgtcctatgagtttgctgtgtatgtgtgttactgtttatcagttaggaatcagtcctgtattttcacattagtaacaaagaggtgggattcgcaaagaagctaaaaaaaatgtggtgatcaagagaaaagcaatgccatacaactgtgtattaaacactgaaggctgggcgcggtggttcacgccaataatcccagcactttgggaggccaaggcaggcggatcacttgaggtcaggagatcgagaccagcctgaccaacatggcgaaacctcgcctttactaaaaatataaaaattagctgggcgtggtgtcacatgcctataatctcagctactcgggaggctgagacaggagaatcgcttgaaccgggaggtggaggttgcagtgagcaaagatcgcaccattgcactccaggctgggcaacaagagcgagaatccgtctcaaaaaataaaaataaaaaacactgataccctttttcgtatttgctcccactttcaatacatagataaaagttctatatatacagtcaaacagtcaaacaccacagtaaatttacatttaaattggattcaggccaggagcagtggctcatgcctgtaatcccaacattttgggaggccgagtcgggcggatcacttgaggtcaggagtttgagaccagcctgggcaccatgttgaaatgccgtgtctactgaaaatacaaaaataagccaggtgtggtggcgagtacctataatcacacctactcggaaggttaaggcaggagaatcgcttgaatccgggaggccaaggttgcagtgaactgacatcacaccactgcactcccacctgggcaacggagggagggcctgtctcagaaaaaaaaaaaaaaaaaaaattggatttagctatgtattgtaaagtaaaaattttcattctaaaatttggttcctgaccaatttttgacattgtcatataaaatttgcaatttctatattttagacaataaattatttgcaaagaacttcgtgattatactagtcattaaaaaataagttgtttgctctttttaatctaaaaatgtgtttatatgtatataaacacataaatatttacatatcatataaatatgtatattatacatacttatacctctgaaaattaggattttaagattattcttgagattttagctctaattcttaccttcaaattttatctttaaaaactcaaaagaagcaaaacaacatccaatacatgataattgaattaggcatctctcacattcagtcacttagatgtgaaccctaagaaaactgtaagatggatgtattcacaccactcacatgcagctacaatgtttcattaatgtctgtttatataactatgaattaaagatatgaatttgttggccaaaaatatcatattcaaacatatactcactataacactgaccatgatttgaaatatatgccattggctgggtgtggtggctcgcgactgtaatcccaacattttgagaggctaaggcaggaggattgcttgagcccgggagtttgagaccatctcgggcaatttagtgagaccctgtctctacaaaaaatacaaaatatacctgtgcgtggtggcatgcacctgtgggcccagctacacaggaggtggaggtgagaggatcaccggagcccagggaggtcgtggctgctgtgagccacgatcatgccactgcactccagcctggatgacagggcgagaccctgtctaaaaaaatatatatatggcatttttaaatctgtatatgcatataaacagatatgaatacacacagtcccacacacattttacattcaatataattggattcatactgtttgcaattttgtacaaaatcttcggcatcaccttataatctttgaatatatccatatcaatatatacttttgagtgcttgagtttttttatattttactctagaaaaactttaagaaattacaagcagaaaacatatggtaggtcaaacctagtgagaagtaatcacttttaaaatatctatgctatgtattatgatctctttcctatgcacatataatatgtacatttataaactaatgttcaaattcccctgtagtataatcattgaaacaagttttcttcactgataacttgagtacttttcaaatgtaattaattattcttggaaataatgataggtttaaaaatattggcactttttgaaactgtgttggtaaaattcatgtaacataaaaataaccattaaaatgttcaaatttggtggcatttagtacattcacaatgcagtgcaagcactacctctgtgtagtggcaaataattttcattaccacaaaagaaaaccgtgaactcattaagcagtcattccccattccactctctgcccagctcctagcaaacactaatctactttccctcactactgatcatcacaataagtagccttttttctttcttctttcacttagcatgttttcaaatttcatccatgttgtaatatatgtcagtacttcatttcattttgtagctgaataatatccatatgtatatatcacattttgtttatccattcatcaagtgatggatgtttgcttatgttcaccttttgggtattgttaataaatatatacagtgagtatataaaagtacttgtttgagtatttgttttcaatcatatgtggtgtatacataggagtagagttgctagctcatatggttccttctatgtttaaatttttgaagtactgataaactgctttctgtagcaggtgcacaatttagcatttccaccaacactctagaagagttctaacttctccacctctccactgatatttgttctttttaagtaattcccattctagtgggtgttaattggtaccatcaggtggttttgatttacgtttctgaaaagactaataatggaagcatctttcatagaactgttggctatttgtatatcttctttggagaattgtatatttaagagctttgcctatttttaaaatttgcatataattgtacatatttatgtagtacatatattttcatgcatccacaaaatgtgtgataaccaaaaaaggataactgggatactcatcacctaatgcatttattatttgtttgtgttggaaacatttcaaatgttcttttaggtatttggaaataagcattaaattattgctaactatggtcgccctaagtatgctattgaacactagaacttactccttctgtccaactgtatttttgtagccattaaccaacctctcttcattcccctcctttcctaacttctggtatccaccattctactctatagttccatgagatggattctttcagctcctgcacatgagtaaggacatgtgataatttgtctttctgcatctggcttatttcacttaacgtagtgtcctacagttccattcatgttgctgcagatgacaggattttattcctttttctggctcaataatcttcctttttatatgtatgtcacattttcttaatccattcatccgtcagtgaacacttaggttgattctatatctttgctattgtgaataatgatgcaataaacatggcaatgcatatatctctttgctgtactggtttcctttcttttgaatatatactcagcagcgggattgctgcatcatacggtaactctatttttagctttttggggaaactccatcctatgtcccatagtggctgtattaatatacatttacagcaacagtatacaagcattcctctttgcttcctagccagcaactgttattctctgtctttttagtaagagccatttgaactggggtaatatggtatctcacatggttttgatttgcgtttccctgacggttagtgatgtttaacgtattttcatatatctgttggccatttgtgtctttgtttcagaaatgcctattcagatcatttgcccatttgtaaatcagataatttggtttttggttattgagctgagtttgttttacattgtgatttgttattccattgttagatcaatagtttgctaagatattctctctttctgtaggttgtctcctcactttgttgttttctttgctgtgcagaagctttctagcttgatttactctcatttgtctattttcgctttgattgccagtgcttttcagatcttatacaaaaaatctttccccagaacaatgtcttaaagcatttccccaggctcttattctagtaatttcatattttcgggtcttttcttaaatttgtttagccttgttctgtggcctaacatatgctctatactggagaatgttccatatgctgatgacaagaatgtatattctatagcaattggatgaaatattttgtaaaggtcagttaagttcatttggtctagagaacagtttaatttcaatgtttctttgtctaattaagctgtccattactgaaagtggagtactgaagtctcccagtgttgttgtacgccattctatcactctgtttagatcttcaaatgtttgccttatatatttctgtgttccagtgttgggtacatacatatatacaattgttatatcctcttgctgtattggcattttcattgttatacagtgaccttctttgcctctctttacagtttttgacttttaatctattgtatctaagtatgacctttctctctctctctctctctctctttctttctttctctctctttctttctttttttttttttgagatggagtctcgctctgtggctcaggctggagtgcaatggcatgatctcggctcactgcaatctctgcctcctggattcaagggattctcctgcctcagcctcccaagtagctgggattacaggcgtgtgccaccacgcccagctaatttttgtatttttagtagagacagggtttcaccatgttggccaggctagtcttgaactcctgacctcaggtcatccgcctgccttggcctcccaaagtgctaggattacaggcgtgagccaccatgctgggccagagtatagcctttccggttcttttttcattcctgttcattttcatgttgctgctgatgccctctctgatttgaggtcttctttgtctcagcaaaagacgagtccccaaatttaatgcactggggttgctagcttcgactccactttttgtctctagctgccctcagagatttttcttcctacaggcagtcaggatgctttctagggagtgaggcaagaacagcattcctgcaaaggacaccaaaatggtagagaagctagctgcctgcctggatctcacattttacagaggaaaccgtgagtccagggggaattttctacatggtgcctagcagctttgagttggggaatcacagagacagaagtctattaatctttccagctgctcatatgtattcactttcttgtggacccacagatcgtcatagtctcaattttcagttctgcaatattgcttgtgacaatcttggcactagacagctatttttagttttctttggggtaaagtcagattgcttccactctaccattttggtgatgtcactctcccttggcctattttttaaaaattgggttgtcttttgttgtttttaagagtcctttatatgtattggatattagcagtttttagataattgatttggaaatatttcctcccactccgtaagttggcttttcaagttctgaattgtgcactttgatgcaaaattttttaattccagggaagtccaatttattttttcttttgttattggtgcttttggcggtatagctaaaaaatcattgccaaatctaaagttttgaagacttattcctatagtttccctgaaggttttatagctttagctcttacctttagacatttgatacatttcaagttaatttttgcacatgatgtgaggtagaggtctaacttcatccttttgcatgtggataaccagttgtctaagcactatttcttaaggagtctattcacgtctcattaaatgaacttgataactttgtgaaaagtcaattgaccacaatgtctgggtttattttcagactcttcatctcttccattaatcactgtgtgtattcttatttgatcatcagcctgctttgattactctagattttctagtaaattttgaaatctagaagtgtgtcttccaccttggtttttcttactcaaagtttggttactcagatctcttgcaatttaataggatctttagaatttgctctttctttttcccaaaaataaatgctcatgggaataataattaggattacattaaatctgtagatctctatggctagtattgccatattataaatatttagtcttctaactcattacccacaggatgtcctttttaaaaatccaggtaatctttaagttcttctccaatattttgtgatttttcaatgtacaagtctttcatctgtttagtgaaatattctccttaaaatatgatttattttgatgctattataaatggaattgctttcttaattcaattttcagattgttcattgctagtgtacacaactataactgatttttacgatttaatgttctatcctgtggggcttgctgaatattgttcattagctctaatatggtttttctgcagtttaaagcatttttataatatcatcatctttatgaagagagataatttccattttttttttcttttttttcttttcaacttggatgccttttatatatcttcattgtctgatgaccctgactagaattttaagtgtacaagaaaagggcaaaagtgtgcattcttgccttgttcatgatcttgggaggaaagctttcagtctttcactcttgagtataatactacctgtagattttttataaatgccccatatatcgtgttgagaaaatgatcttctaatgatagattcttgattgttttgagttgcctttccagagagagggactacagaagttccctaatgcatacttttcattgatgtcactttcgccacctgtttttgaattcgtagaaacaatcatgcttcttgaaaacatacctgccacaatagtcatacatgataacgtgaagtgagatcacgggtaatgccatctccaacaaatactattaaaatgtagattgattttcagtccctttcactgtttttggtttatgtgtttatgtacaacagtccactagaagaagatgtaactcttccttgattagctcagtggttcaatttctctttatgcccttctagtcttcagacaattgggtgcccttgagaccctcagaaaacttacttgctcctgctacatcccacctggaattggtctgtccttggtgttctcacattgctgcaacaaatgactcatgcctcacagcagagtgacactgcctgaaagcctgctaactcttgctccaagggagaaacataacgcacccatccattccccacgtaggcaccgtgtaaagtctcaggaaatacttgaagtatatgtaacacatgggaatgttgttattttggtgttaaatgatgcgaccatgagatataactctgtgtaacctcgacaggaattgaacatatgcattatgagtatcattccatgtggagtatatgtggcgggcagcaatgacaactatcggatccctcctctatggctgatgccaaattactgcctatagtgcaacacatgaggctagaacatgaagaactccctggttgtctgggcggggagccagatcaaagaacaccagaatttgtaaattgcttgccagagaagatctccaagtttcaagtaattttctccttgtgccttcatcccctgaaaaagataattttataccatgaagtgtactggccccttaactctgtgaaataaatcgcaccctcaaagtcttggacaggaggatatttaatttctgaaagcacaagattcttaatgaaggcgggccttgtttgatttcaagtggaaaacaaaagcaaaagtgcagcggtaagaccagctggccccaaactgggctaaatgcaaggcagccatgtttggtggcgcctttgtggatgcgtggcgttttttcatacaggaagggcgggagtagagggcgccaagaccagactacttagcatatttggagcactactgccatcgtgaggatgtcgtttaacgaaaccctacgccattacagagttctagtgtgggctacctgttgggacaggtctggtctggtaagaggtggaagaggcttggcctctatgctgggaggcctcgcctactcctctaaggctttaaaaaagacctggacattggcggtatcttgctatagaacctggagtgtgaaggttctaatagcaaatcctgtaaacttcccttggaataaccctgttaattgtgcgcaacactcatgctaccagagacccaaagatccatagcaagatgacagctcgtggaaaacttctgactcttgctccaaggggcaggaacagcaaagagatgcccataagagcctacatgtgtctttgagagggtttctgctgtcctgcccacaccaggaggaactgaggccccgacccacgacttcctgtaccaggacctcctggcagctgctgcttcactccaagcccctcaatctccaggttctacaccaagataccgccaaattccagttctctcttcaggccttagaggagaaggcaacaagacctagtctggagcccaatcctcttccacctcctcacagaccagactttcccccacagcgaggcttcccgggaaggacgctgtaatagcctattctgtctttaaacgatttcctcacggtggcagtagtgcttcagattttcaaggacgccctgtcttggagcagtcttctcccgcccttcctgtctgaaaaaacgccacccagagacaaatgcgccaggagacatggctgccttgcattttgcacagtttggggcaacctgtgcaaattcctgtacttttgcttttcttttccatgtgaaatcaagtcaaagcctaaacgacccatcctcatcaggaatcttgttctttcaagaaattaaatgttttccagacttagtctatgtgggttggctcagtactttcacatggtatcaaaatgtctgtctcaggccggaaattagaccgatcagagaagaaaagcgataataaatggtcagaagcctggagatcatcatgagccaccaattcacaagtctaggtgatctttgacctattcccctccccagacaaccagggagtcctcctccattttctcagtttatgtgatgaattgtcagaaagtgtttggtagaagtaggaagagaaggccaagacagcgcacatcattgtatgtaatacattgttccacagggcatgatacatatacttacatctgtataaactcccattagaagttacacagttttggggcagatgcagtggctcacgcctgtaatcccaacactttgggaggccgaggccggtggatcacttgagatcaggagtttgagaccagcccggccaacatggtgaaaccctgtctctactaaaaatacaaagatgagccaggtgtggtggcccatacctgtagtcccagctactcaggaggctgaggcaggagaatcgcttgaatccgggaggtggaggttgcagtgagctgagatcacgccactgcactccagcctgggcgacagaatgagtgagactctgtctcaaaaaaaaaaaaaaaaaaaaaagatagttacacagttttaaaaattgtcctctgtttaacagtgaataatttatatttccacatgttcctatgccattaaatatttttcagcttcttcttgtgacttgagtgtgtgtgtgtgtgtgtgcctgcatgtgtgtgtgtgtgtgttacctcttatctcttaggtatcagtcttacaatatcttcttattagcaatggtgtttgcaagccaggtacagtcttgtgttcttgtagtttcagcttcttggaaggctgaggcaggagaatagcttgggcccaggagcagagcagcttgaagaacatactgacaccttagtctctaaaaaaaaaaaattaaaaaagaatgatgtttgccatatagttcaaaaataatcttgtgtacatcaagaagaataacaccatcataaaatctgttaagacaactgataacattttgggttattttcttccatacttttcaatgtatagatacatacgcctactatattttgttcacacaaaaaataaatctatattaaaattggattaatctgtacattgtggtttggatcagaccagatgtgtattctgacaaagttttgaagggaaagtatttgcttgcattaaatgcatgtacaaattctccttaacatcttgttttgtataaataagtacatacacacatacatacggatataggcacagatcatggtaactgaaatgattaccatgactaatcactaccatgactaatcactactatggttagtaaacatgtgtacacagataggtgtataaatatcataaataagtggtctctcaatcccaataggaaatgacttttaaaatggttttatcacacattcacgtcttctattggtcatataagaacttctctatttaaagttcccatatatttgtatgtccagtgttcaaatatgttctctacatttattgtagcttaaacatttgcaaacttgttaaatattcttaaagattattcttaaatattttgtgggatgccaggttgtttttaagagtgccttcctgtttttggcatttctcgaaattagatctgcttatttacaatattttcagatacagtagccctgtttaaagaaaagcaggtaggtcacagttaatgccaccaccaagaaacaagtaatttcaaaatgcggatctattatcagcattccctttctctttctttctttcttttcttttcttttctttttttttttttggcagtttctcgactttattagcctggagctcctctccgacatccccaggggctggtctctggtccctgggcacagtgagcaggactgaggtcagacgggttcagcccctggccatagcagcttgggacagctgggccaagggaacaacaggtgcaaaagtccaaatgctggcacttcaggtgtggccggcacccagccaggcgcaacagtggatgggcaggacgccatgctcctctcctggcgataggtagaccatagcagcgctccctcccagcagccgctaggaacagctggtgattctagccaggaagtgctgcgcccaccactcgtccaagtcaatgggcacgaagttctgcagccggggattggggatcctctccactgcacaggccttgtcccgccctcaccggctgggccaccatccagctgctgccgcacctgctgccaggcttcggacacaaagcggacattctccttgtgggccagtgtgtaggtctcctgggtcccctggagggatggggacttggaggggtcccgccggcgattcacacgattgaacacaagccttggccctgcactcgacaggggccagggtcccagcggctgcgcgaagggctgcgcccgctggggctgcaaggtcggcggcgcgggctgccggcttttcaggagctcctggagctggcccttcacctgctgctgcgtgagacctgtgcggcgctgcgcgaccaacttgctgggcccgttgatgatggtgtacatggcgcgccgctcccagactgccgccggccccccaccagatctcagtattccgtttttctatgtttcgaagaaatataaattactgaattccatctgtggtcaataaggattttgcaccaactgtttcagtacacgtttgttcttgattgcttctcaaattatgaatatcagctttttgagaaatctcttagaatattcaaatctgtgaaggacaagcaaaaacacttcatcgtaaatcccattttcatgaagcaaccaccatcagcagcttgatggctacatgcattcaaatattataaatggattctatgattgttcatgagaggtgatactatttaactaaagcgatagaggcttattaatatactcccttatttgcacaacaaagtgttcaacatacacacacaatcacattaattactcccttcaattccatcctcatcaaactataggtagtatttaatgccttgaatatttcacacaatattaggtaatgggaaatttccaatggcatggagtaactaatagtactttattgctaactctcataacatttctttattgttcaaaaataacaatgaatcaactagtgctcaaatcctaaggatgatataaacacttagcaaaaaaatgaaaaattgaacaattatagcagaagttaatgagacatattctctatcacataaactcaatcaaaattcaattactgtttttctcaactgcatttagctcgttcttctatttgcattttattggggggggtagagggaatgtacatgtgcaggaatttttttttgttataaacatcaaataacaccctttatgtgaaatttccttctaatttaatatttttccttctatcatttttctcaggttttatatagaaagcctacttaaaatgtcactaaacatacttcagctaattggattttgtgttaaataataatttgttagaactttttaattttcttgactagtaagagcaagacatttaatcatcccagcatgtaaacagtgctgtttatttttaaataaaaacatggtattactcagaatgttatcagtactaagccttatttgtcaatgtgtcaagccttcattataaataaaagtaaaactggaaaatgtgctctcaaaaactcagctttagagaagtagacactgttagttgttttgtttgaattttttcaatttacagatacattacaatgtgcatattggctttctagaatacatacatgtttagacgtttggttcaaggttatcacatgttagaagtaaaatgcccttgactttgccatttctcttacctagtgttagcaaacttacatggtttgatccccaaggtccaactgtttgcttttctccctaaatcagaggcagggaatgtctctgccaatcaggccacagagaatggaattcagactttgtgaaggctgaagggattacctaaggagcctaactcatctagtcaaggctttctgtgagtgttctttagatgatatttgaagggaaggttagaggtcatttttctctttcacaaaatacctggaagacctcgtgctttgcttcccagagcctctgcaaggcactgctgtgtgtcagtacacctatgtccataggccatccttgaaatcaaccatgataagtcaaaaagagagaggcacaggccaggatgtcacaaaagccagttcccttctcctggtacagcatggtctacatggtaggtgatggaatcttacctttcaaggtaagatatatttttatatcttttaggtctagttgactcataactttgttcacatcctctaattccttaatgatcttcagtttagttgtttcattcattacttaaggtggggtattgggctgggtgacgtggctcacgcctgtaatcctagcactttgggaggctgaggcgggcagaccactcaaggccaagagttcaagaccagcatggccaaaatggtgaaaccccttctctgcgaaaaataaacaaattagctgggcacattggcgcacgcttgtaatcccagctactcgggaggctgagacataggtattgcttgaacccaggaggcggagattgcagccaagatggtgccactacactccagcctgggtgacagagtgagagactctgtctctaaataaataaataaataaatacataaagtggggtattgaagtcactaacttactttttagaactctattttttcctttagttctgttcagtttttgcctcatgtatttggggactcttgtaaaataaatatgtatgtttaattagtacatcttgacagactgaccttatcattatataatgtccatctttgtctcttgaaacaattattgtcttaaggtatattttgtctggtatcagtacagtcagaccaattttcttttggttactttttacatgaaatatttttttcatgctattactgttaaccatttgtgaattggatctaaagccaactcttttagacagctagagttggatgttctaaaaaatccattctgccaatctttgccttggagtttaatccatttaaagtaattactggtaaagagggacttattcctgctattttgttatgtattttctgtatgtcttatagcttttttctcaattccataattcctaccttcttttgtgattaattgatcttttctagtgcaccatttttattcctttctatttctttttctctatatactaatttttttctttatgttatcctgcagaatacaattaatatcttaattttagagtaatcaatttttattaaactacaaagtagtttatatagtacataaaacctactcctttaaagctctaatcccttttgtgttatttttacaaacgacatcattaaacattgtgtacctattaatgcagacttataattattgtttcattcatttgtttttaaaatcatatgggaaggaaagggaattataaaccaaaaatataattcttctggcttttttatgtatctatgtagctacccttttctttgttccttatttcttcatatggttttgagttactatctagcgtattttcatttcatcctgagagactcctttttgcatttctgttatgggaggtctattactggtggaatctgtaagtttttttctatctaggaatgtcttaatttctccttcatttctgaaagttagtcttgggggatatggaattattgacaagtttgtttgctttagaacttcaaatatgttatcccactgccttttggcttccatggtttctgaagaaaaactggctgctaatcttattgaggagtccttgtatataattaagccctttctcttatgatgctttcaagattcttgctttgtctttgtcttatgacagcaggattataagctttctcattgtagatttcttcgggtttatcttacatagagtttgttgagcttcttgcatgtttatattcatgtgtttcaattgctctagcttcacattcactgacttttttctaactgttctaatctgctgttggaaacttccagtgatcttttttttttcatttcagtttctgtacttttcagttccaaaagttatatttgtttttttaaaaaataatttctctctctttattgatgttctctacttggtgagacattattctcttggtttcttttagttctttgtgtttcatttatggtaacactttgagcatatttaagagagttgacataactcttttctagtaagcccaatgcctgggcttccttctgcacagtttctatgaatttctcttttccctgtgagtaggccataccttcttgttttctttgcatgtcttatgttttgtttatcattaaaaattaaatgttttgggccgggtgcggtggctcacgcctgtaatcccagcactttgggaggccaaggtgggcggatcacgaggtcaggagatcaagaccatcctggccaacatggtgaaacccgtctctactaaaaatacaaaaattagctgggtgtggtggcgcgtgcctgtagtctcggctactcgggaggctgaggcaggagaatgacttgaacccaggaggcagaggttgcagtgacccgagaccacgccactgcactccagcctggtgacagagcaagactccatctcaataaataaataaataaataaataaaaataaaaattagatgttttgatatcatactgtatcaactctggaaattagatttctaaacacacttgcctccccaccccatggggttagttgatagcagttgtgtgttgttgtttgttatttgcttttttagtaacttttcttaaatatttttgtaaagtctgtatttttatcatttgtagccactggagtcagtgttctgatagcttagtggtcacctagtactctgacagtttccttaaacacgtggagcctaagaaagaaagaaaagtagctgggtgcggtggctcatgcctgtaatcccagcactttgggaggctgaggcaggtggatcacctgaggtcaggagttcgaggctagcctggtcaacatggtgaaaccctgtctctactaaaaatacaaaaattagctaggcatggtggcgcaagcctgtaatcccagctactctggaggctgaggcaggagaatcgcttgaacccgggaggcggaggttcagtgagccgagatcgtgccattgtactccagcctgggctacaagagcgaaactccgtctcaaaaaaaaaaaaagaaagaaagaaagaaagaaagaaagaaagaaagataagtattctctaagtccttgaaaactggctctgtgtgttggggcactctttcaactagccaggctgtagtcttcacttctagcttgcaaggggcctgaaagctagtgagatctgagaccttaagctcttctcaggcattttctgcataattgtccagccctgcccatgtgcatggctttcttatttctctagtgtatacaagaacattttaaagttcttattcccccaagtatttcctttcatagcctcttccttcccatgcttttccatctgcttattgtttattttaactgttgtcccttgcctcagattcttatagccagtacttgtgtctttaagttttttcaacacatgcccctcaggagttgttccaaacttggaaacactccaagtgaggcaaaacaaaaagcaagctcttacaccaatcctttagggagccaaaagacagatcaaactggaatgcaacaattctttgagaataagttctgtattatacctatgcacgagggtaggagctatactgaaggcactgtggaggctgggggatggtagacaggtaatttaaaatgccgcagctctcttgctctctcaccacaaagcagtcacttatttcttcaccaaggcttccctgggtgttgtaagtttttgacaagctctagagttctgtaaaagtggattctgacacttctttctttctttctttctttttttgagacggagtctcgctctgtcgcccaggctggagtgcagtggagcgatctcggctcactgcaagctccgcctcccaggttcacgccattctcctgtctcagcctcccgagtacctgggagtacaggcgcccgccaccaggcccagctaattttttgtatttttagtagagacagggtttcaccgtgttagccaggatggtctcgatctcctgacctcgtgatccacccgcctcggcctcccaaagtgctgggattacaggcgtgagccacggcgcggggccgacacttctttctagttcatgcctggctcttgctgcttttgtggagggatgatgtgccaacgtgtcctccttcatgatcttcagtgacatcatttttgccacctgatttttgcacttctagaaataatcacatttctttgcaatgttccttctacaacaggcatgtatgaagtcatagagtgatatcacaaggaatgacacctctggcaggcaaggacttggaaatatgtgttcattttcaatccttttcactgtctgtgttgaaatagcttagtcatatgtaaaacatctaaattagattgaattatacttcagtttttgtttatgcttggctaacatatttggattacttcttctccatctgttttttcatatctactcctttagacgtttcattacttcttggtttgactacgtggccccacttctcctcaattcctcctggctgcaggcagtgaatctagatgtttgacctgagatcttcagcaagcacacttgcctctgcaatgtcatctggaattggcctgttctttgtgttctgacacagctgccacaagaaaccaacgtcccatagcttctttgaggagtccttgtatataataaggccttcatcataggatggtggtaccacgtgaaagcctgctaactcttgctccaaggggcaggaataggagacagatgcccaaagagcttgcatttgtgtttgagtgggtccctcaagtcctgaccacaccaggaggaagtgaggccccgccccacgacttctgtgccagtaccgcctggcagctgatggttcactccaagcccctcactctccaggttttataccaagataccaccaatgtccaggtctctctgttaaggccttagaggagaaggcaaggaggctcagcatgaagccccagcctcttccacctacccacagaccagaccttccccaacagctgggcctcaagggaagaacgctgtaatggcgtattctgtctttaaatgatttcctcacaggggcagtagtgctgcatattttcaaggaaacctgccttggggcactcttctcccgcccttcctgtgtgaaaaaacgccactcagagataaaggcgccaccaaacatggctgccttgcattttgcccagtttggggcgacctgctcatactgctggaattttgcctttgtttccatcttaaatcaaaccagggcctaaactacccactttccccccccaccccccactaaacactcaataactttatttgcctttggttggctcctgggtttggggcggggtaggggttggcagcagcccgggcttcgtgcgccctctggtggacctcagaggcaagaactggaatcccggccaaacctgaggacttcacagtcaatagtttaggagagttgcatggttcctcaggtctgcagtccagacccaacaacagtggacggggcacgttgggaggaggccctgaacctctggctctcatactcgccagtgttggacacccgcatgttctgccgagccctcatctgtttcacacggtccttgtccacttcctgcttggtgaggatgaagagaaggataccacaagggaagccgatggcccaggccagtcccacagctttcatggggttcttgcccctctttctgggaatgtattacatctcgggggataggagttcaggttcctccctgccttcttgggagctgtgggtttgcagtgcctgggtcctgttatgggaagccttgttagctgtggctcctgcgagaatcccccggaggacgcgggcatttcttgccctccatccccccggcccttcagcgccttagcagctaccaccaccgccatgttcagatcccaccctaaaccacccacttttatcaggcaatattatctttcaagaactcaatttccacttaacctagtctttgcagttctgctcttaactcagttttacatctcaagcattttccctacatgatcaaattgtttacgtctaggggcaagtctcaaggagctaggcctaggaggaagacgacaattttgaaaaattaagggcaggattggggcatttctaggcagcaggccacatgttccttaacttggcttgctattgttaaagagaaaattattccagcacctgttaaagtgataaggaagactattcaagactactgcaatagggacattgcaataggtgagaaatagatcagtctccattctgagcatagcaaagacagctggagatttatagtcaaggagcagagtgaggggggtcagtgcatggaacatcacagagaggagacatcaagggtaggggaattcttgccaaactgagttaagattcttattaaaactggactaggcaagccaaagacaggactcaagaatgagctgttaaaaagagggctcagaggagcctatctacaatttggtcaaggagatagcctttgtcaatattcatgccctcaaggagtctttctccatttacggggttagactctgtaaaatgagaggcaactgtttgcttggagccctaagaggaaggcttagataccgctcatcacttcatgccataaatgcccactttgagtagtatacatatataaatacgtataaacccctatcagaagttactaaaaggttgtctcatgatttcatcttttaacctgggaacacaagcactttctcatatcattaatttatttcactttatttttgtttgttgtcattgtatttcttctcatttgaaattagttacttagtttcctcagaaagttaaggaaaatattcattgaaataaatgacaaatattactgaacagcttagtcatatttcaacttgttaaatagatttaggagtaattcagtttttgtttatggttggctataatatttggaccatttctcctccatatctctccaatggaaacaaaatatataggacgaaatacaaaattctccttaaaagtgtcaaagaattcacaaaagagaaagtctcagattaaaactctaatagagagaattaacgggaacaccagattacccagtctttttggccttttgggtatttgcttacctgggtagtattggccttcattttcagggacctcacaggtggcaaagagcagaagatagaaaaagcctgaagggaagtataacgattaaaaaataaaacacacttagggattttcctttaacacaagcacttatcccacatggttacaggttggttctatgaattctttttcttttttttaagatggagtttcactctttgtgcccaggctggagtgcaatggtgcgatcccggctcactgcaacctccacctcctgggttcaagtgattctcctgcctcagcctcccaagtagctggattacaggtgcatgccaccatgcctagctaatttttgtgtttttagtagagatggggtttcgccatgttggccaggctggtctcgaactcctgacttcaggtgatccgcccgcctgggcctcccaaagtgctgggattacaggcaggagccaccatgccgtccggttttataaatttttaagcaaaagatgattccaatcttattcaaaatattttagaggggaaatagagatgaattacttcccaacatattctgagcaacttttataacattggtacctaaatcaaacatagattgtgactgaagagaaaaatacaaactcacttcaattataagtgaagacttaaaaattgaaagatatgagcatatttaatccatagttctgtaaaagacaataaactatgatcaacttggatttatctcatgactgaaagggagttaaaacagtgcaaaaggactaaatgtcatacaccacttttccaaataaaggagaaaagtatatggtcatctcgatgcagaaaaataaaaatatttggtaaattcaacagcacttacaatataaacttttaggaagccacgaatataaaggaacttccataatctggttattatatcatttaatcattgctctgtgaaaaactattttttaactcagtggcttaaaaaacaagcacttatcataactaaaaaatctacaagtaaggccaagtgcggtggctcacgcctgtaattccagcactttgggaggctgaggtaggcagatcacctgaggtcaggagttcgagacagcctggccaacgtggtgaaaccctgtcactactaaaattacaaaaattagctgggcgtggtggcatgctcctgtagtcccagctactcgggaggctgaggcaggagatttgcttgaaactgggaagcacagattgcagtgagccaagatcatgccactgcactccagcctgggcgacagagcaacactctgtctcaaaaaaaaaaaaaaaaaaaaaaagaatctacaaatatactgtgttgttgttatcatggtcttgcctggattgtcaagcatctggcatcagcactgggtcaggttggcagctctgctaatgctatctcttacatgtttgggggtaaattcactgtagagactgctggtctctcctccccatcctgcaacaggccagcctgagcatattcatacactggtagcaggtttgcaaggaaaagtggaagcacacaagtcttgtgagactcagagctgacacaccatgacttcagaattttattaactaaatcaagtcacaaagacagcccagattcaagaaatagggaaaaagagtccacctttttcctggaaaaggaactgaaaattcacattcaccctaggaggagaatttaggacgttttcatgttcaatttagtagagatatctacaaaaacctacatctaacataatgcttaatgggaaaatagctaaagaattcctttcacagccatgaataatagaaggctactcaattatagcaattctaccaaaaagagtcctgaaggcaatgaaaaaagaaaaatgaaatgaaaacaggattagaaaagaagaaaagtaaaatgtgatatatattgtataattttatacatgtgtaaaataagagaatacatcaaactgggcataagatcaatatataaaagtaaactgtatttctatatagcaaagggcattagaaaacataaatttaaagaagacaccatgtgcaatagcatcaataactataaacgaactagggataggccgggctcggtggctcacgcctgtaatcccagcactttgagaggccgaggtgggtggatgacctgaggtcaggagttcgagatcagcctggtcaacatggggaaaccctgtctctactaaaaatacaaaaaaattggccaggtgtggtggcaggcatctgttatcccagttacttgggaggctgaggcaagagaatcacttgaatccgggaggcggaggttgcagtgagctgagatcgcgccattgcactggggcaacaagaatgaaactccgtctcaaaaaaacaaacaaaaataaattaactaggaataaaagatgtgtaagacttttcatttgaaaatcatataaaattgctaagtaggccgggcacagtcgctcattcctgtaatcccagcactttgggaggactaggcaggcagatcacctgaggtcgggagttcgagactagcctgaccaacatggagaaaccccatctctactaaaaatacaaaattagccaggcgtggtggcacatgcctgtaatcccatctactcgggaggctgaggcaggagaatcgcttgaacccgggaggtggaggttgcggtgagccgagatcatggcattgcactctagcctgggcaacaagagcgaaaccctgtctcaaaaaaaaaaaaattactaagtaatagtaaagaagattgaaataaatgcagacaccatgatcaaacataggaaaatgcagtatcataaaggtatcagttctatgacaattgatttattggttcagtactactctatttatcattgcaaaatgtccgtctttttatgttttagtgcttttcacttcaaaagcgcatttctctgatattaatattggtactgctactttcctttggtatgatatttatttgccccaaccttaattttcaaaacttcctataattcttggctttaagtgacttaatttttaaaagcactgtatagggttgtttttgttattgttttgcgttttgtattttagcccaatataatgacttctgtcttttgaggagataattgtgtccactcacgtttactgtaatgaagaaaacacttaactttattcctgccttcctacattatgtttattacttttttttccacttcatttctgatgtttgagttgttgattatatctttttaccaattgttaatttccattaatagttaccttcatttctccatgtctaccaatagccacatatttttctaatgttgcccgaaacaaagtactataaagtcccccaaagcacactatttcttagctcaaggtacctaatattcttcctcaaaactaacccaagatgttgtgtccattaaaatatgtattccaattcgtccttttatattttccccacttaaaagatttgttaaaattctttaatatttttattctgtactcatgttatgtcctttgcagtatagtccctcaattatgactatttagagtgcttatgtcttccatttatgaagagtgtaaggtctttattcctgtttctccttcttcatccacttcagttctcttttctggaatattcatttggctagatttcttttttttctttttttttgaggcagaatgttgttctgtcacctgggctggagtgcaatggcgagatctcggctcactgccacctctgccttccagtttcaagcgattctcctgcctcagcctcccgagtagctgggattacaggcgcccaccaccatgccaggctaatttttgtagttttagtagagacggggtttcaccatgttggccaggctgctctcgaactcctgacctcaggtggcccacctgcctcagcctcccaaagtgctgggattacaggcgtgagccaccgcgcccggccatggctagatatttattcaagtattatccttatacaggatatgtggatgatatattatctgaaggtttccatatgcacaaggaacttctgttcagcctgactgatgaataatttcttggctggagacacacaacggttatgttgtattctctctctcctaatagtctatagatgttattccattgatacttgtttgccagtgttgcagagaagtcagaatggagtctcattccaatatttcttttgtaagttttaatttttacctgggaagattataaggtgactttttaataattctagtattttaccaacatatgcttagtgcatatctttattccgttctataccacagtgagactctacaatctgggccttcttcaattgtgggaagttttcttctacttgttgccttaaattttgccttgtttattctgttttttccctattgtaacatcttttagtaatatgttaaaaccttagatctttaaggttattaacttttccttatttttcccattgctttattttttcctttgttttgagatatgttatgcagttgatccttctagcctgtcattcaatgtcagttgatctccctttcaaaacttttcctaatggtttagcattttcctaaataaaggcttttgggaggcatctgaatcttaataatttcatatttgttttttaattcaagttgtcatttttctcatctagctactgtatttgctgattcaaaggttggcttgttcagaggctgttaggggcctaaggctgcttatgcctcttaagtgggctacaatttattttgttggagttattaagtaacaagtagctgaaattccacaagtggtagagtataaagtgttctttactcctgtcagctactggaataccaccatcaaggacaatagctaacaaatatcgaacacttaaccacataccagggaatattctaaggatctgaatacaaattcatatatttattctttacaacatccttctaatgtaagtagtatgattctagccacttacttaacgaggacagatagcaaataaagttttttttgtatttgtttttttttgttttgttttgttttgtttttttgcgacacagtcttgatctgttgcccaggctggagtgcagtggtgtggtctctgctcactgcaacctccgcctcctgggttcaagcgattctccttgggttcaagcgattctccttccttagcctcctgagtagctgaggttacaggcaactgccaccatgcccagctaattttcttttgtgtttttagtagagacggagtttcaccttgttggtcaggctggtctcgaactcctgactttgtgatccgcccgcctcagcctcccaaagcgctgggattacaggcatgagccatcgtgcccagctgcaaagaaagtttaaataccttatgcaaagtcacagaagaatagttagaaacaaattttaaaatcggattagtcaggcttcagaattcacattcttaagatctagattaggcaaactgtcagctcacttccaaggcactttgaggaagcctcccaacttttattggttttcttgcattctccaagtctcaggtccagggaggactcaggtaacaaattcagttctatcttgtattcttggcataggggaacaactggcaaaaataagtccgactcagttgaccttccaattattagtccacctgtttatcaggccaagccctttccacaatctgttccttttcattgcaagctttaaaaattctggccaggtgtggtggctcgcgcctgtaatcccagcactttgggagggtgaggcgggaggatcacgaggtcaagagatcaagaccatcctgccaatgtggtgaaaccccttctctactaaaacaaatacaaaaattagctgggcttggtggcatgcgcctgtagtcccagctactcaggaggctgaggcagaagaattgcttgaacccaggaggcagaggttgcagtgagctgagatagcgtcactgcactccagcctggcgagcagctcaagggagaaattcccataaagaccccacttatccctagctacctataggcccaaggacccctttggctcagaaaaaaaaagataaattagagttgggaatgtagaaatatacagtcacattcaggttctaatgttttaatttttaaaaatgccgacgttgtttaactatatttatgggtatatgggtattcgttaaggctgtttgccaaatatttcaattactcctcctagatactgttaagatagtggtatttggctaagggatggagtcaaaaccatagatctgattaaataaatacctaacctactcctgaaatcctgccagaatcctttataggagaacataaccaggacatagagcaaaacagccagattacatagtccatacagattagccatttgatacacagagaagtagagaaaaatgaagagtggattaaagaggagaaaatagaaatatcagggaaaaaaatccaacatacgctattatgcaattggtgtttaaagaaaaaatacatacagattatagtaatacgataggtcattttgtgttcacttatctgaattccatattttctaaatattctgtattgagtctattacttttaattttaaatatttctacttataaatatttatataaataaaaatatttctatttcttataaataaatagctattttcatatttttaaattatacttttggataactaaagtacaactgtcaaaatgctcatactataaccaagagaaaaagtataaaagaaaaaatatgcaggacaatgcccaatttttgtaaacatgtatgtgtatatacaaattaaaatttatcggccaggcgcactggctcacacctgtactcccagcactttgggaggccaaggcgggccaatcacctgaggtcaggagttcgagatcagcctggccagcatggcgaaactccgtctctactaaaaatataaaaattagctggtcacggtggcacacgcctgtaatcccagctacttgggaggctgaggcaggagaatcacttgaacccaggaagcaagaggttgcagtgagccgaaattgcgtcactgctctctagcctgggtggcagagcaaggctctgtctcaaaaatagaaaaaaaaggccgggcacggtggctcatgcctgtaatcccagcactttgggaggccgagacgggcagatcatctaaggtcgggagtttgagaccagcctgaccaacatggggaaaccccatctctactaaaaaaaaatacgaaattagccgagtgtggtggcacatgcctgtaatcccagctactagggaggctgaggcaggagaatcgcttgaacctgggaggcggaggttgcggtgagctgagattgtgccattgcactccagcctgggcaacaagagcgaaactccatctcaaaaaaaaaaaattatcaatatatttaggtaaataaagcataaagatgtgatcagtgtttgtctcaagactgtggaatgataaatagggtgaacattcctttcagtgtgccttaggaagtcacggttcacacagttgtccaacttggacaataaattatacaattatctaaggaggatacacaatgtacattctctacctaactgcccaattaattatttaaaatgtgttgtttctttattcattcaaagcatcgtgtatgtgaaaattaaaacatgaatatatgaggcataaaaatataaaagtgtaagaaaaggtcatacgataaagttgataatgttttaacatattagttcaaaacctatggaacagcttaactctgatgtctttaaatgataatagctaaatatgagtatttattttgaacatcaagtttgagcaactgaaatatttattagtgagttctccatctggaaagacatttaaaaagaaggatgccattttggttactttctaaaatatgtgagccagaaaatggagtacgccataagagcctgggaaatgagccaggtcaaagaccacaacgtctgatggagacagatagccaagcctcatacaagctttggagttccagcaatatcttttcctcatgcacggactccttgggacttgaaccttgtatcagaaaacttgaaaatggggaaaatcctgcatatctaatggtgaccgatgaggagatctatgaagctgtagtagaggaaactgaattactgaaaagaaaagatgcctaatgagagtgggtggttttaggcttcagtttgattgtatatggaaagcaaaagcaaaagcgcagcggtgtgagcaagtttcttcaaactgggcaagacacaaggtagccatatttcctggtggctttgcctgttagtggtggtttttttcagatggaatgggagggagaagaaggcctgggggcagggttagttggcttttctgggcccatactgccatcgcgaggaagtagtttgacaaaagcaaaagcttcgggtttgaacttccctcctatctagcagttaagaaagatgtagcaaattcaaaggttcaacagggcctgaccccaagatgggccttctcaacttcaactcttaggctttccaggagttcagtctggacaaaggcaaaatctcagtgaagaagctgctaagtaaggtaccaggactgatgcagggctttggtttcctctcactgtgggcaggactatggaaaaactacagtctacacacagcttctgggcattggtctcctgaccctgccccttagaccatgagacatttgggctggcacaagatatccctgtactttggggtatgggccccaatgttagcaacgttagaatgtgaggagggggaaatgaatctcattcgaggtggcatctaacagcagctggaggtctcagggacaccaaaagtctggtgcctctgttgcctagagcaagaaggatctgaggaaaaggagcatgtgtcactgtgccaagtcaataaattccagaacatcaataagagtgcagatatacacaaccagaaggcctggaggtattctctgagcccaggagttaacagctgtagtggctttgcagcatttttttctagggtccattgtgaaggcatacccacgtggagggatctgctctcatttcatctctcttaatgggacagaaatggtttctttagctttcttctaaggaagatgaggcttttaaggctcaggatctaactgttcattaagattagcaagtattgttctctgtgcctgctccttagcctttttctgatgaagattccttgtaggcctgacaagatatccttcagggagttgagtacatcaggacccccagaaaacttgcctctttagtaccactctttcgtaccagggatgatctctgtacatgatcctttagagaaaatgctgagcagtccatgaaaacaagcatgagtattttgatattctttcttctgctctcttctaaatctattccatttgaatatttgcatgagtacgtgtatgtgtgacactcatgggtttgttggtatgactttaggcttccccatagtttgcagatctccttgggttttgaaatttttccttttccttttcccttttattataaggccaccgcatgggtcattaaatatccttcggatggttggattttgtgttacttataaatttgcccaaagatttttgttttcttcaccataaaaagtgattttttaaaatttccatatgtaaacagagcaatgtataattttcagagaaactgattcttacactgaaggctattttaaaacctgaaaggtatacctttgtttcttgatttccaatgtaaactttgcttgttactatttcaaacgtggagacatgtataacgttaatacttgagggcatggccttaaaataattactccaggaaggtagacacaatgagtatcttcgttagaagactgcaaattcattctttagaattcatatatatgcactcaacttacagtagtcatacatggaataagtagagagagatagactttattttttcctttgttttctctttttttttttttttttttttgagacggagtcttgctttgtcgcccaggctggagtgcagcggcgggatctcgactcactgcaagctccgccttccaggttcacgccattcttctgcctcagcctcccgagtagctgggactacaggcacccgccaccatgcacagctaattttttgtatttttagtagagacggggtttcaccatgttagccaggatagtctcggtctcctgaactcgtgatctgcctgcctcagcctcccaaagtgctgggattacaggtgtgagccaccgcacttggcttgttttcttgtattagtaaactaggatggtttgatcccaaagagtcaataatttgctttaacccctaatcaaagaggtggaatatctttactgatgtggacactgagaatggaattcagtcttttcaaggacttaagaggactacctggtatagctgaaacatgtggagtcaatctactagagaataggccctttgctcctccccactctctgacattgcagaggaaagctgaatgaacctactcatctctgcactcctgtctcctatgggaatgtgaccttgactctggacaaagagtgtgctcatgtgaaaggttaagtgatgcacacatattgcccaccaaatagttaaaccaattgacaatgcttcccacctcacgggaacttgtccaattctacaaatgttcacacaaactaggtgttatcagtggtttcatgttcagtaacttacttagggatattttgaagaggtggggaatggttgagactttgtcatactgtaatttacttgagtattggtgaatttgagaacctctgccaatggactttgttgttccatggcctttttcttctgcgaagtttgtgcctggttccttttctctttccttgctgaattgtttctctttaacttttcatcttggaatagctaatgatctgtaatggatgtcaatggttgaagggcagtaaatactgacaaacaattgcttgtagtttcctgtttttgctgttatttttattatgcctgaaacaatgaaattgtttccatcggcaatcaggcctgttagcctctattaagtatagccaggtgaggtgagcacaacattcttgagcctgaggaattcctgagctgaggccactgctagtgccatccacagttctgtctcaacacatttgtctaccctacttcaaacatacgacctagtcaaaatgcagctccaaggcaggcacgctaacccatctagttcaggccttctctttcggctgttttaagtgagatcaggagatcagcaatgacctctcaccttcacaagacatctgggatcattaagggatgctttaccacatgtctccaagacactcctgagagttattgacccttcttgtcagttatctattgcctctcagctctgaatgcattcttcaatatatgctctacaataaatagtgggaattttccccctgtactctgagctccaacactactgccaaatggggctcatatcccaggccccagtgtgctagaggactgtgtcccagactgtctgcctctacaacaaggagcaggggcaggaggcaaatgatcagaagccctgcacttagcagtaaactgcttcctctagttcttcctgtactgggaggacacaaaagccccacctccaggacttcctatgcatgaatttcctgcctactccccggtcagttctggccacttctacaactatatcacacctttgtccacagattctagaaggtctgagagatgaaggcaaggacatcacgcttgaggccagaagccgtcccaacttccccacaggtgcaaccttccttgacatcctggttttttgggaggaattgttcatggcttggattttcatcaactgatttcctcacgatggcagtagtgctccagaaatgtcaaccagccctgtccccagggcctcttctcccgcccatcgagtatgaaaaaacgccaacaaaagacaaaagcacatggaaacaaaactgtttcaattcttgcccagtttgaggaaacttgttcacaccactgtgcttttgctttctatttccatcttaaatcaaaatgagtccttaaccaccccgccctggtcaggctcttccgttttccagcattaaatttccaccagatctttggcttcacagttcagctcttcttctctcaacattagttcttcagcattttctcaatttattaagttgacttcttaaagttgaacaagactcaggattccaggatgaaatgggagaagaaaacgccgtaagttccaggcctggaaaaggtcatctctagtcacctggcatcatggtccttgacgcagctttctaggttaccagggaatcttcctccattttgtagcagacactaatctttttgtttggtggaaggctgttatttggccgaattcctgagattattttcttatagcctatatagctctcattggtttgacatgtcatatgtgacataccaaatgtacctttatatttatttatttattttcgagacggagtctttcactctgtctcccaggctgcagtgcagtggtgcaatctcggctcactgcaaactccacttcctgggtccaagcgattctcatgcttcagcctcccaagtagctgtgactacaggaacccgccaccacgcctgactaatttttgtgtttttagtagagatggggttttaccatgttggccaggctggtcttgaactcctgacctcaagtgatcctcccacctcagcctcccaaagtgctggatttacaggcatgaaccactgggcctagcctgttcttaggaaactcttaatgaagaaatgtattaaacaaaaaggtgagttcttatctaaaaccagttttcagatgtaacttttctttgcactttggtgtatctattttttcatacacttaaaaacatatagttattcagtacatctgtcatgtgaccaatttgtctttgtaattatcaatacacttcttacaatgctaaatgtggaagtccaaacacacacacacacacacaaacacacacacactcctttttcacttatgtcattacactgaattcacaggtttgcattttactattttattttccttaacaaaacaatagtcaatatacgttctttaaagtttgtaaactgaatctcctacattattttcttagaggaaaccagttttaatatttctccatacttgattctagatgttttagtcagggagggctgccataaaagcatcatagatttttaaacaaactatatgtatttcttacagttctggaggctgggaagcccaagatcatggtggcagccaattcagttcctggctagggtcctcttccaggtgtgcagatggacatcttcctgttgctcacaaggcaaagtgagaaacctctgtcccttcatctccttataggggcactaatcataatgcaggctccacccttatgacctcatctaaacctaactacttcccaaaagtctcatttccaaataccatcgcactgtgggttaagactttcacatatgaatttcgaggtaacacaaactttcagtccttactaggttttcttttttttttttcttccctgtgtgtaagcattgtatttattatctcttgctatgtaacaaattacttcaaacttaatagcttaaaacgacatacattttttttatctcagtttctgtgagtcaggagtctgggcatagttcaggtaggtactcagctcaaggctgcgatcaaggtgtcggttagggctggggactcatctgaggctcaagatcctctgggaagctcatgtggttgttggcagaattcattttgttgcagctatagaactcataattgcttacttctttgaggctagcaaaagagaagatctcagaccaccaggccctcttttcctgtcctgattagatcaggcccccccagggtaatctcccttttgagaccctatcatttttgccatataatataaaggaatcagagaagtgataatctatcatattcacaggtcccactcatacttaaggaattatacagggagatggaatcatcttagtattctgcctatataccacaaggatggatggatggatagagagatagatagatacagtttttaaagattttaagtcaaaattatacatgaacacatttttcaacatcagttatttgtacaatactttacaaacaacattatgccatctctgacattcctccgatattgaaacacttttttttttttttaagacggagtctcactctatcacccaggctggagtgcagtggtgctatctcggctcactgcaagctccgcctcccggattcacgccattcttctgcctcagcctcctgagtagctgggactacaggcacccaccaccacacctggctaattttttgtatttttagtacagacggggtttcaccgtgttagacaggatggtttcgatcttctgacctcgtgatctgcctgcctcggcctcctaaagtgctgggattacaggcgtgagccaccgcgcccggctgattgaaacacttttaacactcttagcgaataagtttttactagcttatgtatccctaaatagaatgcccatattaccaatttataaactaacccatacattcataatatatactcttccttctagaagaatatttcactttctttgccctcactacacttcactaatatcaatattactacttcacttaacatccatcctttcttcccatcctcccaatgtagctataattgcttgtgtcaatgtttaatgcatacaatactatgacaatgtaaatatcttgagatgatccatgtactaaattgtgtttgcttttctttttctggacatctttcctctagtctctgtcccctagaataatttactagtcatttcatttgatggtctgtgtactcatagttcattcaaacacacacatattcaagttgactaaaatatctctcaggagtctcattcatattacggatcttgatcaatttaattttcctcgcaaaatttatctcaaaattttctgacctcctccaatgtgtccagtttcccctatgcctggtgccccagcactttgggaggccaaggcgggtggatcacttgaggccaggagttcaaaccagcttggccaacatggtgaaaccctgtctctcctaaaaatacaaaaattagctgggtgtggtggcacgcgcctgtagtcccagctactctggaggctgaggcagcagaatcgcttgaacccctgggaggtggaggttgcagtgagccgagattgcaccactgcactccagcctggcgacagagcgagactccatctcaaaaaataaaataaaataaaataaaataagccaggcatggtggcacatgtctgtaatcccagctacttgggaagctgaggtgggaggattgcttgaacctgggaggcagacgttgcagtgggccaagatcacaccactgcactccagcctgggcgagagagcaagactctgtctcaaaaaaaaaaaaagactcttactattgatgatacttaataatctggaattgtatttttaaatatattaaaacaatagatgtttcttatcttttataaagcatcctttcatgtgaaaaatgttttttaaaaaagaggcatgagcacccattcataaacagtatgtggtagtacagtaactactatttgcactttggtgtttatcatctcagatctctcaatatgtagaggaaatcatacattcctttaaccaatatttatctagttgctgccaagttccgggcactgttctaagccttggggataaaagaatactaaataggatatttaattgaatagaatcatttaactgaatagaattatttaatatttaacttaatataattcagttatatttatttactataatatcagttataatatttaactgaaataattaatatgtaattgaatataatatttaagtgaatagaattattttaattgtgcacacacacacatttacacatacatgtctttatatatatctctatatttgtaaaattgtatataacttaatgtgcatgcatatatacatagtacatataaatatatatatataacaggtatgtgtgcatagatataggaatatgtgcaaatattggtgcatatatttataaactaacacagtatatacataaacacaatgtgtgtaggtaattggaacgtcgtaaacactagtaaaattgagtatcttttcatttatttaataaacagctggagttcttcttttgtaaattgcctgtttaattcctttaccaattttgccgttggtttaaatacgacagaaacagaaagttttaaattttttagtcacaggacgcttacgcgcaaacacacatacaaaaaatcatcttcaactactctatgaggtcaaatgctaactgagtgaggaaagtagaagagggcgccagaatgtttctccattatgcaatgaatcccaagtaattctagacattctccaccaacttgggaacaagaagtatgggttgtcaggcttaccaggtatcctcatctggagctttttatgaagaagtaacagagaagaacaattgttatgtatgaggagaatcactagacttcaaggagttcagcatcctctgggagaacaaataaagagatgagcactccttccttcttccccaccaaccccaccaagagacctgagatgacggcaaaactctattaggggacaggccttggctataggtgtaacattttttggcctcttagtgtatgcctctgctctctaagcaggagatttggccttttttggctcggcgggatggctcccaatgcttcttcatttccctccttgctctaaggcaatggggtccagacttttgctgtgtatgagatcccccagcaagcacaaatgctgttataagttatctcctcaaattagcctattttatgagctgtgatgctgctatcacaaggagctcaggttctatggctccagaacaaggtgaattggcctgaaccatcttctgagggacaggggcaggaacaggagacaatgggcacaagccctgcactgggccctgaaagttttcctcaacggaagccccacccgacaacttcctgtgcccggacttctggcagctgttggctctgtccggcctcgccaacaacaggtttttacacttggatatcacctttgtcatattagcatcaagtctttgcccagagctcccggaataattcagagaagtcagggaagcccaatttcgggtcagggcctgttcaatctctccgctgaacgggcgtttctaaaccgaaagacctcacgggacggacgctgtaatggcgtagggtattttaaaactatttcctcacgatggcagtcgtgctccagatatgccaacaagtaccgctccctagtccttctcccgccctttctgtccaaaaaaacaccagcaagaaaaaggcgccaggaaacatggcagccttacttttgcccagtttgggacaatcttatcacgctgctgcactgttgcttttggtttccatttgaaacgaaactgaggccttctctttttaagaactgcatttccaataggtttagctttcacagttgtgttctcgctcactcagcatacatctccagtattttcccaagttatcacgttgtctgcttctggattcaagactcaagaatccaggcctaagcagaaaaagaaaatgctacaaactcaaggccgggaggttatctctaagtaccaaaccacatgtccttgcctggctcatccatctgtaaggctcccaaggaattctatattttcaggatagagatctaagtcttatgtgttgacttgttggcagccatttggctggagtcttaagagaagcgcccaagtagctcccattccaagagttttgtcttgtgatttcatttaccatttgaagacactttccgatgccattaagtggtctccaattgcttcctaccactttattggatatgtagggacatgtgtgtgtgtgtgtgtgtgtgtgtgtgtgtatttatctttatatctgtatttaccatttatctcttagagataagccttaaaaccacttcctcattagtaattaagacatgatgtttgccaaggattcagaaataaccatgcactgataaagagtaaagcgctgtcataaaattgattaagaccactgataactttttggatcatgtcctcttactcctttcaatacacacagagttttatatttatgttcatatgtgacaatgaatttatattaaaattggttgtttgtacatgatggtttgcctaggagattgccactcctgattctcagacagtttggccacattacataaaatttttgtcttcatgtttagtaatcaaaacactgcaaaaaaatgtttcttggctgggcgcagtggctcacgcctgtaatcctagcactttgggaggccgaggcgggctgattacctgaggtcgggagttcaagaccagcctggccaacatggtgaaatcccgtctctactaaaaatacaaaaaattagcccggtgcagtggcgcgcgcctgtaatcccagctactctggaggctgaggcagaagaaccacttgaacccaggaggccggaagttgccgtgagctgagatcacgccactgcactccagcctgggctacagaacgagacttcgtctcaaaaaacaaacaaacaaacaaacaaaaatgtttcttattgctccatttattatagtttaaatatggcatatataatatataatattgctatacatatatgtgcacatttatttcaccttaattataacttgacttatactgggcatagttttatacaaagtcttctgcaccaacttacataaattgcatgtttccatatatcaacatctattttccctagctggaaatttctttatacttgattgtacaaggaggtttctcttcgaaggaattataaaggtaacatctgctgttggaaatctgctcatattttaagaaattacaaagccaaaaataaatggtatctcaatgaaaactagaagaaataacttttaaaatgtctttgccatacattctcttatcttccctatccatatataatgtacattttttaacctaaaatcccagttaccttgtatgtcagacatgcttttctcaggacagtttgaggtctttggaaacatcattaactactccttggaatatgcaatatttttaaggttgcttctcatatttttgcatttcctaaaattaagcatacctgtttacaaaataaccagacacattagccttgtacaaagaagtgcagtgaggccacaagtaatgcccactgaagcagataaggatttttaaaatgtgggtgtcttgaatacacctgttttctgtgatcagttaaatatataaatatattaggtctcaaatagccaacaaatcaagttttcaccaacaatttcttctgcacatatttgttctgggttgactctcaaattacaaatatcttatcagcttcttgaaaaatctcttagaatacacaatctatgaagaacaaatggaaacactttatcacaaatcccacttttttgaggcatccactattagcagcttgatgagtatattggtttaaacattaaaaaaatgatatataactgttcaataagaactgatgttattcagtgaaataaatttaatctatatctcattaatatactccccacattcctcagcacaatgctaggcgcgcgcgcgcgcgcacacacacacacacacacacacacacacacacacacacacacttccatttcttttcttcaaatccatcctcattggtcccactacacatagaatttggtgccctgaattctcaattcaacactagaaaatgagtactctccaatatcattaacttttcttgaggaacaagatagttttttatggttaaatctcatagcattcttttactgttgatcaaaccgtaagaattatatgcatctggaaaaaaatcagtaagtggaacaaatatatagcagtaaagaaatgatactcttaagaagtttaatagatattccattgatgtttgttatattgcattctgctctttttattatataattgtacatgtgtgggcacatgtggacaggttgtcaggatttggtgactttttacttacatgatatatgaggaatatccttgcatgatacatgaggaatatccttgcaacttgagttgcttctttctatcatagttttctcaggtctcacatcacataagtctcatcatatgtcgtgaaatatgcttcagaaagctggattttctgttaagtaaaatttggaaatagaatttcagaatagagcctttaaatcttgcatgtgtgtagaagtgtgtatgttttaaagaaaaatacatcttgtaatatgttgttttcctaattatatattgagatgatgctggtttcttgatttttaaaaaacttgcaaatgtaagcttttctcattttcaacatttcaaggctttggacaagtgtaagttaaaacgtgaaggcaagtcattagaaacatcactgtagaaaattacacactgttagttgcttgactggggaactttccagataacttcctttctgcctatttgcttttctgaaccaataggtttatgtgttcaacttgaattaataacatatgtaattaagagagaaagaaagacttcatctttcatttctatttccttgctattagccaaccagaatggtttgattcccgttacaacatttcacattttcttccctaaatcagaggtgtggtcatctcccctattgaggacttggcgaatggatttcaatctttccaaaggcttaaaaagactacctactatagctgaacttactgtagttgaacttggacaatggatgttttgccccctccccaccgccatccttgcaaaagaaatctcagcgatcctctttgtcctctcctttctactttcctgtgggagtttggctgtgcgatcactttcaagaggtagtctctggacaaagggtatgctcatgtgaaaggttaaatgatttggcctgttgaccttcaaagaggtgtaccaattaacagtgcttctcacctggtaggaccttgtccaattctacaaatcattacacaaacactgacatcaatggattccttttcaaaggcttgctcggggttatgatgaagatttaagggcattatggaagaatacagtgaactgcaatttacttcagtactggtgaatttgagactgtgataatagaggtgccttattcctttgccatctttcctgctgagtggttttctttttaactacattttgaaacagcttttgatctgagctgactgtcaatgattgagtggtattgagagttggcaatagttataatctcccattcctggtcacggtgtcacgtttgaattcctgggactcagcaagttgctgctgctttaggcctctatccactctctgaccagatagtctcttaatgtaaaccaaaatgtgtgggaatacaaaattcctgaccctgaggaattctagggctggggctacctctctgtcactcacaattctaagttaagttatggtgcactgtctccacacatctggctttcctagtctagcatatggtcaagtcaaactgtgactcaacagcaggcagcctaacccatctgatgcagggtttctctcagtcacctgcttagctgaagtaggctgaaaaggtcagaggtcaccttacactttcataaggtatttgagaccattgagacatgctttctcaaatgttttcaaacccttcttggctcatgtcaacctataacatcctcaaggacagctagaccaaggcatgaatagcaggaaagtcaatttccccagggaccctatggtctttgtagtagttgctaaaaacttcctagtagatgttatagctccaccctgggcaagtagaattcaggtggtgaccatatgttacagcagtgcatgagaataacattcctttctcttctgtaagtggtcagccactgaatccatcactgatacacgagaaaactctcacatgcagtcaatcttacaaaatttttgccttttcttgctatgctatgggcaagtgtcctgagggtcctgatgtgctcagcttttagagggcttacaaggaatcttcattagaaaaaggctaagaagcaggcacagagaacaatacttgctaatctgaatgaacagttaggtcccaagtctcaatggcctcatcttccttaggggaaggccaatagctaaagaactcatttctgttcctttaatagagctaagagtaggtttctctaaataggtaggccttcacactgggccctagaaaaagtgctgcaaagccatggtagctgttacctcctggcttcagaaaatacttccaggtcttctggttgtgtatatctgcactcctattgatgttcaaggatttattggcttggccaagtgacacacactgccttctcctcaggtcttccttgctctaggcaatgggggcaccagacttttaggtatccttgagacccccagaaagcacgctggctgctgttagatatcatctggaatgagatgtttcatctgcaccctaacattgcttacaccttgtgccaaccccctacctcattgttcaaagggcatggccagaggatatgtggccagaagtccccccaaataggatctgagccatttgttttagccccaccctcactgggtagatatctaagccccaatacttcctatactccacctgcctagtagctgtcccttcagtcctccccctgaccccccacttatcagcttctcccccaggatcctgcctttgtccagagctcctggaaggcttcagatttaaagtgaaggggacctacttagggctagggtccactcaacctcacaaaaggcccaacatttctcagttgctaaaacttgggggggctctaacaactttgggtttgtgttttgtcaaactacatcctcttgatggcagtattgctctggaaaagctgattagccttgcctgggcaccccacccccagagcccttctcctctcacccattcaatctgaaaaaagctaccaagacaaaggagacaggaaacaaagctgccttgctattggccctgtttggggaaaatctgctctttcgaatttacttttgctcctggtttccctctgaactcagactgaagcctataccacccagtttcatcagccatactttgtttaaagaatcccatttccgatagcattaggagatatacctaatgctaaatgacgagttaatgggtgcagcacaccagcatggcacatgtatacatatgtaactaacctgctcattgtgcacatgtaccctaaaacttaaagtataataataataaaatttaaaaaaacaaaaaaatgcccatttccactctaccatagctttgtaggtctgctcttcttcattcaaccttgatccccaacaatttcccaagttatctgcttcagtgggaaattcttagggacctagggctaagaaagtgaagaaaataatggaaataacagcctagagaagaacaaatctaggcaccaggccatgtgacttgtttcactgccaggttccctgggagtcctccattttctgacctgggcactaggtcttgtgtattgagttgggggcagccatgtcagaaccctaataggagggtccagatagatctcaaggctgaattccatacaatatccctcttggggtgacacacacactccaaacttacaaaattccagtagaaaggaacatgattttgtcttatggttccatcattcaacattaaaacacaagcaagttcccatgcacatcattatttgacttttaatggcttcctatggctttattatatatgtgtgtgccactgcttaagcttaggaatcagtcttatggtgtttcctcataagtaattaagacatggtgcttgtaaagaatttagaaaataaccatgtgctgatcaagaacaaaagcactgtcataaaatcttgtattaaacactaatagccttttgcatatttactcccattatttcaacatgcacagaggtctatatttacggtaatacactacaataagcatatttaaattaaatttatatatgcatcatgttttagatgcaaacttttcactgctcattcctgggtaactgaaattgtcatgaaatatttgcaagacctggattttagataataaaatatttgcaatgagcttcttgattgactaattcattaaagaatgttaggttctcaatttttaaaaaatttatacacaggacataatacctataatgccaccactcaagtatcttaattttgatacctgccttacctaatcattagtatgctgactatatatatatatatatatacatgctaacattggaacaggcactatgtgcttatgcctcagaacattagggtttcttttgtttatatttttcaaaacttataccaaaattttatcttaaaattttatgtaaaatctataaagttgaaacgcatactcactctaacactgaccatgattatgcatgatatgcataatgcatatatatgtataagcattagatagataggtccaagttacctggttacaggcctagagggaaaagaaaatgattgcacctattatatatatatttacttctctttatttatttatttttattcagcctctgggagcatggactatccttttctttaaagacaattgaatgcaaactggatacagttttgcacaaattcttcaacaccaccttataccatttgcatacatgaatgacaatgtatatttgagtgcttggattttttttgtatcttactctagaagacctttctatttcaagaaattacaaaagttacacccactgttggcaccgtttagattttaagaaattataagtagaaagtaaacggtacttcaatcacaacaagaaatagccacttaaaaatatccttgccatacattcttatatcttcactttgcacaaataatatacacttaaaaaatgttcaaattctcttgtactttgaatgctaaaacaagttttcctcatttgtaacttgaatgctcttcaaatctcattaagtattctttagaataatgacaggttttaaaatcttgccacatgtttttgcatttctagaaataatcatgcttctttacaatgtacctgctataacagccatgtatggagaagtgaagcgaggtcacaggtaatgccacctccagcagacaagaacttttaaaatgtgggttcatcttcaatcctcttcactcggttttggttctcatctgtttgtgcgtggtcagctctcctagcaaaagtgctaacccttcttggtttggcgggctgatcccatttctcttcaaggtcctcctagctgcaagcaatttggttgcacctgggacctccagcaagcacatggcatccttttataagcaacctggtattgtctggttctctgcagtgactctgctaccacaaaggtcctaggccccagagcctgaaggcaccacgtgtc

SEQ ID NO: 1427 - DNA, 2743 bp, Homo sapiens
gcaatgcgcacgcgcagtggctttgaaggcggggcaacaaagcctgtggccgatgtggcgctcctcggcccgcgcttcagtggttatgacagtgttcgctctaaggggagaaggaatgtgtgaccatttccaacggtaagtcgtacaaaaggtccggggaggcgtacctgggcggcgagaggcgagagaactccgcgcgggctttccagtgcccaggcccctgccggctccgaagccgaaatcccttcttccacttcgttctcttgcagtggacgtggggtgttcccacccctctgtccccaaggccactgtttctgtcttccgctcctaggaataggaaaaagagtcgcgcctctggcatctgtggcagctccagagcgcggccctctagggtccaggcaggccacatggagcggggccctaggcctggctcagagcgtcctaagagcaacaggtctggctcagtcggggaagtggcctggaagaggggctttggagccgggcttcagagccagcaacctcccgaagtgagggaagaaagcctcattctgattgttctctacccagtggtggggctccggttcctaggatcttagacaccctgggagaatctggattttactttttagcggagaggtgttttctctgagaatgccagccagtggcaacatggcccgctaaaaaggcctgtagtaaacttgaggaaagttttctgtttcctgtctgggtctgggagaaagagaacaagtgttgttctccatgcttactatgcctgcctggtcaccaagcgggcctctttgggtcaagtatgacagagtctccctcaggtacacagcaaacccttctgtgctagagccagctggtgccagacactgttcatagatgtgtccaagacatttgtgtaatctatcagacacgtatttaatttccatttgaacatgagtgtttttcctctttctctttctcctctcaggttaacttgcattccccagatagtttggatgagttacaacctaaatctgcaaactcaatacagccagaccctgggaagtgactctctccaagcctcctgtacaagtcccaggaaaagagcctgttttcccttggacatgtgagcagtgaattactgctcattcagaatttcatgtgtatgtgttactgatggccaggtttagagataccaacctatttatttctagaggagaggtgatttgataaccttttcagatatcactatcagtaggcagaaaagggttaatagtatgatagggttaatatgtcctgaggagagtaaagaaattgcaaactgcagaagcacctgatctgtggccctggccagcatctctccatatcctgattctgtaagatcaagtgtttatgcagaaagagaagggactgatgatttgaatgtgaccagatgcagggcatgcccttattgccatgccagcatttgctattcatgatgttagtattcaaaaatcaagaaacacccttcctgggccattggtgtctactaatccattggaagaaaagactggaatccaccacttactagcttcttgggcctcagtcccctcttttctgccatagctaaggaccacctaacctagatggctgttgttattgttcaaagggacatctttagagcctcaagcccaggaatagcccgtggcaggcacctggtaaatgttagttttcattgtcctatcccaacactatgaaacatgcagcactctctgcaactgcccctgtggatttccataggcaggagagtatccagtgttgagtggagctggtattctcagaaacgaagcccctttcctcattttgcgccaatctcttcagtcatttttaccctagtagtataatgctttgtcaaagtcactgtcatctgatgttaacagttgttttcgccagatgacttttcaaaaggtaacttcaccataataccggttaatgtgataaaaacactgcatgtagccaattttttttttttttgagatggagttattggctcttgttgcccaggctagagtgcagcggcgtgatcttggctcactgcaacctccatctcgtgggttcaggtaattctcctgcctcagcctcccgagtggctgggattacaggcacacgccaccatgcccagctaatttttttgtatttttagtagagtcggggtttcactatatgttggccaggctggtctcgaactcctgacctcaggtgatccgcctgcctcagccttccaaagtgctggggttacaggtgtgagccactgcacccagccaaatattttcttatttatttatttattttagagacaggatgccattatgttgcctagtttggaatgcagtgtctatttagaggcgtgatcatggcatactatagcctcggctcaaaggaccctggtctcaaaggaccctgccaccttagcctcctgagtagctgggacaagtgtgcgccaccacacctggctaattttttaaattttttgtagagatagtgtctcgctatgttgcccacgctggtctggaattcctggactcaaggcctcttcctgccctcagacttccaaagtgttaggattacagggtgagtcaccacgcccagccagtgtgaattttctaatgctgagtaagttgtgatccagaagtaaatgtatctgcaagctgatttaaattgtagattttctcttcattgcatattttctgatgttgaataaagtctgagtattaactaa

SEQ ID NO: 1428 - DNA, 31082 bp, Homo sapiens; identical to SEQ ID NO: 1411

SEQ ID NO: 1429 - DNA, 134435 bp, Homo sapiens
caatggcaacacagatttattgggagaaagacctgcggagagggggtaccagctagtgccagagcccccttcccgcttacaggctggaccagttacagtcccgggcaggagaggtctgggattgttgtgaaaatggggtgggggcggtgtgtttggctgctgataatgaaggaatttagtgcagccaggggttaggcctgggacctgcctgacaggatgtttctcacagctcaggccctggtggaattttccactctgaccagtttgtaaaatggtaggggtctgcaaaatagtgcagtttgggctaacattcttatttcttactttagtataaaaaggaaaaagggcgtcgttgatcatctggctgcttcctgctggataggggcgttgtgattagggcctgggttctggagcttccgaatggtttcctcgtaggctctggtattagacgtggcaaaggtgaaatatattatcaatgtgtttttgcatgcttgcctggataaaacaattcagcctttgggaaatgaagcgggatacaaggttaaatatgcatggcccaatcattagtaacaggaagaggaagatcaggggtcctaggaagggggcaacccagggtatccatcttagaagggatgatccttgccaccaggagtcagcgacttgatgtcaaagctctgcagccctgtcatgaagcctacgaactgcgatatgaacaatgccagattcattaacacagaaacagcattcttcctggaggtatatgcaggtaccccctttctcagtggttaggaggtccaggactctccagttttgaaggatgactcccacgaggaagtctaattgtcgttggagactggtaatggaagtgtgcatatcttctacggtgttagaaagggttgtgaatagtgtttggtatgaggtgattgaggtggttatgcctgctattccagtgccaagtgcagcagtgatgcctaatcctgttagcagggtgatgagatgtagagcccatttatttcttatgggtgaagaggagatagaggcttctacagaaattagaatagtttggttagggggtaggatgttgatggttggagcctgaaagaccagggtgcaagttcctgaccagttggctggtaggcaaagatatcagtttgtatcacacaaaaagaagagactgggggtggacaggcagaagttgtaggtgaaggtaggtagccatgatagggtattttcgttttcccaaattgggtaactgccagccagagcggcacctgtaagggcctgatagggagtcttggctagggagttgatgaaggctgtttggttttggagagagaaagaaattgtctttgtcaaccgttagccattgctgccccggtgtggtggctgtcaggtaccagtcacaggtgagggaattgttacattttttccagggggcacctttaaactggagacatagagagcagagttggcagcggggaagccaggaattggatggaaggaaagaaaagaggatccggtggtgaggtgtagggatgtgtggatggtaggcgagccagaaaagcataacaccttctgccaggcagaggtggatatgattttgtaattagggtgtagaattgatggtctacagggagtgcaagggtaaaaataagaccacatagggactggggaacctgtcccaccattgtggcgtgggctggattagggtaggttcggctgagacataaggggggtggggatatgaaggaagtttgagtagaaatggtacccccatattggtggtttagatgatgctgtgttggtttgtatggatgttagtccagaagctattaggtgaaggagggcaacagccctacctgaaaccatgctgagagagctgagtttgaaggaaaggtgtttagctgagtttccaggttatgaaccggtttcaggaatgaatcagccaagaatggtatagccaagtaagaaatgtgtaagctcacgttggactgtgtccatgtaagtaggtcagccggaagagccgtgaatcattgggtgtgtgtagaaagacaaatccagcagttagaggagaggggagattgtgactgacttaatacgtggtgtgtgaggctgatgaagggggcccagctgtcagtgattgggggtggggactcagaatatcccataagcagagaaggcaaaaggagaaaaaggagatttgtgtaggtgtgaaatcctggaaggtgccttgcagccatagctcctcaattagcatgaggaattgagatggattatctaagggcgtggggaaggggtaccaggagagatctgagacaaggtatgaagtaaaagatttaagattggaagtggagagtgtcatgggccagtgcctttcggatgggtgacttctggaattcttgttaggcacagcgaggttggtcctgtgggaaaggaagaatatttccggggtgaggagacttcggggtgtgggccgggtgcctttttaaatttggaatggtgtatacaatagggaaaggatgttaactttgcagcagcggggatggtgaatataacctgatagggacccttccattttgttggaaaggggaggaggggtgtgctacccagacccagtctcctggctgtaagggtaagaaagtgaattgggaagaatcctcaggtttggggaggtgagtgtcagtgtactgtcggactaagtgttgagtgaggtgcagtgctggccaggtgtcctgtaagggaggggatggagcaaagttctgtaggacgaaagaacgtccatacaaaagttcaaaaggacttagatttagaggttttcgggggagggccctgaggcacataagggccaagggaagaagtgatattcagttttcattttgatctctagggaaagtttggttaactgttgttttaagagggcattcgcctgttcaaatttacccgaggattgggggtgatagagaatgtgaaaaacccatatgatgtttaaagacttagaaacctgttgagtgacttgggagataaatgctggtcaattgtccagttgtatagatgaggggaggctgaatcaaaggatgatgtgtgtgaggaaggtagaggcaatggtgtgtgccttttcagtggtagtaagaaaggcttctatccacctgaaaaggtatctaccatcgtgaggagatatcagactttctttatgggggaacgtatgagtgaagtcaatttgccaatcctgtcccggcaactggcctttgggcctgaagggagggaaaaggaggtggtctaagggcccctgaggggaagtctgactgcaggcagagcaacctttagtgaggcggtccaagctgatggccatggtaagggaatgtatacaggtttttagaaattggagcaacgggagataacccgcatggaattggttatggatgtgggtgagaacagaaagtttttgggtcttgggtaggatgagtttgtagtctaagtaaattcagctttcgttatgaacagccctggagccagcaaggcacctttttcttcttgggtgtatgctagggaaaatgggcaataacaatagtgttctaagggctgcctgccaggctgccgaatctgctaagaagtttcccttggttatggcatctgtagccttttggtgtcccttgcaatggataatgacggcctctagtggtagtttagctgcctccagcggcttgtgtatgagtttgccatttattatggcggttctttttgtagttagaaaaacccctttcctgccagattacagtgtgagactgtaggacatggtatgcatatttggaattggtgtaaatgttgaccctctttccctttgctagagtgagggtcttggttagggcaaatagttccgcttgttgtgaggtgatatgtgatgagagagcattggattataggagtttgttttcggcaatgatggcatagccagctgccagatatggttccttaaaagagcttccatcaatgaaccatgtgggttccttccgcaaaggggcttctgaaatgtgttggaaaggggaggagagggaggctaagaggtctaggcaagagtgggggattcagaattggaagtacttatagggaggagggtggttggatttagaattttacatctctggaaggtgttagagggttgctgtaagctggatggcaggaggaaaagaagagatcaatggctcatggggtcccataagttatgggaagatgcaatagtaatgtgctggtagagggtgagtttttgtgcctctgaggccagcaatgtagctgcatccagaactttcaagcatggaggccagccttggatgatagagtccagttttcagaagtatgcaatggcttctggagtgttgccacgggtttggcagagaaatccaagggcaaggccttgattacaatgaacatacagggtaaagggtttaatggaattgggtagtcctagtgctgggacattaaaagggcatctttcagtttttagaagtgggagttaatgggcaagctgggtccaaatgttctaggatggacccacgtgatgccgtgcagagtggtttggtcaacaggccaaagttaatgatccacagctggaagtacccaacaaggcccaaaaaggaagggtccttcttggtgtggggaaggggcacatcctgtattagctccttccatcgggctggcatggctcaagaattaggggttagggtgagtccaaggttagtgacttgggtttgggctacttgagcctttgtaggtaaaacctgatatccctggccatagaggaaatttagaagttgggtgatgtgttgatggatagatcaaaggagggactacacataaggaggtcattgatgtattgaaggaggctgctaggagcaaggggaagctcgattagttccttggtgagagcctgcccaaataggagggggctatcccggaacccctgtgggagtacagtctgttagttaggtagatgtgtgagtatctgggtctgaccaggtgaaagcaaaaagactttgggaagccagatccaagggaatagtaaaaaaaaaaaaaaaaaaaaaaaaaaaaaaaaaaaaagtcccttagatccaatacagagaagtgtgtgctagatgggggaatatgggagagtagagtataggggttgggggccactggataggttggtacctccacttggtaaatgacatggagatcctggaccaagtggtaaaatctgtctgtttttttgacagccaggacaagggtgttgtggggagagttaacaggtttgagaatctgagcttgtaaaaactcacagataataggtttgaggcccctgaggctggctgggctaagggaatattgaggctgatgaaggaaaatggaggagtcttggaaggttattttgactgggatgtgatgtgtggctattgtgggtttagaaacgttccacacttctggattgacagaaggtaacagagtggatagcaaagatgagggggaggagagggaagcatctggacagcagagtaaaataaaaggggtagaattgcaggaggctagtcatatgggggcctggaatttactcagtatattccaccccaagataggggtaggacactaagggataactaagaaggagtggatgaagggggtattgaataggttgcataataggggaccagtatgtgcctagaggggattccattgactctcacaatagagatagaagaactgaggagggtcaagaatattctgataaaactgagtaactagtccccagatctaaaaggaagagcatgggcttaccaaagactgacagcgttaccctgggttccgaggtggtgatggcggtgggggcagcggaccctgggccccgtcagtcttcagcagccaggtctacaatgcttgccagactggaaccagggttgcaggacctgtttgagttagaggtggtcaagcggggtgaagagtcttgttgagtgcaatctgacttccagtgtcccttgataccacagatgaggcaaggttttgagggcggcacaagattggggcagactcttgcccagggaccctgttggctacacttaaaacagactcctgatggggactgtcatgaggttgaggatttttgtatgcattggggaatcctgttgtatggcagctgacagcatctggtatttagcctggtctcttttaagctttcgggtttttatttcttcctctctattgttaaagaccttgaaggctgctttgattaagtctctttaggaggtttgagggccatcctccagtctttggagtttcttttggatgtcgggggctgactgggaaatgacgtgtaaatggaggtagactctgtcctcggcagtgtcagggcttaagctggtatatttaatcacggtctctgaaaggcaggagaaaaaaagagtagggtttttgtcaggggccttgagtgatttctttatcttttcatacttgacagtcgtaagggcggttttattcatgccagttaggaggcatgttatcatatggcctagtttctgtctgtctgcagaagccacctgataatcccaactggggacagtactgggaatagcgagggttgtgactgggttatgggcagcatcttgtccgtggagggtgtctgcttgggcctgatccagatatgttccctgttctccagggtgagggaggaggagaggatgacagaaatgtcatgccaggtaaggtcataagattgagtgatatacagaaattccttgtggaaggatgtggggtctgtggaaaaggagtcaagtctcttttcaatctgagagccatcagctacagagaaaggaacatgaactcagactatgccttcagtctccataacatcccccaatggggggactttagagggcctctgggcctgtgcctggttttcagcagcagaagggggctgagtatgagatcagttatggtggggagagggtagaggagatgggggataggaacaagggggtgggggagccgaaggggaaggaggaggagacggtggtgggagtggggctggggggcgggtggggattcgtcgtctggataaaaatcagaggaggaggaggaggagggcttgtctggaaggggaggcattttggcagatttcttgtttaagaggagcagctggtaaggtgaacaggactgatagagggaattggcaaaagcctggatatagagcatcttggaccacttgccattgtgctggaggacattttctaaatcatgttgaatttggaagtcaaaagtcccatctgggccagcagccatcattgtccagcttatactggggccaggccacattacaaaggaaaataaggcatttagttttaatggagtcggccaagcccagtgctcggaggttccagatgagacatctgagaggggtgtctggaggggatttcgaggagccctgccccatatgagtggctgggagggtgaaaaatgtggagtaggggagtgagtatcccaattctaaccatgagaagggatggagaagagccggggtgcccccgtagctcttcgtggtcccccagaaaccagagtggtcagagcgtgagcattctgagggcatcccctgagaaggcaggccagggtcacccagtggtgaccggggaatcctcttacctggcgctggggttttctggctaacaggcagaaatatgagaggaatccagagggtggaaagggaaactcacccacaattggaggccggtgttggatgcaatgggagtggtccttgccagagccacagagaggaaagagggggaaggagaaagcggtgggaggatggggccgagagaaagaattcctccgtagaaagacgaaagtgggcagggctgggaaccaggggccaatcaggatttgggaattagcccggggcgagctgccgctgcctcttccttcccaggttgcaaggaagtacctctcccttgtgggatctagaccccatcccaggttttggcaccaaatgttagaacgaaagggagaaaggaatggagcagaggcagctcaagggcaacacaggtttattgggagaaaggcctgcagatagggggtactagctagcgtcggagccccagtccttcttacaggctggggcagttctaggcctgggcaggagaggtcggggatggttgagaaaatggggcgggggtggtgtgtttggctgctgataaaggaaggaatttactgcagtcaggggttaggcctggaacctgtctgacaggatgaatttattgccctcagggtttaggcctgggacctttccaacaggatgtttctcacagctcaggcgctggtggaattttccattctgaccagagtttgtaaaatggtggcagtctgcaaaatggcgtggcttgggctaacacgatcaacatgcatcaatttcacagacaaaatattgggcggaacaccccaggataatacacaaaatgaaactgttttggtaaatactgaaaacatgcaaaacaacataaatgttatttttatatactaaaatatgtactaggatcttaataatatacatggaaaaataaacacaagaaggagagggaaatgggattacattatagcacaaaaagtattttaatttcatttgtaatgaattatttgtttaaagagaagctaaagcaagtataaaaatgttataatttaatagttggatggtatgcatttaggaatttatgttaatccctttactattgtgcctgttggaaatatttcattattaatgttaaatattattttggaaagataaaaaggtatattaataaatttatagcgatataaatacataaatatgataaataataaatcaattatagtaaaatgttaatattagaaggttatatttggatgttcaaaacctaattctttcaatatttctgaacatttaaatattttataataaaatgtttgagtaaaataataatggatcaatttctgaaatgaaatgagcaaatgatacaacaaagtgaatatttatttctaacaacccagcagttgtttgtgttatctataaatcaatgatagggtgaaataaaacctctcggattggaacaacaaatatgtgtggtaaaattttgatactagcatgcaattcacttaaatgaaaaagaaacacagaaaatatttatcccaatattgccaatacaaagaaataaaaatgaaaaataattaaaaattggacaagcactaaaagcagtatttaaaaaagtctattttaaataccatatagaagatgaatctaagaaatatacacatactttattttcctcaagattactgactagaggtttttccaacgtgcctaatccatttagacgagcaaaaatagtggttcttctctgaaaattatataacaaggaccacagcagttaagcagaaaaatgaaaaaaaattctgaatctgggaaacagaaggaaggcatgaagttctcttggctgggatcagctaaatactgggtacgaatccccaacatgggaaagcatgagtgagtgcttctctgcagttcacttttccactggggaatggtgaaatccagaccacaggagagcaccttaactttctgaatccctagatctaacttgggtaatggccgggagcctataagaaggaactgctctgggaagtgttccatgtacttcctcagacttgggtacctaaagaaaaatgacattctagattttagctcttagcaagctctgtggggtcaagggagcttgaggcagtggcagtctttggcattagagagacttgcactggggcacggacaactagggctcaaacgggaggagctcccacagccagaacagagatatgagtgtagtgtggactccagctactggtaccagaactgagcttctcttctaggaccagagaaggaggagaattgcctgggaggcatggtattgaccaagtcagtgacttctaatactagggactttgttggaaactagaagcaaattgtagtgactagccaaatattcaaactgcttaccacaattggtacaggagagtgaatgatgtcaagtctggagtgtgagggggaagcacatttcacttccactggctaagaatgtggcactggcaccacccctccctctctgtgctgagaccttgatgaagaagcagttgtccctcacccatgcattcttccagaggcccgagtaccatgatgccacccccaacagggctggtgctttaatccaccattgaggatcctgagtgtaggtttcccatgcctggttccagttagtttcaactccaacccaaggcagaacatgaactcatgaccctgaacattccatggtatcatgcaccacctgggccacttgagcaattttctcagataaagaggttgggcataaacacttctgctatcactttagctggctgtaacctgcaggcaccaactactggcatggaggtgaatctgcacagcccattacaataacagctgacataagagcacaacgctcaggaatgataaaatgtttttatgaccactgctacctgcatgaggcatgccacctcagctgttcagttcaggaaatcatgagagcactcacccatttagtatacttggcatttgagaaagattactggcttttgagaaagatcatattaagggtatttagaagcaaggaaatcatacaatctttgccactgaacacagccaaacagccttacacaacatacaccagagtcacatcaagaatagcctcccccatgaaagtacattcagaaataaaaaaagactaatactccagatatgcagtgatcaatgtaaagatacaagaatcatgaaaaagcaaggtattatgacactttcaaaggatcgcaataattctctagcaatagattctaacaaaaaatcctcaaaatgccaaataagtcagaatattgatttttaaaaagctcaatgaaatgcaagaaaaaatctgaaaccaatacaaagaaatacaaaatcaattcagaatataaacaatcaacttatcaagaatataaatatctttaaaaaatcatgtcaaattttcaacaatataccagaacaagcaaaataaagaatctcagaacttgaagacaggtgtgttgaaatagcccatgaagacaaaaacttttaaaaagaataaaaaagaatgagaaaggccttcaagactcatgggactaagagctaccaaactttcaaattatttgtattcccaaaaaggaataaaaattttaaaaatgatataaaacctatttaaagaaataattgatgaaagcttccagattatgcaaagaaatgtagacatacacatacggggggaccaacaatctcttggaaaatacattataaaaaggaattcactatagcatactctcatcagactgtctaaaaaatgtgaaaaaaagaattgtaaaattatcaagagaaaagtatctactgacccacaaggaaaccctatcagactaagtgaaaacatactagcagaaaacttaacagtcagaacagaatgggatagtattatcaaacgcttaacaaaaagctgcaatcaacaattttatatccagctagattaagcttcaaagaagaagaaataatttccagagaagcaaatgctgaggaaattcatcaccactgcactaacttatgagaaatgcccaaaggaatcctaaacatggaaattaaaagtcaatattcaccatcatggaaacacccagaaaaagtaacctcacaggtattataaaaccatcacataaaggatgaagagaaataaatcaaatggtgattcaatacaataacactaaagactaacagaatttataaaacagctggataatacttttatttatttatttattttgagacagagtctcactctgttgcccaggctggagtgcagtggcgcgatctcggctcactgcaagctccgcctcctgggttcacaccattctcctgcctcagcctcccgagtagctgggactacaggcgcctgccaccacgcccggctaatgttttgtatttttagtagagacagggtttcaccatgttagccaggatggtctcgatctcctgacctcgtgatccgcccgcctcagcctcccaaagtgctgggattacaggtatgagccaccgcgcccggcctggagaatacttttatacatttttatatttttaacaatatgacagtaactaaatgtaacatatcattattaaccctgaatataaatgaattcaatgctccacttaaaagacacagattgacaaaatggatttagaaaattatgatccaaccatatgaagcttacaagaaactcagtttacctgtaaagatacatttaaactgaaagtaaagtgtgaaaaaaaattatgtacaaatagaaacagaaagcaggagtcactatatttatatcagataaaacagtctttaaatcaaaaacagtaaaaaaaggcaagataatcatattataaaaaatatggccaagtcatcaattcagtaagaggatataacaattctaaatgtatatgcacccaaaaccaaagctcccaccattcataaacaaatattagtagacctaaagaagagatatacagcaattcattaataatgggggacctcaatgccccacttacagcactagacagatcaatgagacaaaaaatacaacacggaaactttggatttatgttgaattttagaccaaatggacctaacaggcatttatagaacattctacccaacaactgaagaatatacattcattcttctcattgcacatggaacattttccaagacaggccatatgttaggccacaaaacaagtcttaacacatttttaaaaactgtaatcatatcaagtatcttctcagaccacaatggaaaaaacagaaataccaagaggaaacactgaaaatatacaaaagcatgggaattaaacaacacactcctgagtatttaggtcaataaagttaagacagaaatttaagaaaatctttgaaatgaatacaaatggaaatatataccagaacttctgggatataacaaagcgaagaaagtttatagcagtaaatgcctacatcaacaaagtagagcaatcaaaaaataacaacctaatgttacacctcaagaaacaaccaaaccaagaaaaaaccaaacccaaaattagcaaaagaaaataaataaataaataaataaataaataaataaataaataaatcagggcagaactaaataaactacatcaaaaaccaaaccaatacaaagtaatcaataaaacaaaaaactcactcttcaaaacaaaaaaggtttcttttttgttctgataaacaaaacaaaacaaaataaaacaaaaagaattgataaacagaactgataaaccactagctagactaaccactgcaattcataacatacacataaaaatgatcatcggatactcttttgaacaactaaatgctcacaaacttaacaacctaaagacaatagatacattttgggacacaactaacctcccaaaaactgtaaaaagaaaaagaaatggaaatccagaacagatcaacaatgaagaaggagattggaatagtaataaaagaaaaccccaaaaacaaaaaaatccatacccatacagattcacagctgaattctaccaaacctacaaagaagaattaatatgaatactcctgaaattgttccaaaaatgtgaggaggacagaatttcccttacttcattctaagaagccagtatcatcctgatatataaaccaaacaaggacacagaaaatagaaaccagaaaaagtacagaccaataacactgatgaacattgaagcaaaaatcctcaaaaaaatactagtgaaccaaatccaacagcacatcacaaagatactgcacagtgatcaagtgggttttataacatagatgaaaggatggttcaatatacacacatcagtacatgtgatacattatataaaaataattgagaataaaaatcacatgatcatctcaatatacacagagaaaacttttcataaaattcagcatcccttcatgataaaatactcaataaactaagaataaaaagaacataactcaaaatgacaaagaccatatacaagaaatgcaaaaccaacatcatagtcaatagagaaaagtcgaaagcttttcctctaagaacttaaataagacaagaatgcaactttcaccactcatattaaacagagaactaaaagtcctagccagagcattcaggaaagagaaagaaataaaagccatctaagttggacaagaggaagtgatattattgctatttgcagatgttatgcttatgtatctataaaatcctaaagattcaaccaaaaatttcctagatttgataaatgagttcaatacagatttaggatacaaaagaaaggtataaaaatcagtagcctatttatacaacaataatcttatctgagaacaaactcaagaaggaaattccattcacaatatctacaataaatgctcaggaatatatttaaccaagaaggtgaaagaaaaactgcaaaacactgacaaaataaattatagataatacaaatggaaaaacatctcatgctcatgaattggaaaaattaatacagttaaaatgaccatactgaccaaaacaatctagagattaaatccaatcatgtcaaaatataaatgttattctttcacagaattagtaaaacaatagtgaaattcacacaaaaccagaaaagtgtgtagatggccaaagcaatcctaagtgaaaagaacaaaggtggaggcatcacattacctgacttcaaattatactacaaggctatagtaaccaaacagcatgaaactggtatgaaaatagatacatatgttaatggatcagaatagaggacccagaaataaagccacatgtctacagccaactgatctctgacaaagttgacaagaacatacattgaagaatgacactcttttcaatcaatggtgctggagctcttgcactaacactgaacagaaaacagtggatacttcccagccctgagcagccactcctgattgtggagcactgagacggcgcccagacttgtgcctgccagaagcccacccttgagccagcaccatctccagcatgaccacatgccccatgaaccaacatctgagtcaaaaactttgccagcatgtctatagacaccatcaggggctgcctgtacctccctcccaccctgcattgccttcaccactgtggtgaacatttgcagagaggcaggcaccctggcaccaacttaccacactgctgcagctgctgctactgctgttgctggcatatgtgaatgaggaaggatctggctgtaaacatactataaaacgctttggctgacactacccattggagtgtagtgaacagcagtgcaggagcaccttggccctcatagtgcagtaaattcctaaattcaaggaggcagagaacaaagttgagacccaatacaagttccccacagttagagaatgcagtccaaaagttgggaggtaagcgctggccacctaaaatctttcagaaatgaagccagttggctgtaaggactaagatctgaatttttttttaatcttgtccaaattcttatgtaagggatctgaggagtcatgccctacaaactataaattatcatctgatgggttttatttaaccctgtatatcgtgacttactttccaatctgactctggcataaccttatgtgacaaagaagaaaataaaaatattttaccccaaaatgcttcatcatattttgaaatggcccttcaaaaccatcctttgtgggggaaatttgcatatgtaaagactctctaataatatagctagatctttttcttccaggccctcccaatcctgaagatattaactgagattctagcaccttttaaagatctgaataggaaatatttgtcatctattgtctgtaagggcagccactatgagacttcagaaaccttggtctccataatcttttatcttaacctgaacatttcctttctattaatcccaggtctttagacaaactcaaccaagagtaaacaagaaaatgtttaaattcacccaaagcctggaagccccttcttcgaattttcctgcctttctcgaccaaaccaatgtatttctcaaatgtatttaattgatgtttcatgcctccctaaaatgtataacaccaagctgcaccccaaccatcttggacacatgttctcaggacctcctgagggctgtatcacaggccatggtcactcatattgggctcaggacaaatctcttaaaatattttacggagtttgactcttttcatcaacggctgcatccaacttataccacaatcaagccctcaaaataattagataggataaaataaagtaagcaacagcaaagattgtaggaagataagcacggaaagaagagaaagaatcaacccaagaatcctgaagactcaaaaagcccaggtaccttctttcctccaaatgaccacatcacctctcctgcaagagttctgaaccaggttgagatggctgaaaggacaaaaatataattcagaatatgaataggaatgaagatcattgagctacaggagtacactgaaacccaatccaaggaagctaaaaatcatgataaaacaattcagaagttgacagacaaaatagccagtataggaaataacattactgtcctgatagagctgaaaaacacactatgagaacttcacaatgcaatcataagtatcaatggcagaatagaccaagtggaaagaaagaatctcagagcttgaagcctatctttttggaataagacaggcaaacaagaacagacataaaaagaatgcaaaggaatgaacaaaatctttgggaggtatgggattatgtaaagagaccaaatctacgattcaatggtgtacctgaaagagatggggagaatggaatcacttggaaaacatttcaggatatcatccatgagaacttcctcaacctagatagaaaggcaaacatttaaattcaggaaatgcagagaagcacagttagacactttacaagaagatcatctccaagacacataatcatctaattctccaaggtcaaaaaaaaaaaaaaatgttaatggcagctacagagaaaggtcaggtcacctacaaaaagaagtccattagactaacagcagacctctcagcagaaaccctacaaacaagaacagattgaggacgaatattcaacattcttaaaaaaaaaaaattccaaaaccagaatttcatatccatccaaactatgcttcataagtgaaggagaaataaaatccttttcagacaagcaaatgcagaggaagtttgttatcagcagacttgccttataagagctcctgaaggaagcactaaatgtggaaaagaaaaacagttaccagtcactaaaaaaacacactgatgtaaaaacacaccagtgacactataaagcaaccacacaaataagtgtgcaaaataaccagctaatattatgacagaatcaaatccacacgtcaatactaaccttgaatgtaaatatgctaagtgccccaattaaaagtcacagagtggcaaggtaaataaagaaacaagacctaaaactatgctgtcttcaagagacccaggaagtaagacacaggaagacagacacctcgtgttctcacttataagtaggagataaatgacatgtaaacatggacttagagtgtagaataatacacaatatagactcaaggatggggatttggcagatgaaatattaattaatggatacaatgtacattattctggtgatggatatactaaaagccctgacttcaccactatacaatatatccatgtaacattattacacttgtaccccataaatttatacaaataaaataaaatgaatacagtcatacagcctactggtatgcatgtacactgtgaaatataataacattatattatttttatttttctattttttattattgatatataacataaattttagtattttaaaatgtgtacttcagcagttttcagtattttcacaatgctgtgcaactattaccactatctaattagagaacatttccatactcccatgttcattaacatatactctccatcatcttcatctctaagtcattggcaaacatttatctactttatatctccatgaaattgcctacacttgacatcctttttcttccagggagcatcttttcaacattcatccattttggagcacatatcagtaattaatttatttttatggcccaatatattattgttttgctagaccacattttgtttaaccattgatggactttttttttgtgtacaagattttgtttgaacatatggtttcaattcttatggttatagagttaggattagaattgataggtcacattggcattctacagtgaattattttataaactgtgaaagtattttccatagcagctgcactattttacattccctccttcaatatatgaggattcaaattttgcaaatcaccaataccatttatttccttattaaaatatttatagccatcccagtggatataaagaataccttactggtttgcatttccctatatgattaatgatgttgaacatatttttgtgtgttcatttgtcatatatacgtcttctttggagaagtatctattcacataatttggttatgttttaactgaccaaattatttttgtttttctctttttattgttgttttaagtgttcattatatgttatgtacactagactctaatcagatatattgatggcttgaaaaggctttctctaattctgtagattgtcttttcatggtagtgtccttcaatgtacaaaataaattttgaagtcaaatttatctatattgtcatttcttgcttgatctttgtgtcatactttaaaaaggtgcctaatcaaatgtcattaaaattttcattttttatctaaacattttatacttttacctctcacattcaagtctttgatacatatgagtgcaactccattattttgtatgtgcatatccatttgttccaggaccatttgttgaaaaggctattccttccccattaaattgtcctggcaatcctttttaagatcaattgaatattaatgcatgggttaatttctgcactctgaattctattatattaccttatataggtctacccttatgacagtagcacattgtcttaactactatagctttgtagtaatttgtgaaaacgggaagtgtggttctccaaatttcctctgctccatcaagattgttttggcaatactgagccccaattttccaattttatgattagcttgtacgtttctgcaaagaaaagactattgtggttttgaaagggatttcagagaaacatagaggaaaagacaaactttatttccctctatgcccacctaacacagcacagaacactgcacttctattattaatatgtgaggattattccctcacacaccaagcaattcttcaatggacaccaactgggtattccattattcaattccgacagtatttagttgggttggatagtgtcagatcttgtgagatatcacaagatcatatctcacaagatctagtgtgctaaatcttgtgagatggagccctcacaggttgaggcctctatctcacaggaatgtccccgcttcaacactaattggaagtagcaggttgtcacctgtacttctgagtgtccagctatgtatcagaattcccatagctcccaacttaggtttaattgggtaggacagcttgtggaactcaggaaacatgtacatttactaatttagtatttttttaatggaatggatttttattttctagaattttttaaattatactttaagttctagggtacatgtccacaatgtgcaggtttcttacatatgtatacatgtgccgtgttggtgtgctgcacccattaactcgtcatttacattaggtatatctcctaatgctatccctcccttcttcccccaccccaccacaggccccagtgtgtgatgttccccaccctgtgtccaagtgttctcattgttaaattcccacctatgagtgagaacatgcggtgtttgcttttctgtccttgcgatagtttgctcagaatgatggcttccagcttcatccatgtccctgcaaaggacacgaactcatccttttttatggctgcatagtattccatggtgtatatttgccacattttttaaatccagtctatcattgttggatatttgggttggttccaagtctttgctattgtgaatagtgccacaataaacatacgtgtgcatgtgtctttatggcagcatgatttataatcctttgggtatatacccagtaatgggatggctgggtcaaatggtatttccagttctagatccctgaggcatcgccacactgtcttccacaatggacgaactagtttacagtcccactaaaagtgtaaaagtgttcctatttctccacatcctctcaagcacccgttgtttcctgaatttttaatgatcgccattctaactagtaggagatggtatcacattgtggatttgatttgcatttctctgatggccagtgatgatgagcattttttcatgtgtctgttgcctgcataaatgtcttcttttgagaagtgtctgttcaaatccttagctcactttttgaggtttttgtaggttgcctgttcactctgatggtagtttcttttgctatgcagaagctcttcagtttgattagataccatttgtctactttggcttttgttgccattgcttttgatgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctcgccagttttcccagcaccatttattaaatagggaatcctttccccattgcttgtttttgtcagctttgtcaaagatcagatggttgtagatgtgtggtattatttctgaggactctgttctgttccattggtctatctctctgttttggtaccagtaccatgctgttttggttactgtagccttgtagtatactttgaagtcagggagcgtgatgcctccagctttgttcttttggcttaggattgtcttggcaatgcgggctcttttttggttccatatgaactttaaagtagatttttccagttgtgtgaagaaagtcattggtagcttgatggggatagcattgaatctataaattaccttgggcagtatggccattttcatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctccctgtttgtctcttattggtgtataggaatgcttatgatttttgcacattgattttgtatcctgagactttgctgaagttgcttatcagattaaggagattttgagctgagattatggggttttctagatatacaatcatgtcatctgcaaacagggacaatttgactttctcttttcctaactgaataccctttatttctttctcctgcctaactgccctggccagaacttccaacactatgttgaataggagtggtgagagagggcatccctgtcttgtgccagttttcaaagggaatgcttccagtttttgctgtttcagtatgatattggctgtgggtctgtcagaaatagctcttattattttgagatacgtcccttcaatacctagtttattgagagttttaacatgaagggctgttgaatattgtcaaaggccttttcttcatctattgagataatcatgtggtttttgtctttgattctctttatgtgatggattacgtttattgatttgcatatgttgaaccagctttgcatccaagggatgaagctaacttgatcgtggtggataagctttttgatgtgctgctggatcctgtttggcagtattttattgaggatttttacatctatgttcatcagggatattggtctaaaattctctttttttgttgtgtctctgccaggctttggtatcaggatgatgctggcctcataaaatgacttagggaggattccctctttctattgattggaatattttcagaaggaatggtaccaactcctctttgtacctctggtagtctttggctgtgaatccatctggtccaggactttttttggctggtaagctattaattattccctcaatttcagagcctgttattggtctattcagtgattcaacgtcttcctggtttaggctagggagggtttatgtctccaggaacttatccatttcttctagatcttctagtttatttgcgtagaggtgtttatagtattctctgatggtagtttgtatttctgtgcgatcggtggtgatatctcctttatcattttttattgcacctatttgattcttctctcttttcttctttattagtcttgctagcggtctatcaattttgttgatcttttcaaaacaccagctcctggattcattgattttttgaagggattttttgtgtctctatctccttcagttctgctctgatcttagttatttcttgccttctgctagcttttgaatatgtttactcttgcttctctagttcttttaattgtgatgttagggtgtcaactttagatctttcctgctttctcttgtgggcatttaatgctataaatttccctctacacattgctttatatgtgtcccagagattctagtaggttgtgtctttgtcctcattggtttcaaagaacatctttatttctgccttcattttgttatgtacccagtagtcattcaggagcaggttgttcagtttccatgtagttgaacagttttgagtgagtttcttaatcctgagctctagtttgattgcactgtggtctgagagacagtttgttacaatttctgttttttacatttgctgaggagtgctttacttccaactatgtggtcaattttggaataagtgggatgtggtactgagaagaatgtatattctgttgatttggggtggagagttctctagatgtctattaggtccgcttggtgcagagctgagttcaattcctgcatatccttgttaactttctgtctcgttgatgtgtctaatgttgatggtggggtgttaaaatctcccattattactgtgtgggagtctaagtctctttgtaggtttctaaggacttgctttatgaatctgggtactcctgtattgggtgcatatatatttcggatagttagctcttcttgttgaattgatccctttacgattatgtaatggtcttctttgtctcttttgatctttgttggtttgaagtccgttttatgagagactaggattgcaacccctgcttttttttgttttccttttgcttggtagatcttcgtccatccctttatgttgagcctatgtgtgtctctgcatgtgagatgggtctcctgaatacagcacactgatgggtcttgactctgtccaatgtgccagtctgtgtcttttaattggagcatttagcccatttacatttaaggttaatatccttatgtgtgaatttgatcctgtcattatgatgttagctggttattttgctcgttagttgatgcagtttcttcctagtatcaatgggctttacaatttggcatgtttttgcagtggctggtactggttgttcgtttccatgtttaatgcttccttcaagagctcttgtaaggcaggcctggtggtgacaaaattttgcagcatttgcttgtctgtaaagaattttatttctccttctctcatgaaggttagtttggctggatatgaaattctggattgaaaattctttccttaataatgttgaatattggccccaactctcttctggcttgtagagtttctgccgagagatccactgttagtctgatgggcttccctttgtgggtaacccaacctttctctctggctgcccttaacattttttccttcatttcaactttggtgaatctgaaaattatgtgtcttggacttgctcttctcaaggcctatctttgtggcattctctgtatttcttgaatttgaatgttggcctgccttgctaggttggggaagttctcctggataatatcctggagagtgttttccaacttggttccattctccccgtcactttcaggtacaccaatcagatgtagatttggttttttcccatagtcccatatttcttggaggctttgttcagttctttttactcttttttctctaaacttctcttctcggttcatttcattcatttgatcttcaatcactgataccatttcttacatttgattgaattggctactgaagcttgtgagtgcgtcatgtaattctcgtgccatggttttcagctccatcaggtcatttaaggtctcctctacactgcttattctagttagccatttttctaattttttttaaggtttttagctccttgcgatgggttcaaacatcctcctttagctcggagaagtttgttatttccgatcatctgaagccttcttttctcaactcatcaaagtcattctccgtcgagctttgttccattgctggcgtggagctgcgatcctttggaggagaagaggcactctgatttttagaattttcagcttttctgctctggtttctccccatctttgtggtttaatctacctttggtctttgatgatagtgacgcacagatggggttttggtgttgatgtcctgtttgttagctgtccttctaacagtcaggaccctcagctgcaggtctgttggagtttgctggaggtctactccagaccatgtttgcctgggtatcaccagcagaggctgcagaacagcaaatattgcagaacagcaaatgttgctgcctgatccttcctctgaaagcttcatctcagaggggcacccggctgtatgaggtgccagtaggcccctactgggagatgtctcccagttaggctacttgggggtcagggacccacttgaggaggcagtctgtccattgtcggatctcaaactctgtgctgggagaaccactactctgttcaatgctgttagacagggatgtttaagtctgcaaaagtttctgctgccttttgttcagctatgccctgcccccagaggtggagtctacagaggcaggcaggcctccttgagctgcagtgggctccatccagtttgagcttcccagctgctgtgtttacctactcaagcctcagcaacggtggatgcccctcccccagtcttgctgccgccttgcagttcgatctcagactgctatgttagcaatgagtgaggctctgtgggcatgggaccctccgagccaggtgtgggaaataatctcctggtctgccatttgctaagactgttggaaaagcacagtattagggtaggagtgtcccgattgtccaggtaccatctgtcatggttttccttggctaggaaagggaattccccaactgcttgtgcttcccgggtaaggccatgctcttccctgcttcagctcacactcggtgggctgcacccactgtccgacaagccccattgagatgaacctggtacctcagttggaaatgcagaaatcccccatcttctgcgttgctcatgctgggagctgtagactggagctgttcctatttggccatctttagaattgtaatacaagatagccaaaaaatgcagccagaaagagcatttctcaccaagagaccagaccattaagaagactggcacactctgaacagatcttcagaaggaaggcactgagtatatacagaggaaggatgcagatcttgagctgaagggaaaggaagctggaaaccctgcacagggctggcaagcaaccggactcattcatgatcccagtggctctcctagggaggtggtatgttaaatagccaagaagtggctcaatctcaccatagacatccagaatccgaactgccagggacctcatgactcccatggacgtttgagctggcaaggagagctgcttggagaggtggcagggacaggactccagtctgtgtgaagctcagagaatttgacacaggaaaggctgcatggccagtgatgcccatctcccaaggcttggcatgctcctctaggagactttggaatttgttgactgttggacctggacagagcaagaatgtcttccctgtgggatggggcaaatttgatctgagaaccctcctgtctgccagcctcttccaagatcccttcctggctgtcctcgatggtagaacagtcttgaacacctgactttggtgcatcccagtcactgctgccatatcttattcactggcagactctgcctgtcagagagcttcagcagaagggttcctgccaacatatacccacataaagcatccccccaccactttgcaagcacactcacctgcagtttccctctactactttgttggtgtacactcacctgcagacaccaacccctactttgcattgctggtgcacacacaagtctgaaacttatagcccttctgccactggtgcatgcacatgtgcacttcacagccacaatcctgacaccaccagagcatgaacgtggaccccattgtactgctgctgccacaaatacaaactcatgtgaggagtctgccacatcaccaccacgacaagcatgcatgcattgactctactgcactgctgctggtgaatgcacgtgcatggatcccaatgcatagctatctcccactcaagtatgcacacacaaaccctaccatcccaccaccgttggcaagtgcatgtgaatgcagacaccaatgccactgctacaatgaagtgtttttgctggcactgcctatgagaatgttgttgccagcagattgagaaaaacttagatgcagttggttcttaccttcaaagggccaaagaacaatgtcatgtgcctagacccaggccgccagttacagcacattgcccaagaatgctgagctgatccttgacccctacaatcatctagagaaacaaagccagtcaatcgaactcaacttacaacacagtcaaatccacaagggcatcaaagaaagtaaaatgactatccaaaggacagaaacttcaaagattaaaagaggattagcccacccagatgacaaaaaaaaaaaaaacaaaaaacagcccaataactcaggtatctcaaaaactagcatgtcttcttatcatctccaaatgactgtactagcttcccagcaattgttcttaatgctgaaactgctggaatgaaagacatagaattcagtgtctgaatagctatgaagattaatgagattctggaagagttgaaacccaatccaaaacatctagtgaatccaataaagcaacacaagagcagaaagataaaattgccattttaaaaaaatcgaactatctaatagaggtgaaaaactcactgtgggaattttataatacaattggaattgttaaaaaatagaccaagctgagaaaagagtatcagaaaaagagtatcagagctcaaagacatgctttgaatcaactcaatgagttaaaactaaaaaagaaagaataatacagaatgaacaaaacctacaagaaatatgggattatgtaaagagaccaaactgacaactcattggcatccctgagagagaggaagagatcaagcaacttcaaaaacatattagaggatattgtgtacaaaaatacctgaacctcactagagaggtcaacattcaattcagaaaatgaagagaaccctgcaagacactatgaaagatgacaatccctaagatacagtcattacattctccaaagtcaaagtaaaaaaagtattcaaggcaggtagagagatgggcaggtcaccaaaaagggaatcccattgtataagtccattttcacactgttataaaaaactgcctgagaccgggtaatttattaaaaaaaaaagaagtttaattggttcacagttcagcatggctggagaaacctcaagaaacttaaaatcatggcaggaggtgaaggcgaagcaaggtaccttcttcacaaggtgacaggaaggagaagtgccgagaaaagtggtaagagcccgttgtaaaaccatcagatctcatgagaactcactatcatgagaacagcatgggggaaactgcccccatgattcaattacctccacctggtctattccttaacacttggggatgttgggaattatggggattacaattcaagatgatatctgggtggggacaaaaagcctaaccatatcacccatcaagctaatagacttttcaacagaaatgctacaagctacaaaatactggggccctatattcagaattcttaaagaaaagaaattctaaccaagaatttcatatccagccaaacaatgcttcataagttaaggagaaataatatgcttttcagacaagcacgtactaaggaaattgagacaagcatgtgctaaggaaattcactatcaccagatctgctggataaggaatctttaagagagttgtaaacatggtcataaaagaatcacacctgctaaaacaaaaacacatgtaagcacatagtccacaaccactataaagcaactacacaatcaagtctgcataagaaccagctaaaatcatgatgacaaaatcaaatctgtacatatcaatattaatctttaatataaacaggttaaacatcccacataaaagacacagagtggcaagctggcaaagaagcaaaactcaactatatgctgtcttcaagagacacatctcacatacaatgatatccataggctcaaagtaaatggatagagagaaatataccaagcaaatgaaaaacaaaacctagcagaagttgttattctaattgcagacaaacagacttaaaaccaataatgatcaaaaaagataatagaccaactgaaacaagttggttctttgacagaataaagaagattggtagatcactaactagactaataaagaaaagagatacaaataaacacagtcagaaatgacaaaggggccactactgccaacccaacataaatacagaaaaacctgagactagtacaaacacctctatgtgcacaaactggaaaacctagaaggaatgaatacattcctggaaacacactacctcccaagattgaaccaggaagaaactgaaaccctgaacagaccaataagttctgaaattgcatcaataataaaaagcctaccaacaccaaaaagccctggaccagacagagtcacaaccaaatgttgtaagatatataagcaagatctgtaccaatgctactgaaactattccaaaaattgaggagtgtcttctccctaactcattctatgagactagaataatttgaatatgaaaaccaggcagagccacaaaagaaaggtaaaacttcaggctaataatcctgacaaacacaaatacaaaaatattcaacaaaataccagcaaaccaaatccagcagcatatcaaaatgctaattcagcacgaacaagtaggctttatttctgtgatacaaggttggttcaatacatgcaatcaataaatgtaatttatcatataaactaaaacaaaaaccacaggatcacctgaatagacacaaaataatagaaacactaaaaggaaagtgacatagaaaagggaagttaggtacaaaaacagcttgattgtttacagcttggtgtttgccttatttgagcatggcttgaacagttgcctgcctatgattcgttgaaactctatgactggtacaatagtaggttacagtctatttatacctccagttaggttacagttcaccatgtacagagaaaccttcaggacaaacttaaaatatgtaaggaggcagttttcggctagaaggcagttttaacaaatctcccctttcggtcaacttctcaattttgagaaattgactacatctttaggtgttgacataattgtcaccatcataagtagacttatttgttctcaaatcctaatgataaattgaataaggggtattgtaaggtaagaacaagaaaacaaaacagtaggaaaaaactgattacctctggttaccttttcataagggttaaagcagagggggctcacttatgtcagaatctcctgttttcaggagaacaacagcagcaaaaaaaaaaaaaaaaaaaaaaaaaaaaatccaccagtgtcttttgggatctatcttcttccttaaagtttcagttttcttacatcgcatttagcacaagtaaccccactttggtttgttctcctggggcttagtgcaggagcttagttcagaataatggcctcccataattgtggtcaataattcctccctttttgtcaagttctcacttagatgagcgtgtgaccaaaacttggggctttagcactactctcgattatcaccattttgaatttctggtcttagtacatcattcgtagcttatggtgtccatatgattatgcattttgagtttttgttgatcctgtgaaagagatatttgatattctataggtgactgcatgcatgcattttaaaatttgagcgaatgcatgcaccaccagactactattatgactatcacaagaataacaacaaaagtttgaagtatgttccctagccagggtccccatgaaccaccctaattaaaatcaaatatgtcaacaaatgaaccagacaaatagtctattcattttaaccaagcagcctgtttgtcaatcccctgcaagtgaatctctataatacctgtgtgccacaagaagtgtcagcaactgcacagattcttccttgttcagccagtaggtaatctagagcaactctattattgaccacaactttagcaagataatttacagaagtctgtttgctaccatggcagtcatagtaaaatctgataaagagagtattattagcattgaatttctaattatttcctcatttacatttacacctggccttggaaaaagggacataataatgtccatctagaatgatgaaggcctcttgttaatgttctttttgacttatgatgtcaattaacaagagtggaccagtgttctatttctgactgattatggagcaacaaatatgccattaaaattcctagcccacactggcctttcatttttcatccattaaggcacaaagttgtccatatatacagttggctacaaaatacatcacaaataaaagtatatcccatgggtgcacatgggccctttttctcattctattttttcatagagacataagcaggaaaaaaattgagaggtaagagtctgatgatggcaaagaagtcttaatctgtgatcttggaaaatttgtccatgtccacaataccatctgcttctgaggagaacactcctggttagctttaccttgagttctctgatgaacgtacaacatttataaaagtctggaggggcctttatgagttgtgagatgatgaactaaaggttcctggtcctaaagttttgctgcaggtgagtgaaggggggtgcaacgcgtgggtggcaaaagcagtctctctgatggatttactgaagacaaaatgtttgagctctatattagaaaagtaagattgtccttagttggaggatcatggaaagcttcctttacttgttgaaaatacattttggcataatgtattaaaaccttgatgattctgctcaaatcagagtttaggagtgggagttacatgaggttatactactgtgaagagaggtcttccagtgactatttcataaagggtcagtgtatgttttccactggaagtggatctgattgtcatcagactgaaacatctttaaccaagataattcagtagactcggttagctttgcctaatgctattgtgtttgtaatacctcatttcaactgttttccaaattatccagtgaaataagtacctctctcactaaagatttatccatgcataccccaagaagaaaacacatttcctaataaccttttagctattgttgtagaatcagccttcttgcataggaaagcttctatacaaccagaaaacatacacgaaaatggcaattagtaggaaaaataaaaacaaaagttaaataaaataaagaataaaaagggaacacaatgtttaaatctagtgattttcccaaataaacagaaatgatcaatagtgaaaaagttctagagttgcaagagacctcaaggggtccttcaaatagggctattacctcatttatatttacattaagccatggaaaaagggacaaaacaaataatgcccatccagaatgggtattacccaagagacttaatcttttaggataatggatggaaagaagctaaaaaacactctcattctaaaaatactccttaagctaataaaaagagcaaatgaaaaatgcaaatgtttcaagcttaagtaattgtagtattgtcaaagcttattggaatggagattcaaaaatttcctggggagcttattccaggatttaaatattctttctgacccaacgttctccattctatctaacaaacatttatacactataaacccattttctctatttctgtcttctggagaaaagaaaaatgccagtcagctaccagaagacaatttacgtgcctacagacagctgagccttcttttcctttataacaacactccatggtagataataatcaaatgcattattcaatctttttctgtcttggagtttcaatctcatctacagcctctagtgctctgaaatcaagtaaatgacttccggagtaaatctctttgagaaatgctataaaaaaactttcttataaatttacaggttagcagtagtcaaaattgggtacttaggatttatcatccctcaagctatttagttggtattacatttaaaagttactgattctgcctacaaccagaatcagcagagcctgccattccatttgcattgcttatatggtcaattactgcagtcataggccaatcccattgcaatttttccctttttctaagcaggaaaagaaatcccaacaacttgagttgctttcatatgggtatagagtctggttccagttaaatacattattatggaacttattgaataaaggcaagtatctcccagctcacagatttgaccttgacctgcctcacctctcacaatacacaactgtttaagctttttcatataaagacagccacacaatttcctatttatgtcaactattatgttaaaaacatttaattttatttaatatatttttaacttgtctaaattttctaaacatttttacatctttcctacctcgtgaagaacaaaagtaggcacatgagtatgataatcctttgatccttgtatggaatggtcacatataaaggagactattattgtagtggaacatctatatcaatgctattactattaaagcattttagcagtaaaaaaaataaaagaaaatggaaattaaaatctctcaataaatgttcaaatggcctaaggttttgattatcttcccagggttatggatttaacaaaccaaactttggtcacaaaccatattaaccatttagaacagtcaccataccaataactttaagatataatttggatcatttcatttcttctatgattgagtcatggactgcagagcttttaatggaagctttaaagattcagaaaggaccaggcagctgtttaggctctgcatgagtagatgcttaaaactggatttatatcctctgaaatatcagttttgtttcaccagttcaaggtcatagcactgtatattaaataggttatcattggtaatttgacttggaccactgagtttattcaaattgcagatctcaacaatctcagtactgtcttatttagcactaaaatctggaaaaatattttcttggaattcaattaatttttgtcttttgtggttagcagttttatataccagttaatctcttcattagagttcttgtaattattacccagcccaagcgatactaaagttattagaaactcataatcaagagtgcctgtcagggtcatttccatcctttccatgagctttgttgaagaaggattttacttgcttgtaaagagctttcagaaaacatgtcagaattaagcaattacctgtaaacaatagttaatatggtcatggttaaaggcacaattgacaagaacatcgagttatttctgtggtccacaataatttaacataataaccatcattatgactgataacctatactgagacatatcagaattttaggaatatcatacaattttgtaatgcatataatagcatatctataaagctataacttggagattaaacattatgtctttttttggcaatgcttcccatatattttaacatatcaaaaaaggctatttgttacttctcttttggaagctgcagtggcttttagtaatatcccaaagttaaagatcaaaaagacttaattttagaatttagtattttattctggaaagtttgtcaaataccagatatttaggactcctaatattaaattaaaagtttaaaacactaatcaaaatgatatcacagattactgtaaaataatattcatttagtgaaagcaataataaaatggtttttaagaagcaaaatcctttattctttgatagaaaacacactcagttttccaatcaaaaaatctataaaagtatgaaatagaatctgcctctcctttccttttttctttactgtagtttactttaaaagtgaaaaaaactctatctgataaatattacatgaatgtcttgtttaaatgagaaaacaaaattttacttttatattagtttattatcaatactaaagatagttttgacaaattgtcataaacagatccatctattctcaggttttgacaacagatttccataaaacttttataacctcttacaaattaaatttttttattcctcaactttttagactcctttagttttatctacattatttttctccattttgaaacatttaaataacctttaaactagacaaaattattttttctttaggaaaagccatatcctcaaaccttttttgaaaacttcctcatgaaaaacacatcttacttttcgaatactctctgcatatagaattgtttcttatattgagtaattttaattacatatattaatcaaaattttgactctatccccaatttccagtgaaaaaccaaggaagtaattaattttgaactattttatacaagtatttatagatgaaaacaatttcataagtttttagaaagatgtttcttcaattttttaattaacaggtctaaatatatttaccttttctataccatctaaaaattagatgccaaagtatatgaactgcaacgaaaacatatgtttaataattaatatttcagtattttcactaacccacaattgactcagtttatgattatctattatttaatttaacatgtgtttaacattttaaattactaagaagaattttgaaatgatgacacacatacccttcctaacatcttccccagttttcctggttcccaagaagctacctggcactcaagaaaagggatgaagtgcaggacctgtcttggctctaaatttacatatcaaatacagagctcaggacagaggacaggtctgtgaagaggatgtcctggggttgggggagtagggagagatagcagtaggagatatacctaatgtaaatgatgagttaatgggtcaccattttgtcaaaggccttttctgcatctattgagataatcatgtggtttttgtctttggttctgtttatatgctggattacgtttattgctttgcatatgttgaaccagccttgcatcccagggatgaagcccacttgatcatggtggataagttttttgatgtgctgctggattcggtttgccagtatcttattgaggacttttgcatcgatgttcatcagggatattggtctaaaattctctttttttgttgtgtctctgccaggctttggtatcaggatgatgctggcttcataaaatgagttagggaggattccctctttttctattgattggaatagtttcagaaggaatagtaccagctcctccttgtacctctggtagaattcggctgtgaatccatctggtcctggacttttttttggttggtaagctattaattattgcctcaatttcagatcctgttattggtctattcagagattcaccttcttcctggtttcgtcttgggagggtgtatgtgtcaaggaatttatccatttcttctagattttctagtttatttgcatagaggtgtttatagtattctctgatggtagtttgtatttctgtgggatcggtggtgatatcccctttatcatttttgattgcatctacttgattcttctctcttttcttattagtcttgctagcggtctatcaattttgttcatcttttcaaaaaaccagctcctggattcattgatttttgaagtgttttttgtatctctatctccttcagttctgctctgatcttagttatttcttgccttctgccagcttttgaatgtgtttgctcttgcttctctagttcttttaattgtgatgttagggtgtcaattttggatctttcctgctttctcttgcgggcatttagtgctataaatttccctctacacactgctttaaatgtgtcccagagattccggtaggttgtgtctttgttctcattggtttcaaagaacatctttatttctgccgtcattttgctatgtacccagtagtcattcaggagcaggttgttcagtttccatgtagttgagcggttttgagtgagtttcttactcctgagttctagtttgattgcactgtggtctgagagacagtttgttataatttgtgttcttttacatttgctgaagagtgctttacttccaactacgtggtcaattttggaataagtgggatgtggtgctgaaaggaatatatattctgttgatttggggtggagagttctgtagatgtctattaggtccacttggtgcagagctcagttcaattactggatatccttgttaactatctgtcttattgatctgtctaatgttgacagtagggtgttaaagtctcccattattactgtgtgggagtctaagtctctttgtaggtctctaaggacttgctttatgaatctgggtactcctgtattgggtgcatatatattcaggttagctctccttgttgaattgatccctttaccattatgtaatggtcttctttgtctcttttgatctttgttggtttaaagtctgttttatcagggactaggattgcaacccctgcatttttctgttttctctttgcttggtagatcttcatccatccctttattttgagcctatgtgtttctctgcacgtgagatgggtctcctgaatacagcacactgatgtgtcttgactctatccaatgtgccagtctgtgtcttttaattggagcatttagctcatttacatttaaggttaatatccttatgtgtgaatttgatcctgtcattatgatgttagctggttattttgctcgttagttgatgcagtttcttcctagcatcgatgatctttacaatttggcatgtttttgcagtggctggtactggttgttcctttctatttttagtgcttccttcaggagctcttgtagggcaggcctggtggtgacaaaatctctcagcatttgatcatctgtaaaggattttacttctccttcacttatgaagcttagtttggctggatatgaaattctgggttgaaaattcttttctttaagaatgttgaatattggctcccactctctactggcttgtagagtttttgccaagagatccactgttagtctgatgggcttccctttgtgggaaacccgacctttctctctggctgcccttaatatttgttccttcatttcaactttggtgaacctgacaattatgtgtcttggagttgttcttctcaaggagtatcttgtatctcgaggagttctctgtaatttctgcatttgaatgttggcctgccttgctaggttgggcaagttctcctggataatatcctgaagagtgttttccaacttggttccattctccccgtcactttcaggtacatcaatcagacatagatttggtcttttcacatagtcccatatttcttggagtctttgttcatttctttttactcttttttctctaaacttctcttctcacttcatttcattcatttgatcttcagtcactgataccctgtcttccatttgatcgaatcagctactgaagcttgtgcattctgaagatttcttttcttgttactttgttgtctggcattggcattgtgactatactggccccacagtatatgctaagaattattccctctaattctatggtttagaatagtttgaggagtagtgccattcatcctttaagcatttggtaatatttttgagtggttacatctaatctcggcttttctttgttggaagtttttaagataccgactaaatgtctttatgcctttatgacagcagtttctgtcattctaggaatttgtctatttcatctatgttattcaatttgtcatacaactgttcacagtattttttatgacacattttattcttttatcattaatagtaaaatccccttttgccaagggtctcagtgtgcatgctggggcattgacttcaacactcagccagatggtctgcacctgtttcttagtcttcactttctgtttacctagatactcaaagtcagccagaagtcatatctttgggcctgttcaggtctctgtttagcatgcccacatttctatgcatgcatttgtctttttagtatcccccaaattggttgaaacatttccaagcccatatgcattattcactcctcatcttttcctcttaagtttgttggacaatctattgtttgcctaatatccattatctcaggctggagcaactaaaacaattgtatttaaatgtttttgagtcatgtccacagaaagtggtttttaatactgagtcctaaatcaggcaaaataatgactacattttcaagttgggtgttccagggacaactaaacatgttaaagagtgactattctttgggaatatggctttgaaagatgtataccactgacatgctctctttagtatcaataaggtgaactgttatattttccacgggttcagacaagctggaatatagggaatagtatcagtagaagttaaaatggataaagctccctattcttaatggtattcagccatttttctccattttattccctaggtttctatacacatttgattaatttacagagttcctacagtgttgattgtgagttttttttcccttgcttttttccctcagagttcttagtctaccattttactgacataaattgtattcaatttttaaaaatctttagctgcaggctgggtgcggtggctcattcctgtaatcccagcactttcggaggccgaggtgggcggataacctgaggttgtgagttcgagaccagcctgaccaacatagaaaaaccctgtctttactaaaaatacaaaattagccaggtgtggtggcacatgcctgtaatcccagtgactcaggatgctgaggcaggagaatcgcttgaacccaggaggcggaggttgtggtgagccaagattgtgccattgcactccagactgggcagtaaggacaaaactctgtctcaaaaaaaaaaaaaaaatctttagctgcataaatgactacacttctgctgtgttattgacttttcataaatgtttttgtggtaactgttttttaccttgcaccaaaaaaaataaaatggaaaagagtgatgcacctcagtgcactttcttcccagtgtgcaggccagtcagaggttctctggggacccctttatacttggctgtctcactccccctctaaggaagtacatctaactgccattagaataaagataagggtaaggatgaagaccaatcttaactgcttcctgctgacagggggcgctgttttggggaaaactgcagtcagagctcccttaaaggcctatgtaagggttcccagcaaaagggactattctctcaggttccagttgcatgaccgtttgtagttgatggcctaaagccaagaagagacaaaccgggttattacaaaacatgtattaaaatgaaacaaggggaggggtaaggacagcttaaaaatcccgaggccttttaccagttggcatagggagaggaagcctgaaagcctgattggtaaaacaaacaaacaaaccaacaaacaaacacctttacccttttgctggcatgttgggcttctgggttcccttcccttgagcccaatcttaagccaaccagtttaaggtttgggaaattaactctttccagtttggaggatgcatctgagggtagtgtcctatagtagggagacacagttacctatcagtgaagagaggacagaggaggagaatagaaaaaagaaggagcttttcaaaggagtcccagggatcaggatgtatttgaaatgggtacagactcaagatgaatggctacccatctagaaagaggggagcaggcattcccagttcccttctctttctagcagatacccagaatgcattagggagagaaggaagagcatcctctttcccttttccgtccttgcatccccaagttctgggaaccttggcaggtgccacccatgggtgccaaaatggcttgcaaccatgaagcagggagggcctagagaatagaaattatctgctctcatctatatctctatgacaactactgtcagtagctttgacgttccctagacctcatttatgccatggatactagcattacttttatccatgaaacaagaggcttggcttgattggcaggaattagcaatgctcgcctgtgctgcacattttaacctcccttatcatctgtctctggatcccttaggtccagttttcttcctaaggctttgacctgaagcttggaattgagtttgggagaaaaatctgtctcgggggtttgcgtggactcctataataagccaaatgctaaggtgaagctgtagaattgagtcctccttcaacaagggagacaaaaagatgtcttgtgacatgaccagattaactggtggctatagttatgcttggtaaatttgggtgcagggtgcttgtatttggttagctcccttggtcttgttttcccaaaaaggaaaactccaagtggtgggcatcctatttattcccattacctggcaggatttgcaggataattgctcagaacttcagtactgatccagatttttacattacccatccctcttgttatttctgaggtgcagccagagattgctgattggttcacaggaacaagtagggttagtttaaaatgtaggcaaaacttaaaaacaactagtgagtttagaatttaatgacaaatgtatggtaagttttgaaacataatttctttatatctagttctaaattttgctaaaaaactcaaatcatgatagggctaagtggtttgcaaaatagactttagtcttatatttggcctgattatttgcataaagtgcagcaagaataactatttctacataggccctttagattggctttgaagaaactctgttccacaaggagtctcagataagaccttttaaagccaagcccaaccacgtgtttgtatccttaaatacctgtgagttgggtaatcctcacctcttaagttcccaagataaacttggagctgctaggcctgttagaaagtgacatttgttactgaccacaggtcaggaagcctgtacagggactgtgtaggtaagggcatgaggccagtttctcccacagagcttttacccactctgcaagttgagattgactccttaaagggaagcatatgattccagtcaaagccttggtaaaataaccagtttcttcaattgtgccctgttgcaaaagaaaaatggattcttattgcactgatgcaaacaactctattaccataagtttagaatactcacagatagtttccaaattatagaagaatcagagaaaaacaaacatgctacaaattttgttcacaggagtataccttattcaattattaaaggtcatatataattcaaaatagtttccttgatgttgagaaacaaaacaaggatcagcaatattccaagcaaaagttaaaaatatttggttcagtttcctgagttcagtccacttagttaactcttattttgcttgatatttgtcaacatttcagctcttaatgagtgctctacattttcctttattccaatgtcacaatgtccaaagatatcagaaactagtatttgagagcacctgtcaatcttatcacttattataaaccatcttttgaaaaggattaaaacaagacaattgtctatgtataacaaaatgtccagggtaattacagttagaaacacaatagacaaagtagtttggttatctcagtggtttacaataacttaacaaccttaattacggttgatggcagatacttagacattagaattttagaaatcccatacaattttggaatatatattagtattattcaccaaaatataacagaaaggagattgaacaccattttggcattcccatatacctaaatatgttaaataatcctgtttacccctcttttctgaacactccagtggcccttctggagcctccaaaaagccaggtgtcaggaaagatagttttgaaactgaagtttgattctgggaagcctgttaaataagttagaggattaaaacactcgattttacaaaataaaatttcagattaccataaattatttattttgccaaaatgatgactcagaaattttaaataagtaaataaccttttgttttaatgctcaatttacataaaaaccatataatgccatttcgaatttatgcaatatgttcacacagaattttgcaagattaatttttacaatccttccaccacttgtttgaacttttagctttatcctttctaattcaaaataattcttcaaccctaggcagaaatttacattataagaagatatgccttcttatagtctttaactaaagaacacattttactgttcttacaaaccttgcatataaatctatttccagtaatcttaattacatgtcataatggcaagtcctagcaatttttacctttaatctaaaacctggtaagttgttttaattgtgtgctaggtgcagtcaaggtttgactccttccggcataattaagagcacagttagttccatatgcccccaggccttaacaattgtgaagctggcaagttaaatagttcttaaaacccaaagggaaatttataaccttaaaacatttaggaagcttagtacctaacctgcataatttagtccatctatttatatttggatggcgtctgctttttatttctcaaagattaaagtcacatgaactgaaaggtactacagcttttaccttccctttaagaaatatttgatgcaagtgcttgccttcctttaggcctaattagagctctttttatataaattacacacacaacacatatataactacacagacaggcaggagaaaatccaaccccccacaagatccttttacacaaccaaaactttacagagaatataaaaagtgatctttatcattcctagcctagcaaaacatcttccaaaaggaaaaaaaaaaaaacttatttaaaagttaaccgctggacaatgtggagaagaaaaaaggatgcctgggggaagagtctcctattcttatgcaactggttcctccacccggaagaaaagcttaactgttgtgggatggagttagactccctggctgggagatggggagacttcatagacatgtggcagggaatgccagcaagccacctggggtgctttgggccatgtgttccagccccagcaaggaggggagggtggtgaggagccactgcttcccagtctgtcctgaaaaagtaaggaaagagcaatggaaaggcccctgactcctgcgagcaacggggtgggggcagtttgccttaccctcagacgtctgaggatgaaaaggcttagaaatgagagggaaagagatttattggtttgcatctccccttctcaagccccacattgggcaccaaagctgttgtagagctttctctttagttcagctaaaagctgggttcttgtcacatgaccatgagagattaggctggaagacactttgaaaagtgagaaaaatgaaatttattgggcaaaaatggaaacaggaactttcagcagagtgagagtcctgctagtatatgcttcccactttgcagattgaatatccggttccccccaggaagaggaggggccaggttcctccctgctgcaaatggtgcaaacttcctgaggctccaacccagtgtgcattcctcccagtgcacagggtgatcagaggttctctggggacccttttatacttgcctgtctcactttaacataagaaaaatattataatttaaattctttgcatttcataagtttttagattgttttcctcagtgattcttatcttcaggttcaagaaattaaatatactttaaaattgtttgagtctttgttgcagacaagattgcatggactcctttcttgctgcttctctcccaaatgtatattgagaaacttttgcattaacatgaggaacaacaacaacaacaacaaacaaaataaaacaaaaacaagaaacaaaaaactctgagaagtgtaaagaggaaggtcaactggttagggacccatgtactgaaattgcaacataattgggtgttttataacctccaaccaaaagaagatgactcaagactagcattttctgacatctcaataagcaatagtaggttgcaatctgaggaggctcaactctccacccaataaagcaaattaccagctgacaacaatagtaatagcaataggactggcaaaaaaaagaaattcatcaaaaccaccactgataataagtagtcagtggaagtgttctctccaactgggactgaaactccctccctcactgatatgcaccaggtagacaggtggtatcagcaaagaggaccttgccacaacaagtgacctgggctgaaaagcctcttgtcacaggcgagagattcccttctcacatcaagagaaaattggcaacaaggctgatttggaaaagggaatactggccctataagtggcctagtgtaggaaatctcttcatccccccataccagagactcttttccttcacctagagatacctgacagcctgaactgtggaaactctttccacccccacacgtagtagcaaaccagtttataaaagtatgccagaatctgtatgatacacctaaacagaatcatatattggtaaaattaaagatctaaacatgaccatgtgtttcctatcataatatcccaaatatctataataaaattgaaaattacccatcacaccaaatagcagaaaaataacaacttgtatgacaaaaaacaatcaacacactccaagactgacagaaattggatgctagaattaattggcaaggactttaaatcagcctttaaaaaatgtttttaaaagcaattacaagctattttgagagaacaaaaaattaaaatacttcagaaaataaatagatgttaaaaagaaccaaatgtaaactatggaactgaaaaatacaataagagaaataaaaataaactttattggacagacaaaatagaagaggtagaatgataaaagatagaaacagtgatcttgaagaaagatcaacaaagtagatcaaatctttttttttttgagacagggtattactctattgcccagactgaagtgtaatggtgcaatctcagctcactgcaacctctgcctttcaggttgaagtgatcctcccacctttgccccccaagaagctgggactacaagcatgagccaccgtgtctggctattttttgtagaggcagaatttcacaatgttgcccaggctggtcttaaactcctgaggttaagtgatcccccacttcagacttccaaagtactagggttacaggcatgagccatcacacctggccacatatataaaatcttaaaaacagaggccaaggtgggtggatcacttgaggtcagcagtttgagaccagcctggccaacatggtgaaacccatttctactaaaaatacaaaaattagccaggcatggtggtgggcatctgtaatcccaactacttggctggctgaggcaggagaattgcttgaacctgggaggcagaggttgcagtgagccaaaatcacaccattgcacttcagctgggtgacaagagtgaaactccctctcaaaaacacaaaaacaaaacaaaagacacacacacacacacacacacacacacagacacacacaaccagaaacaaatataataaaaggagaaactcaaggacctttgggaaaataacaaagacacaacatttaaaccatcagtggcccaaaaagagaggaaaaaaattggggttgaaaaattactgaaagaaataatggctgaaaactccacaacttagagaagacacaaacttacagatacaagaaagtgagagaaccctacagaagcaaaagtaagctgaaggaaatcctcacaaaaacataacataattaaactcataaaaagtaaaggcaaaaaatatcttcaaaataattcaaaaaagtgacagaactaccaaatggtaaatctgtaaaaatgtagaaaatctgaataaagtgttttctctacactaattttaaaaaggttttctgtctccaagctgagtaagtccacatgaacattaagtaagaaaaagtataaaagaaaaaaatctaagcataaaagtgctatccatactttcaaaatccttggattctctacctttaaattttattcagattttgttccaaaacaatacaaatggtttgaatgttgactccataaacgtttacaacctctgaaaactgttttaaaagcctgaaagagcaatgacttaacccttacagaatagccatggattttgaacaaatagtcaatgtttactatgtaacagttgctttccccattacccttttcttggaagaaataaacagcttccttctggttttaccagaatgcatccattatctctttccacaatgaaactaacatagttacatagagattacagatgcacataagtcaacaactcatgcataatcttaaaaatgctaaatttcaacacaacaatgaagatagaaaatatcatctaaggttctgtcttatctctctagccaagtagagttactttgataaattttgaatttatttttgggcacgtttttacttattttccaggaaaacattcttaacatggacaaacttgagcactgcaatatgctttgatgttaatttttaaatcatcagtatactcttctaaaattgaaagtcttacaaataggcctctttatccttcagagagccatttcatcaatactgagcttttacaaatcagattagaggtagaggtaattagcaaaactaccattttgttcagtgccttacagatatgatgggattagtttcagatcattacaatgaagggaatatcaaaataaagtgagttacacaaggtttcccagtgcacataaacattatgtttacattataccatagtatattaagagtgcaatagaattatgtctaaaagacaatgtatacactgtaatttaaaaatgctttgttgctaatgattatctaagcctttagttgagtcccaatctttttgctggtggagagtcttatactgatgttgatggctgctgactaatcagcatggtggctattgaaaattagagtgtctgtgacgaggaaattaaagaaagaaaaataaaattaaaaagaaaaaagaaataagctttcctgtattaggctgacttatcccagaggcagcaacaggcacagcccagacccaagaagagcctagataaacactatctgagaagctaagacacaaaagaatgtgttctagagactcccagcactccctcaacataaggaagaaaaaaaaatttcctttcttttatagtatgagtttataaagattcctgatatctgtaactagtaacttcaagtattccattttatctaagaagtacaatgaaagtcatgagctgtccgagcaggcctgagctacagccacctgggcgccatagtgaaggttatgagataagccagtgcaaggcttgtttgagcaagcctagataacagccgtctaggcttcatagataacagccatctaggatgtatagcaacagtcatgtgtaatcctgagttatgcacctgtcacaatttaattaactgcctttgttctgcctctgtatccttgcttttgtgccagtacactttgagccactgtaagcttatttcaggccagcccaccccctttttgaagtgtgtataaaggttaagtgctgtctttgttctaaggcccagtcccaagatgttaaaccactagatctgagtgcactcaatacatcctcccactttaccccgaggtctctctagtcctcctgattcccacaacatctgtggcaatttttcaaaataagacaccaataaaatttgccacataaactgactcttcctttcatgaaatgtatctccatagacagtgatgttgtttgatagcattttacccacagcagaacttctttcaaaattagagtcaatcctctcaaaatctgcccctgctttatcaaacaagtttatgtaatattctaaatcatttgttgtaatctcagcaatgtctgcagaatcttcaccagaagtaaattctaaatcaagaaaccactttatgtgttcatccataagaaacaatttctcattcatcaaagttttatcatgagattgcagtaattcagtcacatcttcaggctccacttctaattatagttatcctgctattgctactacatcttcagttacttctcccactgaagtcttgaactcctcaaaatcatctatgagggttgaaatcagcaacttccgaactcctcttaatgttgatattttgatctcctcccttgaatcaagaatgtccttaatgggccgggtgtggtggctcatgtctgtaatcctagcagtttgggaggccgaggaaggtggatcacctgaggtcaggggttcatatgttcttctcgacatatgaaaaggctcaagcaaccacactataggagtggaagacttaaatagcccactggcagtgttagatagatcattgaggaagaaaacttacaaagaaatactggaattgtactcaatatgtgacctattgaacctaagagacattaacaaatactccaaccactaaatgcaaattacacatttttctcaactgcacacagaacatattctataatcagccacatgcttggccacagagcacatctcaataaattaaaaaaaaatgaattcataccaaacgctttcagactacagtgaaaaaaaatagaaatcaatatcaagatcccgcaaaactacaaaagtacatagaaattaaaaaaattctaaattaaggtaaaaattaaaaattatttgaaatgaatgaaaatggagacacaatacaccaaaattgttggaatgtagctaaagcagtgtgaagaggaaagtttacagtgctaaatacaaacatcaagaagttagaaaggtctcaaatgaacaatctaggatcacacctagaggaacttaaaaggaaaaaaaaaagaaatttaccccaaagctaacagaaagaagaaataactataatctgacaacaacggaatgaaatcaaggtgtaaaaagctatacaaaaaatcaataaaaacaatatttggttctttgaaagagtaagtaagattgatagactgatagctagattaacaaaaaataaataaataaaagatccgaataagcacaatcaggaatgacaaagatgacactctaatcccaaagaaatataaaagatccttagagactattatgaacacttaaatgcacacaaattaaaatatcttgaggaaatggataacaattcctcaaaacaaagaacctcccaagaatgaaccaggaagaaagtgaaaacctgaagagaccaataatgggtttcaaaattgaatgagaaaaacaatcaaacaaacaaacaaaacaatgagaacaacaacaaaaaaacaggtgccaaccaaaaaaggtctggaacagatggattcacagcagagttctagcagacatacaaagaactgttatcagttttactgaaactattccaaaaaattgaggaggaggaggaactcctccttagctctttctatgaatccagcatcatcctgatatcaaaatttcacagagacacaacaaaaaataaaaactttaagccaacattctcgatgaacatagatgcaaaaatcctcaataaaatgctaacaaaatgttaaccaaatctttcagcacatcaaaaattaattcactatgatcaagtaggctttagtcctgggatgcaatgttggttcaacatatgcaaatcaataaatgtgattcaccacataaactgaattaaaaacaaaaaccacatgatcatctcaatagacgtagaaaaagcattcaataaactccaacatcccttcatgataaaatcccttaataaataaagaaacatacctgaaaattataagagccatataggacaaacccacagccaatattatactaaatgggcaaaagctgaaatcatacgccttgaaaactggaacaagacaaaactggaacaagatgcttactcccaccattcctattcaacatagtactggaagtccttgacagagcaatcgaacaagagaaagaaataaaaggcatccaaataggaaaagaagttaaactctctctctctttgctgacaatatgattacatacctagaaaaccctaaagactctgccaaaaggctcctagagccacaaaatgacttcagtagagtttcaggatacaaaattaaagcataaaaatcagtaccgttactatgcactaatagtactctagctgagagccaattcaagaatgtcacttcaataccatttacaatagccgcaaagaaaatgaaatacctggggtgcgggggtgttccaagatggccgaagaggaacagctccagtctgcagctcccagtgtgatcgacacagaagatgggtgatttctgcatttccaattgaggtaccgggttcatctcattgggactggttggactgtgggtgcagcccacggagggtgagctgaagcagggaggggcattgcctaagctaggaagcacaagtggtcgggggatttccctttcctagccaaggggagccatgggagactacctggaaaaacgggacattccccacccaaaaactacacttttcccaaggtctcagcaaccagcagacacggtgatcctctcccatgcctcgcttggcaggtcacacacccacggagccttgctcactgctagcacagcagtctgagatcaatcttcaaggcggcagcctggctggcggaggggcgtctgccattgctgaggcttgagtaggtaaacaaagcagctgggaagctcaaactgggtggagcccaccgcagctcaacaagacctactgcctctagactcgacctctgtgggcagggcatagctgaacaaaaggcagcagacaacttctgcagacttaaacgtccctgtctaacagctctgaagagagcagtggttctcccagcacagcgtttgagctctgagaatggacagactgcctccttaagtgggtccctgaagcccatgtagcctaactgggagacacctcccagtaggggccaacagaaacctcatataggtggctgcctctctgggatgaagcttccagaggaaggatcaggcagcaatacttgctgttctgcattatttgctgttctacagcctccgctggtgatacccaggcaaatggggtctggagtggaactccagcaaactccaacagacctgcagctgagagacacgactgttagaaggaaaactaacaaacagaaaggtatagcatcaacatcaacaaaaagttcatctacaccaaaaccccatctgtaggtcaccaacatcaaagaccaaaggtagataaatcacaaagatagggggacaccagaggagaaaagctgaaaattctaaaaatcagagtgcctcttgtcccccaaaggattgcagcgcctcaccagcaacagaacaaagctggacggagaatgattttgacaagttgacagaaggaggcttcagaaggtcagtaataacaaacttctccaagctaaaggaggattttttttttttttttaagaaggagtcttgctctgtcgcccaggctggagtgcagtggcgcgatctcagctcactgcaagctccgcctcccgggatcatgccattctcctgcctcaacctcccaagtggctgggactacaggtgcccgccaccacacccagctaattttttgtatttttagtagagatggggtttcaccgtgttagccaggatggtcttgatctcctgacctcatgatctacccaccttggcctcccaaagtgctgggattacaggcgtgagccaccatgcccggccgttaaaggaggatgtttgaagccattgcaaggaagctaaaaacctagagaaaagattagacgaatggctaactagaaggtagagaagaccttaaatgacatgatggagctgaaaaccatagcatgagaacttcgtgacgcatgcacaagcttcaatagaagattttatcaagtgtaagaaagggtatcagtgattaaagatcaaattaataaaataaagtgagaagacaaggttagagaaaaaaaagtaaaaataaatgaagaaagccaccaagaaatatgggactatgtgaaaagaacaaatctatgtctgatcggtgtacctgaaagtgatgtggagaatagaaccaagttggaaaacactctgcaggatattatccaggaaaacttccccaacctagcaaggcaggcccaagttcaaattcaggaaatacagagaacaccacaaagatactcctagagaagagcaaccccaagacacataattgtcagatttactaaggttgaaatgaaggaaaaagtgttaaggacagccagagagaaaggtagagttacatacaaagggaagcccatcagactgacagcagatctctcagcagaaaccctacaagccagaagagagtgggggccaatatttgacattcttaaagaaaagaattttcaatgcagaatttcatgtccagtcaaactaagcttcataaccgaaggagaaataaaatccttcacagacgagcaaatgctgagagattttgtcaccaccaggcctgccttaaaagagctcttcaaggaagcactaaacatggaaagaaacaaccggtaccagccactgcaaaaacatgccaaattgtaaagaccattgatgcaatgaagaatctgcatcaattaatgggcaaaataaacagctaacatcataatgacaggatcaaattcacacataacagtattaaccttaaatataaataagctaaatgccccaattaaaacacacagactggcaaattggatagagtcaagacccatcagtgtactgtattcaggagacccatctcacatgcaaagacacacataggctcaaaataaagggatggaggaaaatccaccaagcaaacggaaaacaaaaaaatacaggggttgcaatcctagcctctgataaaacagactctaaaccaacacagatcaaaagagacaaagaaggccattacataatggtaaagggattaattcaacaagaagagctaactatcctaaatatatatgcacccaatacaggagcacccagattcataaaggaagtacttagagacctacaaagagacttagactcccacacaatcataatgggagactttaacaccccactgttaatattagacagatcaagaagacagaaggttaataaggatatccagggcctgtactcagtgctgcaacaagcagacctaatagatatctacagaacttgccaccccaaatcaacagaatatacattcttctcagcaccacatcgcacttactctaaaattgaccacataattggaagtaaaacactcctcagcaaatgtaaaagaaaagaaatcacaacaaactgtctctcagaccacagtgcaatcaaattagaactcaggattaagaaactcacttaaaactgcacaactacatggaaacctaacaacttgctcctgtgtgactactggataaataacgaaatgaaggcagaaataaagatgttctttgaaaccaatgagaacaaagacacaacataccagaatctctaggacacatttaaagcagtctgtagagggaaatttatagcactaaatgcccacaagagaaagcaggaaagatctaaaatcgacaccctaacatcacaattaaaagaactagagaagcaagggcaaatacattcaaaagctagcagaaggcaagaaataactaagatcagagcagaactgaaggagatagagacacaaaaaaacccttcaaaaaaatcaatgaatccatgagctggttttctgaaaagatcaacaaaattgatagactgctagcaagactaacagagaagaaaagagagaagaatcaaatagatgtaataaaaaatgataaaggggatattacaactgatcccacagaaatatgaactaccatcagagaatactataaacacctctatgtaaataaactagagaatctagaagaaatggataaattcctggacacacactttcccaagactaaaccaggaggaagttcaatctctgaatagaccaaaaacagcctctgaaattaaggcaataaataatagtctaccaaccaaaaaagtccaggaccacatggattcatagcagaattctaccagatgtacaaagaggagttggtaccattccttctaaaaaatcccaatcaatagaaaaagagggaatcctccctaactcattttatgaggccaacatcatcctgataacaaaacctggcagagacacaacagaaaagagatttttagaccaatatcccagatgaacatcaatgcgaaaatcctcaataaaatactggcaaactgaatccagcagcacatcaaaaagcttatccaccatgatcaagtcggcttcatccctgggatgcaaggctggttcaatatgcccaaatcaataaatgtaatccatcacgtaaacagaaccaatgacaaaaagcacatgattatctcaatagatgcagaaaaggcctttgacaaaattcaacagcccttcatgccaaaaactctcaataaactaggtattgatgggacatatatcaaaataataagatctatttatgacaaacccacagccaatatcataccgaatgggaaaaaaccagaagcattgcctttcaaaactggcacaagacaagaataccctctctcaccacttctattcaacagagtgttggaagctctggccagggcaatcaggcaggagaagaaataaagggtattcaattaggaaatgaggaagtcaaattgtccctgtttgcagatgacatgactgtatatttagaaaaccctatcgtcgcagccccaaatctccttaagctgataagcaaattcagcaaagtctcaggatacaaaattaatgtacaaaaatcacaagcattcccatacaccattaacagacagagagccaaaccatgagtgaactcccattcacaattgcttcaaagagaataaaatacctaggaatccaacttacaagggatgtgaaggacctcttcaaggagaactacaaaccactgctcaatgcaataaaagaggacacaaacaaatggaagaatattccatgctcatggataggaagaatcaatatcgtgaaaatggccatactgcccaaagtaatttgtagattcaatgtcatccccatcaagctaccaattactttctttacagaattggaaaaaactaatttaaatttcatatggatccaaaaaagagcctgcattgccaagacaatcctaaggaaaaagaacaaagctggagccatcacgctactggacttcaaagtatactacaaggctacagtaaccaaaacagcatggtactggtaccaaaacagagatatagaccactggaacagaacagagccctcagaaataatgccacacatctacaaccatctgatctttgacaaacctgataaacataagaaatggggagaggattacctatttaataaattgtgctgggaaaactggcgagccatatgtagaaagctaaaactggatcccttccttacaccttatacaaaaattaattcaagatggattaaagacttaaatgttagacctaaaaccataaaagccctagaagaaaacttaggcaataccattcaggacacaggcatgggcaaggacttcatgactaaaacaccaaaagcaatggcaacaaaagccaaaatagactaatggtatctaatgaaactaaagagcttctgcacaggaaaagaaactaccatcagaatgaacaggcaacctataaaatgggagaaaagtgttgcaatctacctatctgacaaagggctaatatccagaatctacaatgaactcaaacaaatttaaaagaaaaaaacaaacaaccacatcaaaaagtgggcaaaggatatgaacagacacttttcaaaagaagaaatttatgcagccaacacacacatgaaaaaatgctcatcatcactggtcatcagagaaatgcaaatcaaaaccacaatgagataccatctcttaccagttagaatggcaatcattaaaaagtcaggaaaccacagatgctggagaggatgtggagaaataggaatgcttttacactgttggtgggagtgtaaattggttcaaccattttggaagacagtgtggtgattcctcaaggatctagaactagaattaccatttgatccagtaatcctattactgggtgtatacccaaaggattataaatcatgctactataaagacacatgcacacctatgtttactgcggcactactcacaacagcaaagacttggaaccaacccaaacgtccatcaatgatagactggattaagaaaatgtggctcatatataccgtggaaaactatgtagccataagaaaggatgagttcgtgtcctttgcagggacatggatgaagctggaaaccatcattctcagcaaactatcacaaggacagaaaaccaaacaccgcatgttctcactcataggtcggaattgagcaatgagatcacttggacacagggcagggaacatcacagactggggcctgtcagggggtgtgtggctggaggagggatagcattaggagaaatgtaaatgatgagttgatgggtgcagcaaagcaacatggcacatgtatacctatggaacaacctgcacgttatgcacatgtaccctagaactgaaagcataataaaacaaaaaatatttatttctaaaaatccacacaaacaacaaaaaaagaaatacctaggaatacagctaaccaaggaggtgaaagattactacaaaaagaattacaaaacactgctgaaagaaattagagatgatataaataaacaaacacttcatgctcatgttcagaagacttaatattattaaaatggccatagcacctaaagcaattgacagattcaatgctatccctattaaactaccaacaacattttttcacagaattagaaaaaaagacttctaaaattcatatggaaccaaaaaaagcatctggataaccaaagcaactcaaagcaaaaaaaaaaaaaaaaaaaaaaaagctggagcagcactttttctgacttcaaactatactagaaggctacagtaatcaaaacagcattgtactggtacaaaaaacaaaaacaaagaaagacacatacaccaagggaagagaaaacggaactgagatgtaaaggtgcacacctaccaccacctaatcttcaacaaacttaagaaaaacaagcaataggaaaaagactacctattcaataaatggtgctgtgagaactggctatccatatgcagaagaatgaaactggaccattacctaccaccatatacaaaaattagcttgagaaggattaaggacctaaatgtaagacctcaacctatgaaaatcctggaagaaaacctagaaaatgcccttcttgatattggccttggcaacatatttatggctaagtcctcaaaataaattgcaacaaaaataaaaattgattaaataagacttaattaatctaaagagcttctgcatagcaaaagaaactatcaaggaagtaaacagacaacctatagaaggggagaaaatacaaactatgcagccaacaaaggtctaatatgcagaatctataaggaatttaaacaaatcaataagcaaaaaaccactccatttaaaattgggcaagggacatgaacggacatttctgaaaaaaaagacatacaagtggccaacaaacatatgaaaatatatcatcattaatcataagagaattgcaaatcaaaccataatgatatgccatctcaaaccagtcagaatttattttgtggaaaaataaaaacataatacgttggcaaggctgtggagaaagggggacacatacctttttggtgtgaatgtaaattaatttagccattgagtagagcactttggagatttctcaaacaaccaagatttgaaccaccattccactcagcaattgcattactgggtatatatccaaaggaaaataaatcattttacccaaaggatgcatgcacctgtatgttcgtcacagctctatccacaatagcagaaatatggaatcaacccaggtgctcatcaatggtggattgtataaggaaaacgtaatccatatacaccatgaaatactacacagtcataaaaaagaatgaaatcatttcctttgcagcaacatggatgcaactggaggccattatgctaagcaaactaatgcagaaacagaaaactaagtaccacatgttattacttataagtgagagctaaacactgggtacacatgaacataaagatgggaacaataaacactgagaactactagggtgtgagagaagggggagggggagggctgaacaactaccttttggatagtatgttctctaccttggtgacgggttcagtcgtatcccaaacctcagcatcacacaataaacctttgtaataaacctgcacatgttcccactggttctaaaataaaagttgaaaaaaatgataattatcctcctttttgtattaagattattttgatttcaaatgacaggaaacccaatcacaagtgagctaagtaaaaatacttttttttttttttttagacagagtcttgctctgtcgcgcaggctggagtgcagtggcctgatcttagctcactgcaacctctgtctcccaggttcaagcaattctcatgcctcagcctcccaagtagttgggactataggcacatgctaccatgtccagctaatttttgtatttttagtagagatggggttgcgccatgttggccaggctggtcttgaactcctgacctcaagtgattcacctgtctcagcctcccaaagtgctgggattgcaggcgtgagcccccttgcctggccaaaaagatcaaattttgtctccctaattgcaaagtcccagggaagacttgcctctgtcatggcttgatcaaagagataaagtgattacacttaaaccaaactgagaataagattagtagttacggtacaagtttgaaattttatgtcacatatatgaggtcttgggtctccaatgatttgccctttactcacatagagaacactggacattcttactgttccacggaatcttatctgcaggccgaagtcagttaattattatcttgtatggttcacatcttgtttactgcaaatacctcacaaatctatcttatcatgccctctttacaaattgggattggcagaaatgcggataaatatcctcattctgagtgaacacactatggctgtctagttgaacaaatgatccttgtagccagtttgaacaaggtgccatctctctgaggtatgctaacgttctgatataataatatttttggataagaaaaatttcaaatcaaactgacaaacttgctttttttttttcactcttgttgctcaggctggagtgcaatggtgcgatcttggctcactgtaacctccgcctacaaggttcaagttattttcctgcctcagcctcctgagtagctgggattacaggcatgtgccaccacgcctagctaatttttgtatttttagtagagacggggtttctccatgttggtcaggctggtctcaaactccctacttcaggtgattagcctgccttggcctcccaaagtgctgggattacaggcgcgagccactgtgcccagtccggaattgcttttttttttgagaataaaattttgaaagctggaaaaagaatttccaatatatgctacaacttgcagaggaaacagatatggttgtggtgcaagcagtagccatgggtccagacccctttatcatccttatcaaacttccccagtcactcagattcttttctgaattctatgatgagcactgcactcaagaggagcactgtgttaattagcaatggatcttaattgtaggaggagtcagaaagcaccttatttgtggctataagacagacagacagactgtccactaaatgatgaaagtggtgaggagaaaaatgaaatcagatatatagtttattactttataatgtatgatttagttacagtggcataacttcagctaacagcgtaaaaataaatgttgtcctccggtttgccctagattcaataattagaatacatttaacaattgtacctgtaatgtaaaacattgcattttttgcctttatacttggccaaactagagatatttcattttcagttgacactgacagaataaggttaataagttacataaataggacaaagatataaaattcgtagaggattatgaaacatcacagaaaattgaatattaatttgaaacgttatttgatatggtgttttgatgtcatcacagcagctacgtggcacttagaatctgtgcatctgggggagggagagcgcgctgattgtggaacttaccattggaactcagtgctgccctgtcccaacagaaagcaacaccaggcagaactcacattgtgtccacagagaaagcaattaaaccagctctagaaatcatcaatcccagcagtaggaacctaagttccagcaagcctctcaccatgggataaaatcctctggaaccctaaacaaactggaaaggcagtctaggaaataataattgcaattcttgggcaagtcctggttctgtgcttggctcagagccagtggacttgaggggaatatgacctagtgggacacctcttgggttgccaaggtagtgcttgttccaccccctccttaatcccaggaagcacaaatagcagctccaggagaaactccttccctctgcttgaggggagagggaagagtaaagaggactttgtcttgcaacttggataccagttcagccacagtaggacagggcagcaagcagagtcctgaggcacctgcctcaggccaaaggggagtccactgccttgaatggagaattccaggcctggcagcattcatcacaagctgaaggtagagcctttgggcctttttggtgccagctcagctgcagtagaaagagcactggctagattcctaagatttctgactgtagaacctggctccctgatggcatctctggacctgactggggctgcggggaacttgccaaactgaatggaaagacacaaacctggctggctctgccaacttctgattgcagaggcctaggaccttgtgtgaacaaggcagtggttacccgaggccttgagcgagaccaagtaccatgctggcttcaggtctgacccatcacacaagtaccatgctggcttcaggtgtgacccatcacagtcccagtggtgcggaccacagtagtgcttgtgtcacccctcatccagctccaggtggctaatcacagagggagaaagaaagagagaaagagagaaagagagagagagagagagagacagagagacagagagagagagagagagagagagagagactctatttatttgggagaaagtaagggaagagaacaagagtccatgcctggtaatccaaagaattcttctgaatcttatctaagactactgaggcaatacctcttcaagtctgtaagagccacagcttaactgggcttgtggggcctcctaatgtagatatggctgcagaaaacaaaagcttagataacaacacccaagtccctttgaatacctgaaaagccttcccaagatggatgggtacaaacaagcccagactgtaaagagtacaataaatacttaactctttaatgtccagacactgatgaacatccataagaccatccaggaaaacatgacctcaccaaatgaactaaacaaaggaccagaaactaatcctggagagacagagataggttacctttcagactgagatttcaaaatagctgttttgaagattctcaactaaatccaagataaaatagagaagaaattaagaatcctaatagataagtttaacagagattaaaataattaaaaagaattaagcagaattttgagatgaaaaaatgcaattgacatactgaagaatatgtcagagtctctcaccagcagaactgaccaaggagaaagaagaatttagtgagcttcaagataggctatttgaaaatatagtcaggggagacaaaaaaagaatgaagcacacctatgagatctagaaaatagcctcaaaaaagcacttctaagagttattggccttaaagaggtcattgagaaagagataggggtagaaagtttacacaaatagataataagagataacttccccaaactagagaaagatattaatatacaagtgcaaaaaggttataggacaccaagcagatttaatgcaaagaagactacatcaaggcatttaataatcaaactcccaaaaatcaaggataaaaaaaatgatattaaaagcagcaagataaaagaaacaagtaatatacaaaaacaagtaatatacaatgcagctccaatacgtctggcagtagacttttcagtggaaaccttataggccaagagagagtggcatgccatatgtaatgtgctgaagaaaaacaaaaaaacaaaaaacctttttatccaaaagtattttatccactgagaatatccatgaaacatgaaggagaaatactgtcccagccatagaaagtagaaggatttcattaacaccaagtttgtcctacaagaaatgctaaagagtttttcattctgaaagagaacaaaattaatgcgcaatcagaaatcatctcacagtgtaaaaattactggtaatagtaattactggtaatagtaagtgcacagaaaaatacagaatattataacactgtaattatggcatgtaaactacttacatcttagtagaaagactaaaaaatcaaaataataaaaacttttcaagagagatagtacaacaaaatataaatggaaacaacacaaagttaacaagtggaagaaaaaagttaaagggtagagtttttattaattttcttttttctggtttgcttgtttgttgaggcaatcagtgttgagttgtcatcagttttaagtaacaggttgtaagacactattaccatgaggtaacctcaaattaaaaaacatacggtatattaaaaaatagagcaagaaattaaaataaatcaccaaagaaaatcaccttcactaaagaaagacaggaaggaaggaaggaaagaaggtaaagaagaccacaaaacaaccaggaaacaaataacaaaatggtaagagtaagtccttacttgtcaaaaatcttaaatgtaaatgtgctcacctctccaatgagaatacatagagtggctaaatggataaataaacaagacccaatgatcccttgcctacaagaaacacactttacatataaaaaacacacagagactgaaaataaagggatgaaaaaatattccatggaaatggaaaccaaaaaagagcacaaattgccatacttaagaagaaaaaactataagagacaaagaaggtcactctacaatgagaaaagggtcaattaactcagtaagagaatataagaattataaatatacatgcacccaacacaggagcacctggttatataaagaaaatattattacgcctaaagagagatagactccaatacaatagctggagatttcaacagcttattttcagcattctgtcataaagacagaaaatcaaagaaacattggacttaatctgcactacagactaaatggacataatagatatttatagaacattggatttgtgggcacagaaaacacattcttcttctcagcagatgtaacattctcatggctagaacataggttgcaaaacaattcttaaagaattaaaaaaattgaaattatatgaaatatcttctctgatcaacatgaaataaaaccagaaatcaataccaagaggaattctggaaactataaaaacacatggaaattaaacaatatgttcctgagtgactggtgggtcaatgaataaattaagaagaaaaatgaacaatttcttaaaaccagtgataatgataacacaagatatcaaaacgtatgggatacagtgaaaacaatacaaagaagaaaatatatagctataagtgcctataccaaaaaagtagaaaaactgtaaataacctaatgaggtgtcttaaagaactaggaaagcaagaacaatgaaaactcaaaattaatagaagaaaaaaagaaataataaggaccagagcagaaatataattgaaatgaataaaagatcaatgaaatgaaaattggattctagaaaagataaacaaaattgacaaacctttacccagacccagaaaaagagagagaaggtccaaataaataaaatcagtgatgaaaaaaagacattagggggcggttccaagatggtcgaataggaacagctccagtctacagctcccagcgtgagcaacgcagaaggacgggtggtttcttcatttccaactgagttaccaggttcgtgtgactggggcgtgtcggacagtgggtgcagggcagtgggtgcagcccacttcgagagccgaagcagggtgaggcatcagctcacctgggaagtgcaaggggtcagggaattccctttcccagccaagggaagccttgacagacagcacctggaaaatctggtcactcccacccaaatactgcgctttcccaagggtcttagcaaacagcacaccaggagattataacccgcggctggctcggagggtcccacacccacagagcctcgctcattgctagcacagcagtctgagatcgaactgcaaggtggcagcgaggctgggggaggggcgcccaccattgccgaggcttgagtaggtaaacaaagcagccgggaagctcaaactgggtggagcccactgtagctcaaggaggcccaactgcctctgtagactccacctatggggcagggaatagctgctcgaaaggcagcagaaacttctgcagacttaaacgtccctgcctgacagctttgaagagagtagtggttctcccagccggagtttgagatctgagagcaaacagactgcctcctcaagtgggtccctgacccctgagtagcttaactgggaggcaccacccagtaggggcagactgacacctcacatggccgggtacacctctgagacgaagcttccagaggaacgatcaggcagcaacatttgctgttcggcaacattcactgttctgcaacattcgctgttctgcagcctctgctgctgataaccaggaaaacagggtctagagtggacctctagcaaactccaacagacctgcagctgagggtcctgactgttagaaggaaaactgaaaaacagaaaggacatccacaccaaaaccccaactgtacgttaccataatcaaagaccaaaggtagataaaaccacaaagatggggaaaaaacagagcagaaaagctgaaaattctaaaaatcagagtacctctccgcctccaaagaaatgcagctcctcgacagcaacggaacaaagctggagggagaatgactttgacaagtggagagaagaaggcttcagaagatcaaacttctctgagctaaaggaggaagttcaaacccatcacaaagaagctaaaaaccttgaaaaaaagattaaacgaatggctaactacaataaccagtgtagaaaagtccttaaatgacctgatggagctgaaaaccatggcacgagaactatgtgacaaatgcacaagcttcagtagccgattcgatcaactggaagaaagggtatcagtgattgaagatcaaatgaatgaaattaagcgagaagagaagtttagagaaaaaagagtaaaaagaaacgaacaaagcctccaaaaaatatgggactatgtgaaaagaccaaacctacgtctgactggtatacctgaaagtgacagggagaatggaaaaaagttggaaaacactgcaggatattatccaggagaacttccccaacctagcaaggcaggtcaacattcaaattcaggaaatacagagaacgccacaaagataatcctcgagaagagcaactccaagaacatacttgtcagattcacgaaagtcgaaatgaaggaacaaatgttaagggcagccagagacaaaggtcaggttacccacaaagggaagcccatcagactaacagctgatctcttggcagaaactctacaagccagaagagagtgggggacaatattcaacattcttacagaaaagaattttcaacccagaatttcatgtccagccaaactaagcttcataagtgaaggagaaataaaatcctttacagacaagcaaatgctgagagattttgtcaccaccaggcctgccctaaaagacctcctgaaggaagcacaaaacatggaaaggaacaaccagtaccagccactgcaaaatcatgccaaattgtaaagactatcgaggctaggaagaaactgcatcaactaacgagcaaaataaccagctaacatcataatgacaggatcaaattcacacataacaatattaactttaaatgtaagtgggctaaatgctccaattaaaagacacagactggcaaactggataaagagtcaagacccatcagtgtgctgtactcaggagacccatctcacgtgcagagacacacataggctcaaaataaagggatggagaaagatctatgaagcaaatggaaaacaaaaaaaggcaggggttgcaatcctagtctctgataaaacagactttaaaccaacaaagatcaaaagagacaaagaagaccattacataatggcaaagggatcaattcaacaagaagagctaactatcctaaatatatatacacccaatacaggagtacccagattcataaagcaagtccttagagacttacaaaaagacttagactcccacacaataataatggaagactttaacacccaaatttaaacaaaagacagaccaacgagacagaaatttaacaaggatatccaggaattgaatttagctctgcaccaagtggacctaacagacatctatagaactctccaccccaaatcaacagaatatacattcttctcagcaccacattgcgcctattccaaaattgaccacatagttggaagtaaagaactcctcagcaaatgtaaaagaacagaaattataacaaactgtctctcagaccacagtgcaatcaaactagaactcaggataaagaaactcactcaaaaccactcaactacatggaaactgaacaacctgctgctgagtgactactgggtacataacaaaatgatggcagaaataaagatgttctttgaaaccaatgagaacaaaaacacaacctacttgaatctctggcacatatttaaagcagtgtgtagagggaaatttacagcactgaacacccacaagagaaagcagaaaagatctaaaattgacatcctaacgtcacaattgaaagaactagagaagcaagagtaaacactttcaaaagctagcagaaggcaagaaataacaaagatcagagcagaactgatggagatacagacacaaaaaacctttcaaaaaaatcaatgaatccagggctggttttttgaaaagatcaacaaaattgacagaatgccagcaagattaataaagaagaaaagagagaagaaagaaatagacacaatgaaaaatgagaaaggggatatcaccaccgatcccacagaaatacaaactaccatcagagaatactataaacacctctacgcaaatcaactagaaaatctagaagaaatggataaattccaggacacatacaccctcccaggactaaaccaggaagaaggtgaatccctgaatagaccaataacaggctctgaaattgaggcaataattaatagcctaccaaccaaaaaatgtccaggaccagacggattcacagccaaattctaccagaggtacaaggaggagctggtactattccttctgaaactattccaatcaacgaaaaagagggaatcctccctaactcattttatgaggccaatatcatcctgataccatagcctggcagggacgcagccaaaaaagagaattttataccagtatccctgatgaacatcgatgtaaaaatcctcaataaaataccggcaaactgaatccagcagcacatcaaaaagcttatcctccatgatcaagtgggcttcatccctgggatgcaaggcaggttcaataggcggaaatcaataaatataatcaagcatataaacagaaccaaatacaaaaaccacatgattatctcaatagatgcagaaaaggcctttgacaaaaattcaacaacccttcatgctaaaaactctcaataaattaggtattgatgagacgtatctcaaaataataagagctatttctgacaaacccacaggcaatatcatactgaatgggcaaaaactggaagcattcctgttgaaaagtggcacaagacagggatgccctctctcaccactcctattcaacatagtgttggaagttctggccagggcaatcaggcaggagaaacacataaagggtattcaattaggaaaagagaaagtccaattgttcctgtttgcagatgacatgattgtatatctagaaaaccccattgtctcagcccaaaatcttaagctgataagcaacagcaaagtctcaggatacaaaatcaatgtgcaaaaatcacaagcattcttgtacaccaataacagggaaacaggaagccgaataatgagtgaactaacattcacaattgcttcaaagagaataaaatacctaggaatccaacttacaagggatgtgaaggacctcttcaaggagaactgcaaaccactgctcaaagcaataaaagaggacacaaacaaagggaagaacattccatgctcatggataggaagaatcaatattgtgaaaatggccatactgcccaaggtaatttatacattcaatgccatccccatcaagctcccaatggctttcttcacagaattggaaaaaactactttaaagttcataaggcaccaaaaaagagcccgcaatgcccaagaaaatcctaagctaaaagaagaaagctggaggcatcacgctacctgacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagaaatggggaaaggattccctgtttaataaacggtactgggaaaactggctcgccatatgtagaaagctgaaactggatcccttcattacaccttatactaaaattaattcaagatggattaaagacttaaatgttagacctaaaaccataaaagccctagaagaaaacctaggcaataccattcaggacataggcatgggcaaggacttcatgtctaagacaccagaagcagtggcaacaaaagacaaaattgacaaatgggatctaattaaactaaagagcttctgcacagcaaaagaaactaccatcagagtgaacaggcaacctacagaatgggagaaaatttttgcaatgtactcatctgacaaagggctaatatccagaatctacaaagaactcaaacaaatttacaagaaaaaaacaaataaacccatcaaaaagtgggtgaaggatatgaacagacacttctcaaaagaagacatttatgcagccaacagacacatgaaaaaatgctcatcatcactggccatcagagaattgcaaatcaaaaccacagtgagataccatctcagaccagtcagaatggcaatcattaaaaattcaggaaacaacacgtgctggagaggatgcggagatatacgaacacttttacactgttggtgggactgtaagctagttcaaccattgtggaagacagtgtggctattcctcaaggatctagaactagaaataccatttgacccagtcatcccattactgggtatatacccaaaggattataaatcatgctgctataaagacacatggacatgtatgtttattgtggcactattcacaatagcaaagacttggaaccaatcgaaatgtccatcaatgatagactggattaaaaaaatgtggcacatatacaccatggaatactatgcagccctaaaaaaggatgagttcatgtcgtttgtagggacatggatgaagctggaaaccatcattctcagcaaagtatcgcaaggacagaaaaccaaacaccgcatgttctcactcataggtggttattgaacaatgagaacacttggacacaggaaggggaacattgcacaccagggctgttgtggggtggggggaggggggagggatagcattaggagatatacctaatgtaaatgatgagttaatgggtgcagcacaccaacatggcacatgtatacatatgtaactatcctgcacgttgtgcacatgtaccatagaacttaaagtataatttaaaaaaaagaaaaaaagacattaaaattgatactgcagaaatcaaagaattattagatgtccctatgaacaactatacaccaataaattggaaaacccagaagaaatggatgaattccaaaatgcttataacctaccacgactgaaccatgaagaaatccaaaatgtaagctgatcactaagaagtaacaagatagaagccaaaataaatagtctctcagcaaagaaaagtccaggacctgatggcttcactgttcaattttaccaaacacttaaagagctaataccaatcctactcaaactgttctgaaacaatgaggagtgaatacttccaaactttctatgagaccagtagtaccctgctaccaaaaccagaaaaagacacatcaaagaaagaaaaccacatgctaatatatgataaacattattgcaaaaatcctcaacaaaatactagcatatcaaattcagcaacatattaaaaacattattcatcatgaccaggtgagatttatcccagggctggaaggatggatccacatatgctaatcaatcattgtgttacatcatatgaacagaatgaagggaaaaaaatgatcatttcaattgatgcagaaaaaacatttgacaaaattcaacatcccttcaagataaaaactctcaaaaaataagcatagaaggaacatacctcaagacaataaaagccataaatgacagactgatagctagtatcatactgcatggggaaaaactgaaagcctttcctctaaattctggaacatgagtatgccaaatttcaccactcttattcaacataatactgaaagtcctaactataagaatcagaaaaaagaaagagataaagggtgtccaagttgaaaagaaataagtcaaatcaccctcctttgcgaataatatgatcttgtatttggcaaaacctaaagactcagcagaaaattataggaactaataaacaaattcagtaaagttcaagaatacaacattaacatagaaaaatcagtaacatctccatatgcaaacagtgaacaatgtgaaaaagaaaccaagaaagtaacacaatgtaaaacagctacaaataaaatttaaaacattgaaataaacttaactgaagaagtcaaagatttctacaatgaaaactatgaaactttgatgaaagaagtgaagagtatacagaaaaggaaatatattcaatgtccatggattgacagtatcaatattgttaaaatgtctacactaccagaagccatctatagattcaatgtaatccctatcaaaataccaatgacattcttcacagaaatagaaaaaacaaccctaaaatgtatatggaaacaccaaaaactcagaatattaaaaactgttctgagcaaaaagaaccaaactgaaggaatcacgttacctgatttcaaattatactacagagccatataaccaaaacagcatggtaatgacataagaacagacacataaattaatggaacagaacacaggacctggaaacaaatccagacatctgcagtgaactcaatttcaacaaaggtgccaagaacacatgttatggaaagaacagtctgctcaataaatgtcactggcaaaactgtgcagaaggatgaaacttgattcctatctctcaccatatgcaaaaatcaaatgaatatgtattaaatacttaaatcgaagacctcatactatgaaactactaaaagaaaacattggagaaactatccagtacattggaataggcaaagatttcttgagtaataccctgtaagcacaggcacccaaaccaaaagcggacaaatgggatcatgttaaaattaaaaagcttctgcagagcaaaggaaacaaagagcaaagtgaagagacaatccaggttgggaaaaaaaaaagtttgcaatctctccacatgacaagggattaataattaaaatatctaaggtgctcaaacaactctattgggaaaaatctaataatctcattaaaaaatgggcaaaagatctgaatttttcaaaagaagacatacaaatggtaaggaggtatatgaaaagttcctcatcataaatgcttatcagagaaatgcaaatcaaaactacaatgagatattaccttaccccagttaaaatggcttatagccaaaagacaggtaataacaaatgctggtgaggatgtggagaacagggaaccctcgtacactgttggtgggaatataaattggtacagtactatggagaacaatttggagttttctcaaaatactaaaaacagagctaccatatgatccgtcaatcctgttataaggtatataccccaaagaatgggagtcagtatactgaaaaaatacctgcactctcatgcttattgtaccatttttcacaatagccaatatttgaaagcaatctacatgtccatcaacagatgaatatataaagaaaatgtggtaaatatacacaatggagcactattcagccataaaaagattgagattctgtcctttgcaataacttagatggaactggacatcattatgttaagtgaaataagccaggcagagaaagacaaaattcttatgttctcacttacttgtaggagctaaaaattaaaacaattgaactcatggagctagagactaaaacaatggttaccacaggccaaaaagaatagtgcagtggaaagttaatggttacaaaaataaagctagataaaatgagtaagatctagtattggatgtcacaacatggtaactacagtcttcaataatttcttatacattttaaaagaactaaaagattataactggattgtttgtaacacaaagaaaatataaatgcttaaatgattcatatcccatttaccctgatgtgattattaggaagtgtttgcttgtatcaaaatatctcatgttctgcagaaatatattcacctactaagtacacacaaacataaaaaaatttaaaaaataaaataaaaataacagtaaataaaaaatgggacaaggacctgaagagacatttctcaaatgaagaaatataaatggccaacttgcatatggaaaaaatgttctaaatcactagtccgcagagaagtgcaaattaaaaccacaatgacatatgacctcgcattttttagagtgccttttatcaaaaaggtaaaagaattgttgacaaggatgtggagaaaaaagaacccctgcacactgttggtggagatgtaaattagtacagccattatggaaatcagtatggaggttcctcaataaattaaaaataaaactacttcatgatccagaagtctcacttctgggtatatccaaaggaaatgaaatcagtatttcaaaaggatgtctgtactcccatgttcattgcagcattattcataatagccaagacatgtaatcaatctaagtatctattgatgaataaaggaagaatatattatatatattagaatgcattttatatttatatatatgtatacacacacacacacacacacagtggaatactcttcagtcttaaaaagagggaaattttgtcttttgcaataacatggatcaacctagataacattaggtaaagtgaaataaggcaggcacagaaagacaaatactgcattatcttatttgtatgtggaatccaaaagagttgaatgcatataggtagtgagtagaatgatggttacctgagacttggagtggttactaggactgggtgttgggggaattttttcaaaggatacaaaatttcaactagatagggagaataagtttaagagatctattatataaagtggttaatatagctttaatgttttgaaaattgttaaaacagtagattttcagtgttctcaccaaaaaaataagtaggatatatatatacattttatatatatatatatatatatatatatatatatatatatatatatgcatgcttaattgagccattccactatgtacacatatttcaagagttcatattgtatactataaatatattcaatttttatttgtcaatgaaaaaacaaaaacttcataaatttatgagctgctatggaggtaaaggtcttagaaaatttttaaaaaagagattgggtaaaattttcttgctctagctgcaagagcatggctttaggtgtaaagagctgggagaagtactctcaattagtgaagagaaaatgtgaggtaactaatgtttatttccatcttttactaaatactttaaacaaggatacacttccaattacataacagctaaacttgttatttacataataaatttttaaaaacgtaaaaatttacattattacataatagctaaatagataatagctaaattttttgtaccaaaatgtgttttataattcaccttttgaggaactttattcttatctatatccaggatacactgtgaggtatcctcaaaaataagtttttaaaaattattattattattattattattatttgagacagagtctcgctctgtggctcaggctggagtgccatggcgggatctcagctcactgcaacctccgcctcccaggttcaagcgattctcctgcctcagccttccaagtagctgagactacaggtgcccaccacctcgcctggctaatctttgtgtttttagtagagacggggtttctccatattggccaggctggtgtcaagctcctgactttgtgatccacctgcctcagcctcccaaagtgctgggattacaggcttgagccacggcgcctggcctaaaaattattttttaaaaaactgcagctaatttaacatccttactctttattctcattatattttcctctttctctatcacaaattattacatatattgacacaatgttaaatttttttcttctcctttcttaacttagtgcctttttgtaaagacaaattgaagttggagagagagtaggactcttcagattagataacagtattacagtattcacacaacttaggtttagataccttttattacacataaactgttatgcttgtatttttgattaattttaaaatgtggtaaaaagtaggaaaaatcactgataatctttacatattcaagatatttaagattgaaaatatttagaagaataaattttgttttcaaagagattaaataagcctaaaataatatattttacagaatttttgaggaattatatttatatttgtaaaagattttaatagtaagctatagttagataatatatttcgacagtaaagccactttcaaagaatatctcagagacgctggcgtaatttaaatagtaactaaaagggctatgtattacttttctatggctgctctaacaatttatcacaaactcagtgacttaaacaatgcacattttttctcctacagttttgaaggttagaagtctgaaatcagcttcactggggggaaatcaaaatgtaggcagaaccacactttccctagagggtttaggggataaaagactttgcctttgcagcttctagagctgcattccttgcattccttagctagagactccttcctttgtcttcaaagccagcaaaatagcatcttgcttcactggtaacacactgtcttctgtctcaaatctgcctctgccttcttcttataaggacacttataatttcattcagggcccacccagataattcggaataatctcaccaactcaagatcctttaattaatcacatctgcaaggtctcagttaccttataaggtaacatgcacggattccagggattaggacctggatatctttggagtcattatttgtcctaccacaagctaaaatcaatttctgaaattcatgtaaaatctgttgaaggcacagcacatctctgaatataaatggttattttaatagtcttctaaaattttcttttaaacaccaataattgcaatctgcttatttttcatgtagaaaaatatttttttctcctaaaatttgcatttgaatgatacctttttttttgagagagaggggcgagtcttactctgtcacctgagctggagatcagtggctccatcttggctccctgcaacttccgcctacatggttcaagtgattctcctgcctcagacccccacatagctgggattacaggcacgtgccaccacacccggctaatttttgtatttttagtagagatagggtttcactctgttggccaggctggtcttgaactcctgacttcaggtaattcaccagcctcagcctcccaaagtgctgggattacaggtgtgaaccaccacgcccagcctgaaaggtacttttacacatgttaaaatccacagctaattactctgtaaatatttaatattaaattgtgactaccaattttaaaaacaagatagaaaaagttgaaatcatgcatcacatacaagaaatgaatccttactctcacagcccttccacaactgatgtcagactcttacgttagtttcttttttcttccccttgataattttctctaatctcctttactatttaaattttctcaaaacccacttcactctaatgccattattcctgtagatgtttgtcctctgactacctctccattattacttcctttcctacttttttcataccttgctttatcctcatggaaaacatgtaaatcatttcaacaaacactgattgggccctaactttatgcaactgcctatcctagggacttcttaggcatagtaaggaataagaagtagcccttaaaaggctcatgctatctcagaaagggaataagacaggtggagtcaaagactagagcaagctctatataatgcaggcaaactctggaagatgtatgatcctattgggaggattatgcttaatttcaatgttcataatcaaataatttgtcaggagtgggaatggagagaaataaaacacagtaacaccaagcgtcactattctttgcatgaaccctgcccaccatctgctcatcaatatgcttctgcctacagaagaaaagttaacacttttgtagaagaatacgagctctttcaaattatcagactcagagaggcattaaagtaagacaataatcacatcctactccccccttttgagccatttattcaactattaaaactgcttggtagctatgaagtagctatgaattaacctaataatgtggcactggacactatatcccataccctatagcttaacaatgtatagccaatcactaatcaatgttatttttgtaaaccagtgagaattcctgacaaacaactttgtatcagccaactccctgtgcctcttctttgcctttagaaatctgctcgtaacaaaggcccaatggagctcctatcctaggttacttggctctgagttttcccagcagctgcccttactttgtctgaaataaagtctttcaatcatattttgtccttcactctccttcttttagggtgacatatctggtgctgtgagcagaattcagacacctctgaccatctgacattcctccttgactcagcatttggtcagctctgaacctcttgatttattttgactctttgagaaagtattgaatgtgaagtgttgaggcctactgaaatctggtccttcccactttttggttgaaggtctagactctgcttgaggtgtttttttccaaacctcactttccaaacctcaaaattgaggttttccatctttaccctaaaggtaaggtatttgggttacaagcaaaacaaaaacaaaactgactcttctgcctctggctcatgataggaggtctgggtcacagtcaggcaaacagctccccagagaacttcagccttttctacctctgtcccacggaagtaaggtctgggtcaaggtattggaaattaggcactggtggtttcattttaatagcatgctttttaatattgcagcagttgcttagaaatgcagacctaccttttcatttgtgacaaattcctgttagttcctaatggaaaaatgcagagggtgagttctcttgccccaaggaaaagaggagatttgcttcctctggcccatttgggtgctgcaggtgactgaagactacaccaaggtgtcagggtcattaaccatgacgcaacatgaagtagcctcatggggccctcccccccagaagaacatctttatgaactcccttttctgctcttccattaggatataatatgagggactggtcccctatatgttgagtaccctgctgccacccagcagttagaaacagactaggatacataagaaagctattcatgactcttgggtgacatctagaggagtgatgttcataagaagcatacttcaaacacaaaacatattcatgaccttggtaacttttgaaaagctcctaaattatgggaaatcaagcttcaaactctgaacactcttttaagcaacaactgccattagaaacacattttccatttcagctctaactgctccttcttctcctacccctgcatcttcatattctccttcatctgaactttcctgtcttgctttacttcttctagcatcagtacctgagggaactttccatgtctccgatcccctcccttaaacttccattctggcagcctttttcaaggtgtgattgtacagcacctcttcctgtacggaagaggtgggtctaataccccttgggcaaaaattgaatttaagagtgttatcaaaggcttccctgacctgttccaagattctatatggtttgcaaaagaatttgatctgactctttgaacttatgagcctggatattctgacctatatcaattaattcacatgttggtgtcagaaggcaaggccattgggtggttaaaaaaggcaaactgaaataatcctttagaggattttcaaaatcagactgaagcagaccatgaaggggtctgcattttgtccaagtctctccatgatgccattccccaggtctttcctttaaaaaaatgtatattggaagcgagttgagcaatgtactcaaaaggccagatgaatctgtagttatttggaatggcaatgagataagctttcaacaatattccaaagtggttgacactagcctccaagattaccagaacaattttctcataaactctactttcttcaattgcttaaatgaggacttggttaccttagttaaaagacaccagtttcttaactgggtgaatatacaaacccatgaattagtaagctttcagagcaaaatgattcagaaaaaagatagaattaatgcctcaaagattattaatttgcacctcaacaactggctagttaaaccaggccttttaagaaaagacaaatgcctctttctaatgataaaagaggtgtctgcttctatttcaaaaagtctggccatttcggaaaggattgtagaaaacttaaataatagcaggaacaacaaaagcacaggatgccataagatgaatagggttgctctgaggatcaaaatgggattttcccattaggagaagtggaaatgctcataaatggagaacagacatgcaccctcatagtcactttatgtcttcaaccctacaccccttaaattgtccccttcctcagagtaataaactatacaaacagcaggggtatctaatcaacctatgactgtatataagtccaaatccttagaatttcatgaaggctcattgagtaaccttcattcctttctgcatggtcccttggctcctatacacctctcaggcagagattttttggaactttgcaatacatacatttccttctctcagaaaggtgaaatgttaaattcagagtagaaggagctaatggaacaattacagaatgagaattaaactactgagattataaaactacggatctgacatattttttctaaaccaagaataggaaatggcactaatgatttattgcaagctttgctggaccacttatggtcccaatcttccattaacattaagatatattcaactactggctgggcgcagtggctcacgcctgtaatcccagcactttgggaggccgaggagggtggatcacgaggtcaggagatcgagaccatcctggctaacatggtgaaaccccgtctctactaaaaatacaaaaaattagccgggcgtggtggcaggtgcctgtagtcccagctactcgggaggctgaggcaggagaatggcgtgaacctgggaggcggagcttgcagtgaaccgagatcgtgccactgcactccagcctgggtgaaaaagtgagactccgtctcaaaaaaataaaaaaaaagatatattcaactacccccattaaagtgaaagtaaacctgcttaagatttacccaatattagacaatacccattagggtccgaagcaatggaaagaaccagacctataataaggtataattattccttgtatcagcccatataacattctgaccctttccataggaagctgaacgggaagggctggcattttctgtaagatttgagagctatcaacaacgctgtggtcccaagacatccgatggtacaaaacccccatattcgtttggcagcagtccctcctgaaagtaagaaatttactgtggctgatttgcgcagtttttttttttttaaagcattccagtagagccagagagtcaatatttatttgcctttacttatgacaactgccagtattcccagacctttatgccccaagattataatgagagccctaccaatttttctcaattattgaaatctgacttggctaatgtatatttctcagagggatctatacttgtccaatatgtggataatcttttcctttgttctccaaatatgcaaacttctaaggatgatagcataaatttcttaaaataattggcacctaagggacataaagtttctaaaaagcaactccaattttgccagacacaggtaaaatatttaggatattttatttctaagaaaggattgctcataaacccagacaggattaaaggcgtcctgctttactctaagccctcaacaaagaagcaactttgaggatttctgggattggctagatactgttaaaattaaatacatattttttctttaatagctcaccctttatataccctcctggaaatggatcaacctgatctttgtgtttggacttcagagagactaaaagccacataagtcatcaatgaacatcttataactagcacctgtcttaggtcatcctattgacagctttttctttcccctgttcattcatgaagacaaggcagatgccctgggaatactaactcagaaacatggggattataatgcacccggtggatattacagccggcaacttgatgcagttgctaggatgccaccttgcttaagagcaatctctgctactgctaccctctttagatatgggatcctctttcaccatgtacttaactcatacagtggaaacacttctgaacttctttcatgcccaacattactctgtttatataatagagttgtttcttatgcaggtcttcttctgccctcacctaaggttaccatttcctgttgttataatattaacccagccactcttttgctttttcctactgacaagacaccacactactctatcatcctgaccaaccaaattcttacacttcaacaggacctacaagaaacagttataaataaagctgatgtaatttggttcactgataattcttatttgaaagataaatctggaacttacagcgatgtttatgtcattgtgtctctaactgggattatagagaataatcctcttccagatgggggagaataatcctcttccagattattaaatcagctcagcaggcagaattgaagtagcccgtgattgtggaatgctgtggaagcaacgtggatatctgatctcatcaagtcaacccatcaaaaatggtcaacaagtctccgacctctttgaagcaatccctgaacccaaatcattggccatcatcaaaatctctggttattcgacattagaaactccagagagtaagcacaaccatttcactaacactttaggtaagcatgcagccctgaaggttatatcaggcatgtcttgaaatgaccttacaaacttactacgcatttacaattttacaagcacaaatgggagctcctaagaaggagatagagctctggaaaaataaagacggcaagttgtccccagaaatgggcttatgttatggacttgatgatagactgatctttcccttaaggcttcaattacatgtcttacagtatgttcttgagctcactcattgaaatctagacaaaatgatagcatgaggaaaaaaaatattaaaaactatatcctgctattgcacaaacaatgtgttctcactgtaccgtttgtcccaaacataatcctgcaaatccccttcatgggtcacaggggcattttccttcaactttggatcctttgagatattgtaattggactttatccagctgcctctatctcagggttaccagtgtgttctggtattaatttgcgtttctgtcattgggggttgaaacatttccatgctgacaagtcatggccaaagtaataggaaaagtgttattagaaaagttttttttttttttttttttccatagggagttcaatctgagctccatggcgactgaggaacacacttcactggtcaggtaattttatctatttgtaacatttggcctatattccatcatttctgttgtgcccatcacccccaatcctctgaactggtgaaatgaacaaatgatattaaaaagctcaatgcaaagctaacagaaatttttaactttctctagccagcacctctcccattagttctgctcaacctacaatccaccccactcataaaacgtcaagtctctttctttgaaataataacaagaaggcctatgtggctagataaaagagcttatgaacctgtacttcttaaaggtgatatcctccattattgccaaggtctcacaaaacttcctaccataaattccaaattaataaaggattcctttcgcaatgagctccagggagataaaggtaacagagaccatggcctacaacctggagattttgttaactgaaaacaacatcaaataaaagattccctgcaaccccactggaagggatcatatcaggtattgaccaatccttgtgctgccaaagttaagggtgttgactcaaggattcatgtttctcattttataaaagcggctctaccagagtggacattttctatcaccagacatgctcaattaaagctgacctgcaatcttcctgatcagcaccgcaagtaactgacatttgctgtagtctgcttctgcttaagatactggttcaggcctgtataaccagttcctcatgattccaatgattactgtgcctgaaattttcatctcctttttctgttgaccggaatattatgtttttaggctgccttcatattgtaggaatcctctcttggtggttttggtaaaataatcatatatatatatatatatatatgtatatatatatatacacatacacacacatatatacacacacacatatatacacatttatatacacacacacacacacacacacatatatattaagatatagcatactagtcttattgttaatatatgtactttagcaacatgcccatgatcaagcttcagtttttactgtccctaattaattgaattacagcatggagaaatagttctctggttcatatctcataaactgctattacatttggaaatctaacaagatgctgggtttgccaccctaaaccaccaacaactttcgacgacagtgacccattgctacattctgtcctaaatgccaccagtatttctaattgtactcataacccaattcaggggtcacataaaacaaaaccaaataggtctgtctgattcattctaacctgccatgtttcaatttaacccatcagaatctcacagtcaaaacaactgctgcctcactctgaaatgacagtggtaaaaaccatgatgctgctagaatgttaaaagaaaaacaatcgctcctgctatcaggatccagtcttttctcttgatctaacatttctgacccatggtttaaaaatgtcccaaaactgatatattgaaattatagtacactcacctctactccactaggatttacttttgtctgtgaaggagatcacagacatttacttttgtctgtgaaggaaatcacagacatttacttttgtctgtgaaggagattttatatccatggatataaaaatatctaagggcatagaatgaggaatagtagtgtcttttaaaatacttggttttatatatatatatgtatgtatatatatatatatgtgtatatatatatgtatgtatatatatatgtgtatatatatatgtatgtgtatatatatatgtatgtgtgtgtgtgtatatatatatatatatatatatatatatggctcagaagaaatccaatattggactagttccttcaaacttttctctgagcatgactaatgatctatttgagataaagattctatttgaggggaacctgttaattatctgacggaccatcaagaagatagttccatgcatgcttttggaagagtgtttttgccttggcgggttgttgcttcccattaacacatgattagaagtctttctataaccttaggaaagattgctaatgaaactgctacttcttcagcaaatcaaaaaaacctactaattcactagctaaggctgtactagaaaatcacattgctttatatattagctgaacagggatgtatatgtgtggtggcaaatattctttgttgtgtatacataaacacttcctatgaagtagaaactcatctatggaaaattagaaaagaagccacttaactatagcaaatctctaaagaagaaccagcatttaattttcttcctgatgttttagtttgctccatgaggaaatagtttccctttttctatttggcatataaattttcttgctgattataattcttatgtacattacatttttattatccaaattattaatgttatgtatttgtcatttcttttcattttctgagaaaactacattcatggttctccaaagaatagagattattcagcaagtgacaccagctgtatagatcagtgacttgacaggtctcattttttgccactctgtgataccatcccaatttggcttttgggtgcttttcaaaattccttgctgagatgtctcctttccttccctctacctagcatggaatgagattaccagggaatgtgctttcccaatgatgagggacatcttcacgctgggactttgaaagaactatccaggaatgagcttttccagcaatgagggacatcttgacacacagattttgatcatcaatgttttcaagaagaaacactttttatcaaaaaagagaaatgagtaaagaaaagaacttctatctgaggaatgtgagccctttcaaattatcaggcccagaaaggcattcaaatgaaataacaatcacatcctacttccccccatttggagctatgtatttatctataaaaactgcaaactcttgccacaggtagctacaaattaatctaataatgctacactggacacaatatccaacaccctataccataaaaatatatagccaatcaataatcaacgtaatttctgtaaaccagtgaaaattcctgacgaacaactttgtgatagcccactgcctgccattttttgccttcaaaaacctgcttgtaacacaggccaaatggagctcatatccaaggttacttgggtctgagtcttccaggcagctttccttactttggctcaggttaactctttcaatcatattttgtgctttagcctcttcttttgggattgacaccaggcagatgtatctgagacacagaaacaacgtctcatagaatctcatatctctgaaggtttgttacattttttacttatttcagtaaaattttcagaaagtttttggaggaaataattgaggagtttcactggaaaacaatgctttccccagagagcataaaataacatccagcaacatctggcagttttggctatatctcaatgagctttgctttggcatggcctcaaggaaaaacaaataaaaagcattgctgagacaactgcttaaggtcggagcattccaaatggcagaggaagccatgatctggccgctgtggaatgaagtatgatgggaagagagtgatgtgtgtgagctcaaggtgaactgtcagtataatggcatagatacactatcaaagtgtgccaaagatccattccaataaaaacattcactattgcctcaatacacctcaatgcaaacatccatgcctctttgtatcagtagcagaggcagaatttcctttctatttttcccacttttgtttaagacacagtaattccatgtctttaggcctgaatttgattccttcctcttcttcaactctcatatccaataaagtatattggaaatctctgatttaaaatactttgacttgtgctccctctcttgtggccaaaattccacttagattgcctaataactgtgctgatgttaaaaatgaagcccagataacttcttactctatcagttgcaatcactgacaagcctgtctgcagctaactactatagaaatgggagagagcaagagatcagggaagaagacattgtcttggaaactgcctctctccaaatatgtgtatatgtataaaattgcaaataacaattcaagcagaaatccctaattttgaattcagtccaaagattcttgaacaatgaattgctccaaggcattgtcattcccaatttcactggattcatatttaagtatcctcagttgatatacataatatttatctgaaagaaacataagcagcttttttacactaattgattttatgtatttaataatcatctgtaaatgaatatagatgttttatttaattttcatttctttttattatcaattttgatatttcattgtattaaatgggtttctaggaattttatgtcaaaatattacttcgtccttcgggaaataagcatctgagttaaggactgacttgaaatcattgtcaaagaaataactgaggcttaaattaggagacgtctctagtgtaaagaacctggaatgagccaggagatctggattccagttccttttgagaagctaaaacactgtgtgatcctggccatgtctcttaacagttttgggcctcaatttttctaagcataaaatgagcatttcgatagtattatttttaaagttcaggtggagtttttctcttttctacattcctcagtacttatttataacatgcattagcattcaagttattgctgtctctaagtgcttaaacttcctaactagaatataaattccctgaggcagaagatctgtacttccagaacaccttcagtgtttagcagtattggacatatagtatgtatggcatacaatcacccaagataagtgaaatttaactgggttggcttaactacacagctactgcttctctacttttgtcctcagttttgcactgtaaaaaaaaaaaaaaaaaaaaaaaacctttttgtgttttagttcaggctattatgatcaaactccaaatgtattcatgtatacccaatccacaaagctaatttaccaactggaatctcagtttattcttttaacatgaccattgtaagttccaagggaacattttctgcaaattacagcatacaacgggatgcttcctaaaaacagttggcacagcagaatacctgaatatcagagaacagcactaagcaataggggctgctagagcagcaggaaagaacttaagaaaaattattttgctgagagaaggtagttatcagagaacatataaaaattatttttcctctatggaaatcaaagaaatgtaagatgaaaaaagaatagtatatcctgttttagctggttgtgctaagtatagatgaagacatacacagcagaatttagtagaacttagactctctgacagttgagaacaacagtgaatttgacaatgttttctagaccaagtatatatttttgtactgatgaagaaattttctaaatcatattatgcaataatttaaaaacaactgccctgattatttgcaaacatggtcatattcaccttggcacatgcccatttgaggaatattccctaatttaaaaagagaaaaaaaccaaacaaatgtaatttgaattgactataaaaatatctagagagaaacagcagctacattaatattaattctaaatttaaaacaaactaaacattcaatccagatttcattagtggtgagtggcttttaatctgagtattacttttgggtatctatatcataaatgtcttcaggaacatttaatcaatgcctcaattccaaaaagataaagcttctttctattttttttatgaaaaaaatgcattacaatacagtttattatattagcagttaatagaaaatctggtatagttgccaatagcttgaaagactttaaagataaaactaaggggacaaggagccttttaaaaacagtatcaaccattctggacagtcaagaaaaaaaggtagtattttttatgtatacaagacaaaggtaagaaaagaaccttttcaaaacagcaggaccttacctgggagcaaaggaaagcatataatattagataggaacttttgctcatgctaacacttttcagtcggtatctgtgggggcacagaagctttcttcttccatttgcctttctctacagtctctttccaaaacaactcattttctagcaaatttcagctgaattttcttccatacctgaaataattaaagacactgatattgtaacttaatatgtggtaactaaagacatggatattgacattggcaaatcctgcaatgattctgctctacgttgatttaagcaataaatcgtggctcccataatgaccttcattactccatcatgttattccataagatccatgtaactcagaatgatggaatgaagagaagaaaggataggaaaaaatacaatgaaatactaggtacttttgctttgttcgccattagccttagtgctgccactaggctttaattaagagtaataagggaaacgttcttaagtctgcattactctcacttagtaggagtgcttacagtaataacctaaaaagtttactctgtaaaagatgttatgctactacattggtctcttctcaacaatattttctttctgcctcatgaatactaccaaggatgtatggtcaaatttcaccttgtttaatgggaatcttcctcatatcatctgattcctttataaatcctctttaaggtgcatatgcttccattacatatcaggaaacagctgccaattctagctcaaaggaatccatttagagttatgtgaaaacaaaatgtatgaagattaagtttcctctgtattaaatcttgagtgaacaaaagcaaatatactctattttgctaacactcgctatccctaagttccagactcccaaagaagagatagagaattttagaaggaaacacaccatcacacacttttaatcctaaatgttggcacagtaggtggaaaacaaggagaatgtgtatccagaacctccagcccctgggtcatctgtttccctgcatgagagggcaagggcccccctagctggagtacagcagccacacaccactgcaatcaggacacaaggctctgttaaagtgactgccccattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgaccagcattttttcatgtgttttttggctgcataaatgtcttcttttgagaagtgtctgttcatgtccttcgcccactttttgatggggttgtttgtttttttcttgtcaatttgtttgagttcattgtagattctggatattagccctttgtcagatgagtaggttgagaaaattttctcccactttgtaggttgcctgttcactctgtcggtagtttctggaatactatgcagccataaaaaatgatgagttcatgtcctttgtagggacatggatgaaattcaaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataataataatattaataacaaaaaaataaaaaataaaaaaaaaataaagtgactgccccaattttaactgaagcacagtggcagcttacatttcatcatttaggaagagatgtagaccaagggaagcagggagccaacaacttttacatattttcggtgctcatgttaacagtaaattcaagtactttaaaacatccctatgtctacagctcccagcatgagcaacgcagaagatgggtgatttctgcatttccatctgaggtaccgggttcatctcactagggagtgccagacagtgggtgcaggacagcgggtgcagcacaccatgcgcgagcagaggcagggtgaggcattgcctccactcgggaagtgcaaggggtcagggagttccctttcctactcaaagaaaggggtgacagagggcacctggaaaatcgggtcacccccaccctaatacagtgcttttccgacgggcttaaaaaacggcgcaccaggagattctatcctgcacctggctcggagggtcctatgcccacggagtctcgctgattgctagcacagcagtctgagatcaaactgcaaggcggcagtgaggctgggggaggggcgcccgccattgcccaggcttgcttaggtaaacaaagcaggcaggaagctgcaactgggtggagcccaccacagctcaaggaggcctgcctgcctctgtaggctccacctctgggggcagggcacagacaaacaaaaagacagcagtaacctctgcagacttaaatgtccctgtctgacagctttgaagacagcagtggttctcccagcaagcagctggagatctgagaatgggcagactgcctcctcaagtgggaccctgacccctgacccctgagcagcctaactgggaggcaccccccagtaggggcagactgacacctcacgcggccgggtactcctctgagacaaaacatccagaggaacgatcagacagcagcattagcagttcacgaaaatccgctgttctgcagccactgctgctggtacccaggcaaacagggtctggagtggacctctagcaaactccaacagacctgcagctgagggtcctgtctgttagaaggaaaactaacaaagagaaaggacatccacaccaaaaacccatctgtacaccaccatcatcaaagaccaaaagtagataaaaccacacagatgggaaaaaacagagcagaaaaactggaaactctaaaaatcagagtacctctcctcctccaaaggaacgcagctcctcaccagtaacggaacaaagctggacggagaatgactttgacgagttgagagaagaaggcttcagacgatcaaactactctgagctacaggaggaaattcaaaccaaacgcaaataagctgaaaactttgaaaaaaatttagacaaaagtataacaagaataaccaatacagagaagtgcttaaaggagctgatggagctgaaagccaaggctcgagaactacctgaagaatgcagaagcctcaggagccaatgcaatcaactggaagaaagggtatcagtgatggaagatcaaatgaatgaaatgaagcaagaagggaagtttagacaaaaaagaataaaaagaaaagaacagagcctctaagaaatatgggactatgtgaaaagaccaaatctacgtctgattggtgtacctgaaagtgacggagagaatggaatcaagctggaaaacactctgcaggatagtatccaggagaacttcctcaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagacaaaggtcgggttacccacaaagggaagcccatcagactaacagaggatctctcagcagaaactctacaagccagaagagagtgggggccaatattcaacattcttaaagaaaagaattttaaacccagaattgcatatccagccaaactaagcttcataagtgaaggagaaataaaatcctttacagacaagcaaatgctgagagatttttgtcaccaccaggcctgccctaaaagacctcctgaaggaagcactaaacatagaaaggaacgactggtaccagccactgcaaaatcatgccaaattgtaaagaccatcgaggctaggaagaaacttcatcaactaacgagcaaaataaccagctaacatcataatgacaggatcaaattcacacataacaatattaactttaaatgtaaatggaataaatgctccaactaaaagacacagactggcaaattggataaagagtcaagacccatcagtgtgctgtattcaggaaacccatctcacctgcagagacacacataggctcaaaataaaaggatggaggaagatctaccaagcaaatggaaaacaaaaaaaggcagggattgcaatcctagtctctgatgaaacagactttaaaccaacaaagatcaaaagagacaaacaaggccattacataatggtaaagggatcaattcaacaagaagagctaactatcctaaatatatatgcacccaatacaggagcacccagattcataaagcaagtccttagtgacctacaaagagacttagactcccacacattaataatgggagactttaacaccccactgtcaacattagacagatcaatgaggcagaaagttaacaaggatacccaggaattgaactcagctctgcaccaagtggacctaatagacatctacagaactctccattgcaaatcaacagaatatacatttttttcagcaccacaccacacctattccaaaattgaccacataggtggaagtaaatctctcctcagcaaatgtaaaagaacagaaattataacaaactgtctctcagaccacagtgaaatcaaactagaactcaggattaagaaactcactcaaaaccactcaactacatggaaactgaacaacctgctcctgaatgactactgggtacataacgaaatgacggcagaaataaagatgttccttgaaaccaacaagaacaaagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaacctagcagaaggcaagaaataagtaaaatcagagcagaactgaaggaaatagagacacaaaaaactcttcaaaaaattaatgaatccaggagctggttttttgaaagcatcaacaaaattgatagaccgctagcaagactaataaagaagaaaagagagaagaatcaaatagacacaataaaaaatgataaaggggatatcaccactgatcccacagaaatacaaactaccatcagagaatactacaaacacctctacacaaataaactagaaaatctagaagaaatgaataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattctaatcaatagaaaaagagggaatcctccctaactcattttatgaggccagcatcatcctgataacaaagccgggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctgtttcaatatacgcaaatcaataaacgtaatccagcatataaacagaaccaaagacaaaaaccacatgattatctcaatagatgaagaaaaggccttagacaaaattcaacagcccttcatgctaaaaactctcaataaattaggtattgatgggacgtatctcaaaataataagagctatctatgacaaacccacagccaatatcatactcaatgggcaaaaactggaagcattccctttgaaaacaggcacaagacaggaatgccctctctcaccactcttattcaacatagtgttggaagttctggccagggcaatcaggcaggggaaggaaataaagggtattcaattaggaaaagaggaagtcaaattgtccctgtttgcagatgacatgattgcatatctaggaaaaccccatcgtctcagtccaaaatctccttaagctgataagcaacttcagcaaagtctcaggatacaaaatcaatgtacaaaaatcacaagcattcttatacaccaacaacagacaaacagagagccaaatcatgagtgacctcccagtcacaattgcttcaaagagaataaaatacctaggaatccaacttacaagggacgtgaaggacctcttcaaggagaactacaaatcactgctcaatgaaataaaagaggacacaaagaaatggaacaacattccctgctcatgggtaggaagaatcaacatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggacgcatcacgctacctgacttcaaactatactatgaggctacagtaaccaaaacagcatggtactggtaccaaaacagagatatagaccaatggaacagaacagagacctcagaaataacgccgcatatctacaactatctgatctttgacaaacctgacaaaaacaagcaatggggaaaggattccctatttaataaatggtgctgggaaaactggctagccatatgtagaaagctgaaactggatcccttcattacaccttatactaaaattaattcaagatggattaaagatttaaatgttagaactaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggaaacctacagaatgggagaaaatttttgcagtctactcatctgacaaagggctagtatacagaatctacaatgaactccaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaactgcactgagataccatctcacaccagttagaatggtgatcattaaaaactcaggaaaccacaggtgttggagcggatgtggagaaataggaacatttttacactgttggtgggactgtaaactagttccaccattgtggaagtcagtgtggcgattcctcagggatctagaactagaaataccatttgacccagccatcccattactgggtatatacccaaaagattataaatcatcctgctataacgacacatgcacacgtatgtttattgcggcactattcccgatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccgcatgttctcactcatagatgggaattgaacaatgagaacacatggacacaggaaggggaacatcatacactggggcctgttgtggggtgtggggagtggggagggatagcattaggagatatacctaatgttaattgacaagttaatgggtgcagcacaccaacatggcacatgtatatatatgtaacaaacccgcacgttgtgcacatgtaccctaaaacttaaagtatattaaaaaaaaaaaaccataactaccgttaaaataaaaaaaaaaagagaaagtcacttagcttctctggttacattttttcacatccgcaaaattagtagagtaaaattagatagtaattttatgggacttcgtagttttaataatctgtgacgctcagaccagtttttcctagaccaaatcacaagaatgctcataaaagcctttcgttgcctggagttttgttggtaggccaggctataatttaaaagtttaatctgcttaataatttaagcaattaaagtgcatgaacatgtagtgcttggggcaggaacacctgcactctctgacactcacaactctgtgaccatagctgagaaacggaaattaaatgacaaagaaaacctctgtgaaaccaaatagctccagcgttaagacccacagaatgtactcaaaagagagctcttagactagtcataaaaactggagttaatcatgcttaacgagttctactaattaggtaactgctgcctgaaacacagagcagtgttaagaagaaattttgagatcttaagtggactctatgagaatagaaactatgataaattgtcattgtttgccatggacaagagcagacctatggtagcaaatgtgctctatatctttacatggaacttagtcttaattcacaaataattctagcaagtttaatgatttaatctgttagcatgtagcagaatagaaaccataatttagaaagttgggagaggggttgctaaagtgggctcactaaaagctgtgaaaggctgcagcacaaagcaaggatacaaacatgataatttgttttttcctttaagttgtaggatacatgtgcagaatgtgcaggtttgttacataggttatgtgtgtcatggtggtttgctgcacttatcaacctgtcatctaggctttaagccctgcatgcattagctatttgtcctaatggtctccctctcctgagccaccaccctccttacaggccccagtgtgtgttgttcccctccttgtgtccatgtgttctcattgttcaacttccacttatgagtgaaaacatgaggtgtttgtttttttgttcctgtgttagtttgctgagggtgatggcttccagcttcatccatgttcctgcaaaggacatgatctcattcctttttatggctgcatagtattcaatggtgtatatgtaccacaatttctttatctagtctatcattgatgagcatttggattggttccatgtctttgctattgtaaatagtgctgcaataaacatacatgtgcaaaacatagtaattattatagtcatagatcaaagtcacagaattgtaacaaactagggaccatcatgtaagacacattggtcctacaaaccatagtaagctaggcctaaaaatgtcagtctattacaattcagtttgataagtgatacatatactggcgacccaatgcatatatcaggacaaaggtacagttattttcactatgtcctgataaataacatccaaaatcctgaacctgatatattaggcctaattcatcctcttctccagatgcctgtaatctaaaatccagctatataaatgccttgttgtttacaaaatatggcattgtttctctcaactcagggcttttcaaatattatttcttctgcctgtgacatcctcattttagttactaaatcgtagctatccttcataacccagctctaatggttgacacctctaagatacatttcctggcactattctgtcacttcaccacaccccaggataccacacttcatccaagtgtaagattatacctcttgccctctgcttccctggcaacctgttcaaacctcaattgtagcacctataacctggtactggatgtctgctctttctttctacattattagcttattcagattactcatatttctcttcagtgcctagccagcccaagatgctgtatttcttagataaattaaaatttaaaatatccacaaggcttagagattttcaagattttctaatatttagaaatttgccaatatataaatgacttgctattcagagcttagcctgctggcctgttcaggatggctcaatgaaacttccactaggtagtattttgctaaaatttttttccaatcactcaagactgttaaaactttctgtactaaaaagcattgtaagatgcacttgtactaatctgagcatttcacaattgttctaaattgtggaattataatttaaaggcaaaatgcataaatactttttcatttgttcagtccaaaaatacttactgagtctctgtcatgagtcagacactatgcttggccctaaagatagagtgatcagaaagatggtcatccatcctgtcctcataaagattaccaagtatttgctttctctgtgtactgaaaagaattaacaaaacaattctttcaatataaaatagcaaaaaaaaaaaaaaccctcgaaatacagtaatggcactattctaaatttaaatagctcgttgcctttgatagaatgctacaaataccaaaaggacaatactatcaggtgagtattactggtccaattctgtagacaatgaaattgaggtcatgaaatgttaaataacctggcaaacatcataaagctggaagatggtggagagtggactcaaacccagaattatgtgggttcaaggcctattcacattcccaattctcatggcccattaatagttacatggaaaaaacactgggccatgtatatgtattaacgtaatgtaatatttgtaaaggtgttttaaactttttaatttcttattgatacataacatttgtacatatttatgaggtacatgtgatttttttatatgtatataatgtgtaatgatcaagtcaaggtgtttgaggtatccatcacctcaagtatttattatctatatgtattgggaaaatttccagtcctgtctcctagctattttgaaatatacattgttgttaactatagtcacactactttactaaattgatctcaaggaggtagagattagaatgatagataccaaaggctaggaagtatgtatgggtgaggggacagtgaagagatgtagaaatatacagttagatctttgtaaagatttttatgtcgttgatagtttccttagaacttggtttaatctttactaatttacacgtaaaagattataaataattaatttgttagagatacatatttgctaaggcatacagctgttcatacaatttttataaatacatatctaacaacagaaaagaaggcggcacaaaatggcaaaataaaaggctccactaatcatccctgctgcaaggacaccaacttaacaaccatctacacatacacacaaaaaaacaccttcatagaaaacaaaattcaggtgagtactcagagtacctggtgttaacttcatattgctgaaggacgcactgaagagatagaaaaaacagccctgaatcaccgatgcccaccctcccctaccccccagcagcagctgcatggtgcagagagcttcctggggtcggggagaaagaacacagcaattgtgaggcattgaactcagtgctgtcctttagagcagaaaggaaaattggaacaaactcagctgatgcccgcacatgcagggagcatttaaaccagccctagccaaagggaaatcaccaatcctagtgatcagaacttgagttcccacaaacctcgccaccaaggcctacagtgctctgtgtctccaagtaaacttgaagggcattctaggccataaggactgaaactcttaagagagagctattactgaacttggcccaaagacagtggactggagtagctcatgaaatactgagacaccagctggggcagccaatggagtgctggcatcactccttccctaccccaggctgcactgctcatggctccaaaaaagaccctttcctcttgcttgaggagaggagaggcatgagtaggaagggctttgttttgcatcttgggcaccagctcagccacagcaggatagggtaccaataagagtagggagtcccccgttccaggctgtagctcccagatgacatttctagacatttctgggccagaagggatcctgctgtcttgaaggaaaacactcagttctgggaccattcatcacctgctaactgaagggcccttgggccctaaataattagcagtgatacctaggtactatgttgaggaccttggtgagcctctgagacttgctggctttgggagggactcagcacataaccagctgtggtggctatggggcaaaatcccttctgctagagaaaagcagagagaaaaagggacttattcttgcaccttaggtaccagcatagccacaggggtttagagcaccaagtgggttcctggggcccactgctctgaatggtgagtcccaggccaggtagcaatcacgacaagctaatttaagagatcttgagccttaagggaagatcagaggtattctggcagtactctttgtggcctaagaatgatagctaccgagagaggctcctccgcctttggaaagagaaagagagtgggaagtactgcatcttgtggtttgagtcccagctcagcctcagtactacagaacatcgggtagactttgaaggtttttgactctggtcactgactcccagatggcacctctggacctacccaaggcctgggcgaccctgcttccctggaggaaaggaaacatcataaagctggaagatggcagagactggactcaaacccagaattatgtctgcctggctggctttgccacccactgactgtagaaccccagggccttgaaagaacacagccagtagccagggagtggttatagcaggctttgcgtgacacccagtgctgtgctggcttgaggtctgagtcagcacagtcatggtggtggtggcaacaggggtgcttgtgtcacatcagccccagctgatggctaagaatgaagagattatctgtatgtttgggagaaagaagaagaagggaacaagagtctctgcctggtaatccagagaattctcccaagtcttatctaaaaccatcaaggcagtatctctactagtctgcaagaactacagaagactgggctttggatgcctactatagcagaaacagcttacatcacagtacccaagttttcttcaaatatctggaaagccttcccaagaaggatggctacagataaatccagacagtgaagactacaataaatacctaactcttcaacacccagacaatgaagaacatctagtagtattaacaacatctaggaaaacatgacttcaccaagtaaactaaataaagcaccagggaccaatgctggagaaacagagatatgtgaccttttagacaaagaaatcaaaatagctgtgttgaagaaactcaaagaaattcaagacaacacaaagaagaaattcagaattctatcatatatacttaacaaagagaatgaaataattaaaaagaatcaagcaaaaattctggagctgaaaaatgcaactggcatactgaagactgcatcagagtcctttaatagcagaatggatcaaggagaagaaagaattagggaggttgaagacaggctatttgaaaatacacagaggagaaaaaagaaaatgaataaaatacaataaagcatgcatagagaatccagaatacagcctcaaaagggcacacgtaagaggtattggccttaaagagaaggtagagaaagtgaggagggtagaaatagtattcaaagggataacaagaagaaacttcaaaaacctagggaaagatagcaatattcaagtgcaagaaagttatagaacacaaagcagatttaacccaaaatagactacctcaaggtatttaataatccaactcccaaatgccaaggatgaagaaaggatcctaaaagcagtaagggaaaagaaacaaaaaacatacaatgaagctccaatatgtcaggcagcagacctttcagtggaaaacttataggccagaagacagtggcatgacatatttaaaatgctgaagaaaaaatcttttaacccagaacagtatatctggcaaaaatatccttcaaacataaagaagaaataaagactttcccagacaaacaaaagttgagggatttcatcaaccccagtcctttcctacaataaatgctaaagggagtacttcaatcagaaggaaaaaaacattaaatgagcaaacagaaatcacctgatggtgtaaaactcactggtaatagtaagtacacagaaaaatacagaatactataacactgtaactggtatgtaagctactcatgctaagtagaaagactaaacaatgaaccaatcaaaaatagtaagtacaataacttttccaaacatagtgagtacaataagaaataaatagaaacaataaaaagtttaaaaagcaagggaatgggattaaagtgtagtttttattagctccttttctgtttgcttgtttgcttatttatgcaaatattgttaagttgttatcaggttaaaataacaggttataagatagtatttgcaagcttcatggtaacctcaaaccaaaaatcctacagtggagacacaaaaaataaaaagcaagaaaactaaatcatatcaccagagaaaatcaccttcactaaagaaagacaggaaggaaagaaagagggaagaagaccacaaaacaacaagaaaataacaacaaaatgacatgagtaggtccctatttatcaataataacattgtacaggaatgatctaaaccgtccaatcaaaagacgtaaattggccaaatgggtaaaaaaacaagacccattattctgttgcccacaaaaaacaaacttcacatataaatacacaaataaactgaaaataaaaagatagaaatagatattccatgctgatggaaagcaaaaagagcaggagtcactatacttatatcagacaaaagagatttcaagacaaacctacaggaagagacaaagaaggtcactatataatgataaaggggtcaattcagcaagaggaaattacaattttaaatatatatgcacccaacactggagtacccagatatataaagcaaatgttattagagctaaagagataggccccaatacaaaaacagctggagacgtcaacaccctactttcagcattgtacagatattccagacataaaaatcaacaaagaaacattggacttaatctgtactatagaccaaatggatctaacacatatttacaggacatttcatctaagagctgcagaatatacatagatcattcaaaaagacaaaccatatgataggtcaaaaaacaagtcctaaaacattaaaaaaagattgatataatatcaaacatcttttctgaaaacaatggaataaaactacaaattaataacaagggattttggaaatgatataaatacatggaagctaaacaatatgttcctgaatgaccagtgaatcaatgaagaaattaaaaggaaattgaaaaatttcttcaaacaaatgacaatggaaacacaacatatcaaaacctctgggatacagcagcaaaaacagtactcagagtgaattttatagttattaagtgcctatatcaaaaaagaggaaaaatttcaagtaaacaatctaacaatgcatcttaaaaaactagaaaagcaagaggaaacaaacccaaaattagtagaataaaagaactaataaagactagagcaaaaaataaataaataaaattgaaataaaaaaaaatcagtgtggctgggtgcggtggctcacacctgtaatcccagcactttgggaggccgaggtgggcagatcacctgaggtcaggagtttgagaccaggctgaccaacatggagaaaccccgtctctactaaaaatatgaaattagctgggtgtggtggtgcatgcttgtaatcctagcaactcaggaggctgagacagaagaattgcttgaacccgggaggcagaggttgcagtaagccgagatcgcaccattccactccagcctgggcaacaagagtgaaactctgtctcaaaaaaaaagaaagaaagaaagaaagaaaatcaatgaaaaaaaagaaaccctggtttcttgaaaagttaaaaaaaaataacaaaactttatctagactaataaaaagagaaatattcatataaataaaatcaaaaatgacaaaggagacattgcatctgatactgcaggaactcaaaggatcattagtggctactatgagcaactattggaaaatctagaataaataaaaaaattcctagactcatacaacctaccaagattgaaccaagaaatctaatacctgaacaaaccagtaacagttaacgagatcaaagccataataaaaattcttccagtaaacaaaagcccaggacctgacggcttcactgctgaattcaatcaaacttttaaagaagaactaataccaatcctactcaaactattatgaaagatagaggaggagggagtacttgcaaactcattgtatgaagctagtattaccctgataccaagaccatacaaagacacataaagaaaaaaccaacacaggccaatatcgttgatgaatattgaggtgaaaatccttaacaaaatactagcaaaccgaattcaacaatatattaaaaagatcatttatcatgaccaagtgagatttatcccttggatgcaaggatagtttaacatacacaaatgaatcaatgtaatataaacagaatgaaggataaaaaccacgtgatcatttcagttgatgctgaaaagtcatttgataagattcaacatcccttcatgatagaaaccctcaaaaaactgggaatagaagaaacatacctcaacataataaaaccgcacgatctcactcataggtgagaattgaacaattagaacacttggacacaggaaggggaagatcacacaccggggcctgttgtggggtggggggaacggggagagatagcattaggagatatacctaatgtaaattatgagttaatgggtgcagcacaccaacatggcaaatgtatacatatgtaacaaacctgcacgttgtgcacatgtaccctagaacttaaagtgtaatttaaaaaaaggaaaaaaaaagtcatatacaagaggccaacagctagtgtcattactgaataaggaaaaaactgaaagccattcctcagagatctgcaatgcgacaaggatgctcactgtcaccactgttattcaacacaatactgaaagtcctaagtaaggcaatgagaccagataaatatataaagacatccaaggtggcaatgaagaaatacaattatccttgtttgtcaatatgatcttatatttggaaaaacctaaagacaccagaaaaaaaaactattagaactgataaattcaagaaggttgctggacacaagatcaccatacaagaatcagttgcatttgtacatgccaacagtgaacaacgtaaaacagaaatttaaaaagtaatcccatttacaacagacacataaaattaaaataaccaaatgagtgagagatatctatgataaaaattatataaaacactgatgaaagaaattgaagagggcactaaaaatgaaaaaatattccagctttacagattggaagaatcaatattgttaaaatgttcatactacccaaagcaatctcacattcaatgcaatccctatcaaaatacgaatgacactattcacagaaatagaaaaagcaatcctaaaatttaaacagaaccatgaaaaacctagaatacccaaagctttcctaagcaaaaagagcaaaactggaggaatcacattacagtacctgacatcaaattatactccagagccgtaataacaaaaacaacatggtactggcatacaaacaaacacatagaccaatgggatagaatagataacccagttacaaatccacatacctacagtgaacacatttttgacaaaggtaccaagaacatacactggggaaaagacagtctcttcaataaatggtgctgggaaaactggatatccttatgcagaagaatgaaactagacccctatatctcaccaaataaaaagtcaaatcaaaatgtgttaaagacttaaatctaagacctcaatccatgaaactgctgcaagaaaacattggaggaaatcaccaggacattggtctgggcaaaaaaaatttcttgagcactacccacaagcgcaggcaaacaaacaaaaaaatggacaaatgagatcacaacgagtttaaaagcttctgcataacaaaggatacaataaacaaaattaagagataacctacaaaataggagaaaataactgcaaactactatctgacaaaggattaataaccagagcaaggagctcaaacaattctacaggaaaaaaatctaataatctgattaaaaaatgggcaaaagatttaaacagacatttctcaaaagaagacctacaaatggcaaacagggatatgaaaacgtgctcaacatcattgatcatcagagaaacgcaaataaaaatttaatgaaatattatttcaccccagttaaaatgacttatagtcaaacaaaaggcaagaacaaatgctggtgaggatgtgcagaaaagggaagcctcgacactgttggtgggaacgaaaattagtaaaaccactatggtgaacagttgagagtttcctcaaaaaactaaaaatacagctaccatgtgatccagcaagcccactgctgggtatataccccaaagaaaggaaatcaatatatcaaagaaatatttgcattcttatgtttgttgaagcactatttacaacagctaagatttggaagcaaactaagtgtccatcaacagatgaatggataaagaaaatgcggtagatatacacaatggagtattactcagccataaaaagactgagatcctgtcatttgcaagaacatgggtaaaacttgagatcattatattaagtgaagtaagccaggcacagaaagacacacaatgcattttctcacttgtttgtgggatataaaaatcaaaacagttgaactcatgggcacagaaagtagaaggatggttaccagaggctaggaaggatagtgggaggatttgggggaggtggggatggttaatgagtacaaaaattacttagaatgcataaaacctactatttgatagcacaacagggcaagtatagtcaataataacttaattatacattttaaaataaagagtatgatttgtttatttgtatctcaaaggataaatgcttgaggggatgaatacctctttctccttgatgttcttatatcacattgtatgcttgtatcaaaacatctcacgtatcccataaatatatacacttactatgtacccacaaatattaaaaataaaaataaaaacttaaggggaggggccaagatatccaaatagaaacagctctggtctgcacctcccagcaagacgaacgcaaaaggagagtgatttctgcatttccaactgaggtacccagttcatctcattgggactgactaggtggttggtgtgacccacagagaccaaggaaaagcagggtggggcgttgcttcacctaggagctacacggggcaaagggacctccctcccccagccaagaaaagtggtgagggactgtgctacctaccagggtaccatgattttcccacagatttttgcaattcatggatcaggagatttcctcgtgggcatagaccacatgggccttgggtctcaagcacaaaactgggcagacaaatgacagccactcccactggcggctgttaggcactgagctgcaggagtttttaaatactccagcggtgcctggaactcaagtgaggcaagagaaccatccactcccatggaaagggggctgagacaaatggctttgctcagcaggtcccactcccatggaaccctgcaagctaagacccactggcttgaaatccccactgccttcacagcagtctggagtctgcttaagaagaccaagttcctggggggaggagcgaccaccattactgtggctctagttggtggtttccccctgccagtgttaaagaaactgggaggtttggacagtattccccaaagtgcagcactgcagctgtgacagatcatggccagactgcttctttgagacctagatccacccctcctcattgggcaaggcctccttgcaggaattccagcagctccagtcaggggcttcgagacagaccctcatctccctgagacagagcacatgggaggagggatggctgcggtctcaggttcagcggatcaaatctttcctgactgctggctctgaagataccagctgatcctgacaagggggattcccacagcacagcacaccagctttgctaaaggacagtaagattgcctccttaagcgggtctctgatcccatgcctcctgactgggtgaaacctcccaacaggggttgccagacacctcagacaggagagttctggctggcatcaggtcagtgcctctctggaatgaagcttccagaggaaaaagcaggcagcaatctttgctgttctgcagcctccactggtgatacccaggcaaacaggttctggaatggacccccagcaaactgcagcagacgtgcagaagaggagcctgactgttagaatcaaaacaaacagaaagcaacaacaacaacaacaaagatccacaaaaaccccaatccaaaggtcaacagcctcaaagatcaaaggtagataaactcacggagatgagaaaaaaacaacgtaaaaacccaaaaaatttcaaaagccagaatgcctcttctcctccaaataactgcaacacttctccagcaagggcacagaaaaaggctgaagctgacttggatgaactgacagaattaggcttcagaaagtgggtaataatgaatttttatgagctaaagaattatgttctagcccaatgaaaagaagctaagaaccataataaaagattacaggagctgttacctagaataaccagtttagagagaaacataaatgacctgatggagctgaagaacacagcatgagaacttcatgatgcaaacacaagtatcaatagctgaattgaccaagcagaagagagaagacgagagcttgaagactgtcttgctgaaataaggcaggcagacaagattagagaaaaaagaaatgaaaaggaacaaccaacacctccaagaactatggaaatatgtgaaaagactgaagctatgactgattggagtacctgaaagagatggggagaatggaaccaacttggaaaatactctttaggagctcatccaggagagcttccccaacctgtcaagaaaggccaatattcaaattcaggaaatccagagaaccccagtaagatactccatgaaaagatctactacaagccatactcacgagatactccaaggttgaaataaagaaaaaaatattaagggcagccagagagaaaggccaggtcacctacaaagggaagcccatcagacaaacagtggacctctcagtggaaaccagaaaagccaaaagagattgaaggccaatagtcaacattcttaaaaaaagaaattctaaccaagaatttcatatccaaccaaactaagcttcataagcaaaggagaaataaaatatttttcatacaagcaaatgttgagggattttgtcactgccaggcccaccttgcaagagctgcagaagaaagcactaaaaatggataggaaaaactgttaccatccactataaaaacaaactgaagtaaacagaccaagaacactatgaagaaactacattaactagtctgcaaaattagccagccagcagcatcatgacaggattaaattcacacataacaacattacccttaagtgaaaatgggctaaatgtcccagctaaaagacacagaatggcgagctggatacgaaaacaagaaccgttggtgtactgtactcaagagacacatctcatgtgcaaagacacacatagactcaaaaataaagtgatggaggaaaatttaccaagcaattggaaaacagaaaaaagtaggggttacaatcctaatttatgacaaaaatagacgttaaatgaacaaagatcaaaaaagtcaaagaagggcattacgtaatggtaaagggttaagaaaaactatcccaaatatatatgcacccaatacaggagcacccaggttcataaaactagttcttaaagacctacaaagagacttagatccacacacaataaaagtgggagactttaataccccactgtcagtattagatcatcaagacagaaaattaacaaagatattcaggacttaaactgagctctagaccaagtgcatctgatatatctctacagaactccccaccccaaaacaacagaagatacatatttttttttggtgccacacagcacttactctaaacctaatcacataattggaagtaaaacactcctcagaaaatgcaaaagaactgaaataataacagtctctcagaccacagtgcaatcaaattagaactcaagattaagaatcccactcaaaaccacacaactgcatggaaatcgaacaacttgctccagaatggcatcagagtaaataatgaaattaaagcagaaataaagacattttttgaaaccaatgagaacaaagagacaatgtaccagaatctctgggatgcagctaaagcagtcttaagagggaaatttatagcactcaatgcccacatcaaaaagccagaaacatctccaattggcaagctaacatcacagctaaaagaactagagaaccaagagcaaataaactccagaggtagcagaagacaagaaataagcaagttcagagaggaactgaaggcgatagagacacaaaaaagcccttcaaaaaaatgaacaaatccaagagctggttctttgaaaaaaaatcaataaatagaacactagtgagattaatgaagacaaaaagagagaagattaaaataaacacagtaaaaaagataagggagataccaccactgaccccacagaatacaaacaatgatcagaaaatactataaacacttctatggaaataaactggaaaatctagaagaaatggataaattcctggacacaggcatcctcccaagactgaaccagaaagaagctgaatccctgaatgaaccaataacaagttctgaaattgaggcaataataaatagcctaccaacaaagaaagcccaggtccagatggatttacagctgaattgtaccagaggcacaaagaggagctagtaccatttcttctgaaactattccaaacaattgaaaaggagggactcctccctaactcattttatgcggccaacatcatcctgataccaaaatctggcagagatagaacaaaaaaaggaaaacttcaggccaatatccctgattaacactgatgcaaaaatcctcaataaaatactggtaaactgagacaagcagcacgtcaaaaagcttatcaaccatgatcaagttggcttcatccccaggatgcaaggctggttcaacatacgcaaatcaataaaggtgattaatcgcataaacagaactaaagaaaacaaaaacacaggattatctcaatagatgcagaaaacatccttgataaagttcaacatcccttcatgttaaaaactctcaataaactaggtatttatgcaacatacctcaaaataataagagtcatttacgacaaacccacagtcaatatcatactgaatgggcaaaagctggaagcattccccttgaaaacgggcacaaaaaaaggataccctctgtaaccactcttattcagaacagtgtcggatgttctggccagggcaataaggcaagagaaagaaataaaggatactcaaataggaagagaggaagtcaaaatgtctttttttttttttttttttttttttttttgcagatgacatgatcctatatctagtaaaccccatcaactcagcccaaagcttcttaagctgataagcaacttcagcaaagtctcaggatacaaaaaccaatgtgcagaaatcacaagcatttctatacaccaattacagacaagcagagagccaaatcatgaatgaacttccattcacaattgccacaaagagaataaaacacctaaaaatacagctagcaagggaagtgaaggacctcttcaaggagaactacaagccactgctcaaggaaatcagagacaaaacaagcagatggaaaatattccatactcatggataaaaagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtgggggtaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataataataataataataataataataaaatattgtgaaaatggccatactgtccaaagcgatttatacatgcaatgctattctcattaaattaccactgacatccttcaaagaattagaaaaatctatgtaaaattcatatggaaccaaaaaatagcttgtataagcaggactatcctaagcaaaaagagcagcgttaaaagggaaatctatagcactaaatgcccacatcaaaaaactagaaagatctccgattgacagtctaacatcacaactaaaggaactagaaaaccaagagcaaacaaaccccaaagctagcagaagacaagaaataagcaagatcagagtgtaactgaaggagatagggacatgaaaaacgcttcaaaaaaatcaacaaatccaggagctgtcttttgaaaaaaaaaatgcaaataaactagaaaatcgagaaaaaatggacaaattcctggacacatacaccctcccaagactgaaccaggaagaagctgaatccttgaatagatcaataacaagttctgaaattgaggcagtaataaatagcctgctaaccaaaaaaagatcaggaacagatggatttacatctgaattatatcagagttacaaagagaagctggtaccatttcttctgaaacgattccaaacaattaaaaaggagggactcctccctaactcattttacgaggccagcatcatcctgatactaaaacctggcagggacacaacagaaaacttcaggccaatatccctgctgaacattgatgcaaaaattctcaataaaatactgacaaaccgaatccagcagcacatcaaaaagcttattcaccatgatcaagttggcttcatccccaggatacaaggatggatcagcaaacacaaatcaataaaagttattcatcacataaccagaactaaagacaaaaaccacatgattatctcaatagacacaaaaaagccctttgatgaaattcaacatcgcttcatgttaaaaacactcaataaactagatatttatgcaacatacctcaaaataataagagccatttatgacaaacccacagccaatatcatactgaatgggcaaaacctggaagcatttctcttgaaaacaggcacaagacaaggatgccctctgtcaccaccatttttcaacatagtgtcggaagttctggctagggcaatcaggcaagagaaagaaataaagggaatgcaaatgggaagacagaaagtcaaattatctttgcagatgacatgattctatatctagaaatccccatcatattcacccaaaagcttcttaagctgataagaaacttcagaaaagtctcaggatacaaaatcaatgtgcaaaactaataagcattcccatacaccaacaacagacaagcagagagccaaatcatgaatgaacccccattcataatttctacaaagagaataaaatacctaggagtaccactgtcaagggaagtgaaggaactcttcaaggagaactacaaaccactgctcaagaaagtcagagagaacactaacaaatgaaaaatcattccatgctcatggataggaacaatcaacattgtgaaaatggccatactgccaaagtaatttatagatgcaatgttattcccattaaactatcattgtcattcttcccagaattagaagaaattactttaaaattcatatggaaccaaaaaagagcccatgtagcaagacaatcattagcaaaaagaacaaagctggaggcatcttgctacctgacttaaaactatactacaaggctacacagtaaccaaaacagtgtggtactagtacaatagaccaatgtacatagaccaatggaacagaatggagaactcagaaataagactgcgcatctacaaccacctgatcttggccaatctgacaaaaacaagcaattgggaaagaattccctatttaaaaaatggtgctgggagaactggctagccataggcagaatagagaaactggatcccttccttacacatcatacaaaaattaactcaagatgggttaaagacttaaatgtaaaactccaacgtataaaaactccagaagaaaatccaggcaataccattcagaacacaggcaagggcaaagatttcatgatgaaaatgccaaaagcaattgccacaaaagccaaaattgacaaatgggatccaattagactaaagagctgctgcacagcaaaagaaagtatcatcagggtgaaaaggcaacctacagagtggaagtaaatttttgcaatctatccatccgacaaaagtctaatatccagaatctacaaggagcttaaacaaatttacaagaaaaaaacaaaccccattaaaaactgggcaaaggatatgaacagacacttctcaaaacaagacattcatgtgaccaacaaatacatatttaaaaaaatctcaacatcagagatcattagagaaatgcaaatcaaaaccacaatgaagtaccatctcacctcagtgagaatggtgtttattaaaaagccaagaaacaacaattgctggtgaggttgcagagaaataggaatgcttttcattgttggtggggatgtaaattaattcaatcattgtggaagatggtgtggcaattcctcaaagatctagaactggaaataccatttgacccagcaatcccattactgggtacatacctaaaggaatataaatcattctattgcaaagatatatgcacatgtatggtcattgcagcactattcacaatatcaaagacatggaatcaactcaaatgcccatcaatcatagactggataaagaaaatgtggtacatacacatcatggaatgctatgttatgcagccataaaaaggaacgagaacatgtcctttgcaggaacatggatggagctggaagccattatcctctgcatactgatgctggaacagaataccaaataccacacgttcttacttataagtgggagctgaataatgagaacacatggacaaagggaggggaacaacacacactgaggcctgccagagggtggggtgggggaggaagagcattcggaaaaatagccagtgcatgctggacttaatacctaggtgatggactgatacgcgcagcaaaccaccatggcacatgttttacctatgtaccaaacctgcacatcctgtacatgtactccggaattaaaaataaaaataaaacgttaatccaccacaattaagtaggctttatccctggaatgcatgattggatgaacatatgtaaatcaataaatgtggttcactgcataaacagaactaaaaacaaaaccaacatgattatctcaatagatgcagaaaaagttttcaataaaatccaacatctctttgtgttaaaaaccctcaataaaaaacaaaaaaataaaggcattgaagaaaaatgtttcaaaataataagagccatctatgaaaaactcacagccaaagtcataatgaatgggcaaaagctgaaaatattccctttgagaactagaaaaaggcaaggatgccctctctcaccactcatatttaacacagtactggaagtcctaggcagagcaatcagtcaagagaaagaaatagagggcatccaaataggaatagagggagtcaaactaaccctgttagcaaacattatgattctattcctagaaatctttatattgtgtgtcccaaagctccttgatctgatacagaaggttagcaaatttcacagtataaaaacaatgtgcaaagatcagtggaattcctgtacattgacaacatctaagcagacagccaaatcaagaatgtaatcccattcacaatagccacacacacaaaaaaaaaaatctagaaattccactaaccaaggtggcaaaagacttctacaatgagaattacaaaacactactcaaagaaataagaggtgtcaaaaaaaatggaaaaacatttcatgctcatggaaaggaataatcaatattgtcaaaatggccatagtgtcctaaccaatttacagagtcaatgttatcactgtcaaagtaccaatgacattgttcacagaattaaatcaaagtattttaaaatacatatggaacaacaacaacaacaaagagcttgaatagccaaggcaatcccaagcaaaaagaacaaggctggcggcatcacattacctgacttcaaactatactacaaggctacagtaatgaaaacagcatggcactggtacaaaaaaagacacatagatcaatggaacagaacagagagcccaaaaatattgccacgcacctacaattatctgatctttaaggaaaatacacaagcataagaaatgtggaaaggactctctattcaataaatgttgctgggaaaactgtgtagccatatgcagaagattgaaactggaccccttaactcaagttgaattaaaaacctaaatgtataaccgaatactagaaaaactctgaaagataacttaggaagtaccattctggacattcttgacataggacctagcaaagccttcatgacaaaggcgccaaaagcaactacaacaataacaaaaaaaaattgtaagatatctaattaagttaaagagtttctgcacagcaaaataaactattaacacagtaaacaacctacagaataggagaaaatatttgcaaagtatactatccagcatctatatctagcatctataacaacatacagcatctataagaaacttaaacaaatttacaaaaaaaaaaccaaacaactttattaagaaagtgggcaaagtacatgaacagacactttacaaaagaagacattcatgtggctaacaagctatggaaaaaatgctcaatatcactaatcattaggaaaatgtaaatcaaaaccacaaagagataccatctcataccagtcagaatggctatcattaaatgtcaaaaaatagaagatgctggtaaggttgtggagaaaagaacacttatccactgctgccgagaatgtaaactagttcagccagtgtggaaagcagttaggcaatttcttaaagaacttaaaacagaattaacatttgacccagcaatcaccatcattgggtatatttcccccaaaagtataattcactctaccagaaagacacatgcctgcacatgtccactgcagcactattcacaatggcaaagacatggaatcaacctaaatgcccattagtagtagactggataaagaaaatgtggtatatgtacaccacagaatactatgcagccataaaaaaagaatgagataatatcctttgcaggaacgtggatgcatctgaaggctgttttcctaagcaaggtaacacaggataaagaaaccaaatatcacatgctctcacttataagtgggagctaatcactgagtagatatggacacaaagaagggaacaatagacactggggcctacttgtgggtggagggtgagaggagggtaaggattgaaaaactacctattgggtactatgtttattacctgggtgacaaaataatttgtacaccaaacccctgtgacatgcaatttacctatatagcaaacctgcacatgtgctctcaaacctaaagtaaaatttaaaaatatgttcttctttctgataaatgcatgatgaggaattttcagatgaagaaaattctacattttcccaaaagggaaggccatatatatgttcagaaaatctttgggtggattagccaagattaaccagattaacaatgtgaatctggtgagtagtatcccatgataagcatattcattggtgagtgggataacctgttgagaatattctttgtattagtccttttgtcttttctgtaaatttgaaatacttcaaaacaaaacacatttaaaaaacaaggtccctgctcttaacattgtgtttcttgagtaattattcttttcctcaaaccccattaaatagatattaatacacaggaatagttgcaggtcagagataaataggagataaaaacatctgaaatatattttgaaaaatggctgcattatcatatccatttaactgatctgaataatgattattactaataactcaataataattacgatatcatgctaagccagtctatgaaatttatagtcaaaatttatttgattcgtgtttttctaacatacagttccttttgaaatactacattgtaaaattatctggaataatttttattattaatatagattcatatatattaaggcatacatacaagatttggtatgtttcaaaattattatagtgtggcaaaatcattgcagtatattgtgttaatgttcccaattatttgttacctctccccatgaaaggattatagtttcttgctctgtggatgtcaagcttgatattgacatatgtcatgtttatgttttaagaggcattgcatgagtccatcattcttttcattctacaaatagcttgtctcagatttgggggctcctccaaactagatcctggaacaaaaatgatgcagggaacacctccagagctaacaagtaacatgtataagaagcaaatctttgttgttgtaagtcactgagcttttagggctgtttgttctcaaagcacaaaataacaaaaactaataataacataatactaatcatggtaacacctattttagaatatatttagaaattatgtattacattcatattgagaactgaaagaaattccagactcttcaagtttagatttaaaatacataaaaattctttgctagatgtgtggggcatgagggggattgtaaagtcacatttcaggttcagatcactaggaaaagactttttaccaaactacacttttttaaaaattatactttaagttctgggatacatgtgcagaacgtgtaggtttgttacataggtatgcatgtgccatggtggtttgctgcacccagaaactcgtcatctacattaggtatttctcttaatgctataccttctctagcccccaacccctcgagaggcccctgtgtgtgatgttcccctccctgtgtccatgtgttctcattgttaaactcccacttatgagtgagaacatgcaatgtttggtcttctgttcctgtattagcttgctgagaatgatggtttccagcttcatcaatgtccctgcaaaggacatgaactcatccttttttatggctgtatagtatcccatggtgtatatgtgccatactttctttatccagtctatcattgatgggcatttgggttgattccaagtctttgctattgtgaatagtactgcaataaacatacgtgtgcatgtgtctttataggagaatgatttataatcctttggttatataaccaataagcggttgctgggtcaaacggtatttctggttctagatccttgaggaatcgccacactgtcttccacaatggttgaactaatttacactcccatcaacagtgtaaaagtgttcctatttctccacatgctctccagcatctgttttttcctgactttttaatgatcgccattctaactggcatgagatactatctcactgtggttttgatttgcatttctctgatgaccagggatgatgagccttttttcatatgtttattggctgcataaatgtcttcttttgagaagtgtctgttcatatcccttgcccactttttgatggggttgtttttttcttgtaaatttgtttaagttccttgtagattctgtatattaccccttggtcagatggatagattgcaaaacttttctcccagtctgtcggttgcctgttcactctgatgatagtttcttttcctgtgcagaagctttttagtttaattagatcccatttgtcaattctgggttttgatgccattgcttttggtgttttagtcatgaagtatttgcccatgctatgtcctgaatggtattgcctaggttttcttctggggttttcacagttttaggtcttacgtttaggtctttaatccttcttgagtttatttttgtataaggtgtaaggaaggtgtccagtttcagttttctgcatatggctagccagttttcccaacaccattcattaaattgagaatcctttctccattgcttttgtcaggtttgtcaaagatcagatagttgtagatgagtggcattatttctgaggcctctgttcttttccatttgtctatgtatctgttttggtaccagcaccatgctgttttggttactgtagccttgtagtatagtttgaagtcaagtagtgtgatgcctccagctttgttctttttgcttgggattgtcttggctatatgggctccttttttggtttcctatgaaatttaaagtaggtttttctaattctgtgaagagagtcaatggtagcttgatggggatggcattgaatctataaattactttgggcagtgtggccattttcatgatattgatttttcctatccatgagcatggaatgtttttccatttgtttgtgtcctctcttatttacttgagcagtggtttgtagttctcctttaagaggtccttcacatcccttctaagttgtattcctaggtattttattctctttgtaacaattgtgaatgggagttcactcataatttgtctctctgtttatctattattggtgtataggaatgcttgtgatttttgcacatttattttgtatcctgagaatttgctgaagctgcttatcagcttcaggagatttggggctgagacgatggggttttctaaatatacaatcatgtcatctgcaaacggggacaatttgacttcctctcttcctacttgaatatgctttatttctttctcttgcctgattgccctggccagaacttccaatactatgttgaataagtgagagagggcatgttgaatatggtgagagagggcatccttgtcttgtactagttttcaaagggaatgcttccagcttttgcccattcagtatgatattggctgtgggtttgacataaatagctcttattattttgagatacgttgcatcaatacctaatttatggagagtttttagcatgaaggatgttaatatttattgaaggacttttctgcatctgttgagataatcatgtggttattgtcattggttctgtttatgtgattaagtttattgatttgcatatgttgaaccagccttgcatcccagggatgaagcccacttgatcatggtggataagctttttgatgtgctgctggactcagtttgccagtattttattgagaattttcgcatcgatgttcatcagggatattggcctgaaattttctgtttttgttgtgtctctgccaggttttggtcccaggatgatgctggcctcataaaatgagttagggaggagtccctctttttatattgcctggaatagtttctgaaggaatggtaccagctcctctttgtacctctgctaggattcacctgtaattccatctggtcatgggttgttttttggtttgtaggctattaattactgcctgaatttcagaacttgatattggtctattaagggattcgacttcttcctggtttagtgttgggaaggtgtatgtatacaggaatttatcaatttcttctggattttctagtttattcacatagaggtgtttatatattctctgatggtacaaactacacttttgaggtaaatgcttgtgaggtatatgggagtcatcaactttgagggaatcagagtacagggaactcaaatttcacaatgaattatttgaaaagacttttaaaaatctattctgtgggacatatgtaacttataaattgtcctaattccctataactggaaatgaattttgtttttccactttaatgtgaaagaccctaatttttatgacatcctttataaaatcttactttgagacaaatggaattaaaaggttattatgatagcaatatgttgctatgttaatagtatgcttggaccattatgaacaggcctaacagttatgaagactgacaacaatgtgctggctacaaggacttcacaatttgtaaaggtagcctggacaaaaatacagttttaaactttattctttcattcttaagtttcatggtacatgcctataataagatgctaaaagaacaaatcctacttagaaggaaatttagtgagtacatttacatactcttaaaaaatgtcttgcgcaacttttaaaaaatgtattttaaatacaaaataatacataggataaaaatcaaatcatacctagatatacaaggggaaaatgtgaaagcctcatttcaactccgtctgatctgaatcctatccctcagaggcaaccacttttaaacgtttggaacatatttatctatccacttttaaacgtttggaacatatttatctatctgcctgcaaatacacacaaataaataagctttttccttcttgagtgctatcagactatacatttggttctatgatttgctttctttactagtcgatataacagacatctttccatgtcactacactactactactcctccctcattctcttgcaacattttttttttttttttttttgagacggagtctggctctgtcgcccaggctggagtgcagtggtgcaatctcagctcactgcaagctccgcctcccgggttcacgccattctcctgcctcagcctcccgagtagccgggacaacaggcacccgccactacgcccggctaatttttgtattttgagtagagatggggtttcacagtgttagccaggatggtcttgatctcctgacctcgtgatccgcccgccttggcctcccaaagtgctgggattacaggcttgagccaccgcgcccggccattctcttgcaacattgtatagtattgcagtgggaatatctccacaatgtatttgaccatttcctgttgatgggaacttaggctatgtcaaatatttttgcttctaccaaccatgccgcaacgaacattcttatacattatcaatgtagagtattataaaaatatctatctcccagaagtaatggctattaaatcctcaacgagatccagataatttggtttccttgcttgaaagggacaaatatgcagagatgcctccatgaccactcttaagcagcatatttatgattatgatgatggtaatgaggatgataatggtaactaatatttgctgaatacccaaatgtctggcactttgcatttataaacttatttacttgtcacaaaaaagcctgtgaggttagcaatgccgtatttcctcaattctaagattcacatcttttgagatttttggattagggatgctgaattgataagtataatgcaaatattacaaaattcgaaaaaaaaaatccaaaacccaaacacttcttgtcccaagcatttcagataaggcatactcaacctctatttactggttgtgacagcatatagtattgctctcatttcataaatgaggaaacagattcagagaagttaagtactctattcaacatcagacatttagtaaatgacaataatgggacactcacccaggcaatctgacgtgaatttgtacttttaactccttttcctgaagtgcatgaagttatagtaacaaggtagaacaaatgttgagcaccaatcccccatgcatacaccacacacatcaaaatgtagcactgattataaatatctagaggatttatagatggtttttatttacttatattcttctgcaattttccagttttctacattgaattagttttttaacatattgtaggaagttttgaactcatacaaaactagagagaataataatcatgaactcccccatatatccattactgagcttcaacaatgattaattcatctattcctggacccattagccaacacttattatttccaagcaaattccatgcttcatattataccatatgtaaatatttctgaattaatctctaaagacaatgatttttaaaaaccatgatcctattatctcaggtaaaaattaataataattatttaatatcatcacatatccagtgttcagatatccccaatcatctcattttttaatctttcaatattgagataatttgtcttaggtgaaaattgcaaaaattttgtaaaaaatagtgcagaactttcttgaatactcttttctgcttctcctaatattatctgtaggatcataatttaaaatactacttaaatcaggaaattaacattgaaacagtactatcaactaatctacagatcttattagaatttcagcagttttcccactgatttcctttctatggttcaattgcaatctgggatcctatattgcttttagttgtcatacctccttagcctcctccagtcaatgacagcccctcagtctttctatatctttcatgaccttgacactctgaaatagtatggtatgccaagcagttattttcacaatgtctttgtaaaaataaataaacagtggtgttgcctcatgagtgcattttggcaagaacaccatggatgtgatgttatttccttctcggtgcatagtatcacaaggcgcacaaggttcacatgtcttttattggtgactggtgatgatgactttaatgatttggtttaaagtggtttccaccagttttctccattgtaaagttactatattttccttgcaattaatacgtatcttatggggagacagtctgagactacacagataccctatgtctcatctttccacccactaattttagcatccattgacgattcttgtctgtaataaatgttacagtggtttgtgcttaatggtggctatttctatcacttttgcacatttttaattgaaattcatctgcaagaagagctgtttcccaaatcttaactttattattcatttatttatttattatatgactatagatttatgggtatctattgtattatattataatccaagactattactatttacttttttgttcaaattatcacagatttgttgactgggagctccttcaagctttgtccgtgtcttttcaacatgcccccatcatttatttatccttccttacattttggcaacataagatgtttctggctactcttgttttgtttcctgccccaggcttgaaattaaccatgactccaaaaagccctaattatttttattgtaaaaaaaatttagaaaccacaatccaggcattaagtatgatcacagctaatgttttgtcattgtttctaggtcctctcagtgaacaaagctaggaaatatatgtatgtatacacccacacaaatatccacatctacatttatttctatatctatccttatgtgtgcacatgtgtatatattgatatatacatatttacatattgataatgttcttacatctatatttatatatacagatatacacacatttatactgatatctctgattctaattcacatagctcattttagccttctccctttcccttgtttgtaactccttttatgaaacctgttattactcacaacatttgttcagtcctaatatacccattaagtaattataaaattgttaacacacaccattgtaaaaaacaactttcttcactagagtacaactgctgtgtacatttatttttgtctttctttagacttacagtatgcatttttaatagtactttccatagttacttaggttagcttactttttttcttccccactcacttcagtgtggttttattactcatttgtaatatagctaggttcacttgtaatgaattgcattgaacttttgtttcttgcaaaatcatggttgattttaattatttgtttatttttggagggtatgtgaaacattctcatggctctgttacagctacacaaaaaagtatattcacaaaactgttgctccccgtcatttctaccactcccttctcattctctcattctttgtacctcatacacactaactacctgtagcctctcattaagtctctggcttcctgtatttcttttgcacaattaagcagatatatgtacatatttttacacctccttcatcacatgaaggataacatattacagatattcttttgcctttaacacttttaatttaatgatatgttccagaaatcactccatattagctcataatgatcttccattttcttttttacagcttcatgccaccacactgtatgaatgtgtcacagtgtatatgggtatttatattgttttcaatattttgtaaatataaataatgttgcatattcactgaataactctgtgcatattcacttttgtattgttgaaagtgtatctacagggaagacttctagaaatgggattggtaagccaaaagataaagctgtattatttgttaggtatagataggatagatataaaaataaatgtagatgtggatatttgtgtgggtgtatacatgcatatatttcctagctttgttcactgagaggacctagaagcaatgctttcaaaagcattatactagcttgcattggcaccagcaatgtcttatctgtctttaacaatatgcttgcttaaatcaggatccagataagctctatacattgcaagcagttgatacgtttcttaattctcttttaatctgtaggtgttctggactactccaatccctgtctgtctttttttatttaaatgtatttgtctaaaaacccatatctgcattgcagagtttcccacaggttggatttttctgactgcattcaatgatgtcatttgtcatgtaattctgtgctttgcatttcccataaattattaaatttagaggcttgatcagatttgagtgaacttttctggcaaaaatatttcatagaaggtattgtgtaccttactaaaaggcaccttgtgactggcaacctaaaaattttttaaacagtttattatgtaccttaaagatgtatttttaagatgaggaaaaaagtaaagaaaaatattttctatatgtgccaccacatataagctatttcaaaaataatttattattatatttcatctggtaataaaattgacatatattcatctcaaaaaaaattgtgagtagaacagtagatgctgctagacaacattaggatggcttcctggctcataaggattacctaatggttatgtctatgttatttaacctgccttcacagccacctgtgactcaagctgggtaatcagaatctcttcactggaaatttaaaacttggagacacagagagagaaatcatgttaatagcagcactttagaaaacaaatatagaaaattattgttgctaacatccttggacagagaagtgccctattccggcttgggtattcactcctttgattctgagagctaattagaacttcctctacctgacaccaaatctgccactaccttgatcttggacttcccaacttccagaactgtgaaaaataaatttctgttccttataagtcattcagtttgtggtacttaattatagcagcccaaacaaactaagacatcaacaaaaaagaaccttaacaactacaatgataccaatcattgatcagagatgaaataatttacccaagatgctatgggatagtaatgggaatcagatcacctaacacccactaaaagattgtacacaacaggtccttcattatcttagttccgtagtatcttgtcattttggaaatatatcttctctgatgctaacatggaaggtaaaataaggggtcagaaaactaaacaagataggtagtaaaccagataagcttcttctaataccacaactcactgcacaaaacaataaagcccataaataacatcattgggtacaggctatttctggcccttacttttctaaaagatctctatgctagttattgaacagatagttgcactcccaggtttattgcagcactatttatgataccaaagatatgcaatcaacctaggtgttcatcagtggatgaatggatatagaaaatatggcatatatacacacacaatgaattattgagccacaaaaaataatagaatcttgtcatttaccatagcatagctggaactggaggacattatgctaagtgaaataagccaggcaaacagagataaatgtcacatgttctcatatatggaaactaaaaaattcaccttatggaggtaatgaatagaatggtggttaccagaggctaggaattgcagttgggtagggggagataaagacaggtggttaatgggaacaaaaatacagttagatagaaggaagatctagtctagcgttcagtagtacaatagggccactaatagttaacaactatttattgtacatttcaaaaaaagcagaagaatagattggaatgctcccaacacaaagaaataatagttgattgaggtgatgggtatcccagttacccagatttgatcattattcattgcatgcttgtatcaaaatatcacatttacctcataaacacatacaactattatgtatatataaaattaaaaaattaaaaataatgtatgctagttatgcttttctgtttaggccgaagtcatctcttttatgacaggaagatgggaaaggagtgcaatcgttgaaagttaatttatttcaaaccctttacacagcttcttcattcatgcctcacaatatcttgagaattaggtagccattattcccattttacaactgataaaatagaagtattgctaggcctggcatggtggctcacacctgtaatcacagcactttgggaggcccaggcaggtggatcacttgagctcagaattttgagaccagccttggcaacatggtgaaaccccgtctctacaaaaacaaacaaaaattagttgggcatggtggtgggtgcctgtagtcccagctactcaggaggctgaggtgggaggactgcttgagcccgggaggcagaggttgaagtgagcagagattgtgccactgcacttcagcctgggcgacagagtgagactttgtctcaaaaaaaaaagtgaaataatttttccaaagtaatccatcaaataattcatagagcaaggaaatgcattacaatgtccattaacataaatacatgtactgaaaactgaaacaatcaaagtggtcattcataaaatggaaaaataaattgtggtagagttacacattagaaacagtacagtagggaaaataaattaactgttaataaaagttatcaacataaagctcccaaccatattttgactaaaaacaagttgagaagaatatatacagtataccatttatattagattttaaaggaagtaaaatatatatttctgagatataaatgtacatgtggtaaaaaatttaaaaaattattcatagaaaaaataaaccccaaactcatgattggagtaatggaattaaggaaggttacacagaagatctcagctgtattgatcaaatttttacttgttaaactgagctaaggctacaatggtatcggttgaatttttctttacaaccttgtgtattgcttaatatgtaatactttaaaaaagaaagtaaatggtatctggagtataaaaattaatgttgaaataaatgtacatggatctttaagaaaaaaaagaaagaaagaaagttggggaaggacgttgagaaggaaagcagaagtggggaggaaaaacaaatgctacaattccactacccagagattttcattgctagttgttttgttcataatttcctatagcattttttctgttcatatagaagtatgtattcacatatattgtaaagaaatatttgataatattatgactactactagaaaacctattttgtaacttatttcacaggcaccaaatcagtgccatttaaaagggctgtattctatccaatcatattgttataccacaatttattttaccaattcactattgatgggcatttagattatttccaaagtgtgctattacaaataatgctgcaattaacacattatatgtgtatgtgcatacctgtgtgtattttcagtagtaactgtgttgaaaaaaaattcctaagggtagaatttctaggtcaaagactaagaggttttcaagtttgttacatatgccaaatagcccaacaataaatgattatactaatttacacacttaatactgtaattgagtgccagtgtccccaaactctgcacaacactgggcataaacaatctttttatccccttgtcaatcataatctgctattccgttttttcatgtgcatttattagtgaagctgagtcactttttaaacgtttactcaccatacttgaataacttcttctgatttttttgccattttgttaacatttttgaagttttaattattatggatatataatagttgtacatatttatggggtacatgtgatattttgattagaacatacaatgtgtaataatcaaatcagagtagatggtataaccatcacctcaagcatttatcatttctttatgttagaatcatctcaattccgctttttagttattttgaaatacataataaattattgttaactatagtcgtcctattacgctaccaaacacgaaatcacaaataccaggaaagttaacggagaactggatcaggagccaaaatgtttacattcgaattaaggctctggattaatgaaaatgcgtaaccaggaaaagaaagaacaagaataatggggacatagagggtgagagaggagaaaaacgagaagaaaaagccatgtaaggaaaaagaatttgcgcctcagggtccccctccccctctgccctgttccagacacctattctcattcccgcactcctacccctggcgtcctgctagctggtctggcttccttccctctggaaaaaggcaaattattcaataaagggaggatgagtcctagctcatccccacttcttgtctcctgccgggtgttcaaatacaacttaccacgcagtcaccgccatccaactgcatgtcactctccacttcgccacggtctgaactcttggccacaagatctaagccttccggatgccccagccagttcaggctgctggtctcttgtccctaagcctttgccgaggtagtcggcttacttgatgccagcac

SEQ ID NO: 1430 - DNA, 29031 bp, Homo sapiens
ttaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatcccagaggcggaagccaatggaggtcacatccggcccccacgcctggagcttccctggatttacagcaggagcgaacccgattctgcccgtgtgggggcggggcgaggcgaggcggggcggggcgaggcgaggcggggcggggcggggtggggcagggggaaaagtagtggcgaggggtgcagatgtggtcgagggtcatgggggtgcctcagtcctccctcaggtttctgaccttgattccttgcagagcctggagctccgtcctctgccaatgatgtctgctcctctcggaccaagtctctgactctgagtcccctgaggtggcagtgagcgggaggtgtgaggtcgggggacaacattgccaaggtcttccggggctgacaggagggaccgagctggattctgtggcccctctatgtggggagggtggaccgtcagtcctcactcaggagggtcctcctcttggctactggttctttcatgaagtgatgggtgggagatgctctgtttctgtcacctctgagcattgcccaactgcaccccttgcagacaatagctgcggatcccaggctaggtgcttccatgtggcttcagtacccgtgattgtagtgacctctgggagaagatgcacaccttcctacgggggctcctccccagccagatctagactttgcaaacttttgccctgaaagctttatttttacactgaagaggctgagtggctgcaagaaatttgcggaagtcctgcgtttagaatttatctaacacttcatagttcattttagtgattttcattttttaattctcattcagtgtcaaaaatcatacttaacctaactgcctatttcactctaatggtcaatactctaatttaatccattctttatcttcaattaaaacgataatttttaaaaagccaatctttatctactgacgtggttttagtggttatcagcacaaattccagccgtattcctttaatcaaccagtgtttcctcatgtcctgaagttaccccatgactactggcacctgtggtctgagaccctacccgagttttccacagtgaagtaggggcagaattttaaacatttctttcttcctatccaccccaacttccctgccactcttcccccccaatcacaagtattccttcaaaatacaatgaaattctcagggctctctcatgttttttttgtttagatttcttttttgatattgtttgcttgttcctttatttatttatttttattctttagttttcccgggttgttttggggagtctaagatagaagcccaagactgaacgcggtggttcacacctgtaatccaaacactttggtaggccaaggcaggaggatcacttgagcccagtagctcaagattaatctgaactacataacaagaccccatctcaaaaaaaaaagaaagaaagaaaaagaaaaagaaaaaagaaatgaaaaattagctgggtgtggtggcgtgtgactgcagtcccagctggtagggaggctaaggtgggaggatcactggagcccaggatgtcagtgctgcagtgagctgtgttcacaccactgcactccagccttggaaatagagtgaggtcctgtctcaaaaaaacaaaaccaaaccaaacaatcaaaaaccaacagatgcctgagcttgacagtcatcttggctggttaaggaattacgtctgtcaatttttgaaaaaatagaattgccatctttgcaatattctgttccctatcaatgatatcatatactgccttgtttatttgggtgctctttgaactggatatatcagtacttgtatagttgcctcagtaaaaatcatacatgcttttgttagtcttcttgttaggtaatttttggatattgttgctattgtgaatggggtattttctatgacctgttcttaatagttattgtctgttttgcaaatcttttgattttgctttattgatcttctgttcgctatttttcacatgtctcttattcatttgactatttcaagtgtgcatttttttgaattttctagatagactgttgcattaccctaccaaatatcactctttctttccaatatacatacctcttatttattttggtatccatatctgtggctttgtattccaatacaactttgaaaaatagcaatgatagcatacatttatgacctgtgcctgacatgaatgcgtccaacattttacaattaagtatatttgctatcaatttgatgaaacaaaatttccttctactcttaattttctagttatttttatcatggatgattactaattttttcaaaatatttttctgtatccattaatatgatcatatgttttgcctctataatcttgttaatatagggaatcacactgaaggtatattttaatgtcaaattgtattttcattctttggatatatcccgtttttccatttagtacactgccctaatgaattggctattaatttatttaggatatttgttgctatgtgagtaactttggtttaagtgttcttttcatggtgaggtcctcttctggtatttgaaacaaagaacactagtctcagaaaatgagttccacagttgcccatctttttgtatggtttttaagagtttgcttaggatggcaatgagttctaattatttggtaaaactggcctctgaaactttcttttcctggatcatttgtgggtggcttgaactgagaatacagttttagtttgtaatgtttgattaaagttttctgtttctttatggaccaatttgatctttttttttttttttcgagacagagtctcgctcagtcgcccaggctggagtgcaatggcacaatctcagctcactgcaacctcctcctcccaggttcaagcaattctcctgcctcagcctcctgagtagctaggatttcaggtgtgcgctaccacacccggctaatttttgtatttttagtagagacggggtttcaccatattgtccagacgggtctcgaactcctgacctcgtgatccacctgtctcggccttccaaagtgctgggattgcaggcgtgagccactgcgccgggccattttttttttttataaaatatagttcatttcacttaggatttcaaatttaatggcatgatattatgatgaaataactttattaaagtgtcagacatgtaaaatagtatagtataatatacccaatatacttgatattcagcatcaaaaatcttcaatccattactaatctgtttccaactatacttctacctaccccacgtctcaaatgctggaataatgtaaaccaactcagtaaccttggatagaatactggatccaataagccagttcatggtacagtgcagctgacctggctctgagacagcctatggctcagagaaaagggtctggcttcaatagaccagcctccctagacccctacctcctactctctgttccagggtcctgaggtactgcacgcctttgttctcttctagacacatgctcctataatactgctagctaatactgctttccagacacccttgggtctctctccaaatatcttctctgtgaggccttctatgaataacctttctttttcttcatagaatttgtgtctttattatttatttttgtaatttcactttcattttagattcagggggtacgtgtgcaactttgttacatgggtatattgtgagatgctgagatttgtgatattattgatcccgtcactcaagtagtgagcatagtacccaatagttggatcctgacctttcatcatatacaaaaattaattcgacatggattaaagattgaaatgtaagacctcaaactataagaatcctagaagaaaacctaggaaacaccattctggatatcaccctcgggaaataatttatgactatgttctcaaaagctattgcaactaaaacaaaaattgacaagttaacctaattaaactcaaaagcttctgctcagcaaaagaaactatccacagagtaagcagacaacctgcagaatggaagaaaatattccccaactacccatctgacaaaggtctaatattcagaatctataaggtgcttaaacaattgaacaaacaaaaacaaataacctcattaaaaagtgaataccctttctaaaattgcaatcctccctcttaactcatcccaaacacttattcagttctctagattcaatttgtttccatagtatttatcaccatgtcaaccaaaattaagactggttaggcaaaaataagaggataaatgtttattggaagccaaatgtgaggactgacctgggaggagaaaccaacaaagttgggagtgttctggagagtcttacaagttggaagggttttatgagagtttagaacaagagagaactttttatatggcagttgtcgttttttattagaggatacaatacggaggttagaatcattgtaccaaattgcaacatacagactaaaatgtccatgtgcaaaacaaccagtaaaatttcatgatttaaaaataaatcagcaaacttttcaatgttggtacattacatattaatccatatgtaaacaatttgtggaatgcaggataagacactttactgagggacaggatggcaacagaaatcacaagacctcccccaggtgagttcatttggaagcctaccaaaggtgatttggaagttaaccattaaatctactgcacctttaagtttgtttcatgatttattgtgtgcctaccctttacctcactagaatgtaagttccacctagggaggaaatgtgttcaatattgtatcctcagagcccaggacagtgcctggcacacaatacatgctcagtattcatttatggaatgaataaagaactgccagttctatggtcctagtatttggagcttctctggtactaaagtctcatggaattttcaatctttccaaacacccaacagccaaagtttgaatgctcccactatcttctaattgttggctcctggaccaggtaagcatctgagttttaaagggactccaaaggcctgctttcccagcttctggtttgtgctcctcacatcctgggtaagtgagcatggcagggctctagccacccagggctatctgaacactctctcttgtcaggaggcagctgtgacctttccctgatgccctgtttctttttccatcttgtttggatatgcaagttaacacagtagtccttgcaaggtggaatctaacagcctaattgtacctgttgggatttggggtttccttctcctgaggcccatctctgagcccccatcaccttggctgcagtgcccacacttgcccacagtttcccgtatctgacttcagtcttcccaactggggcttggaattgcagctctccaatacaactactcaagactcagtgctgaggcttatgaacagttaaacttttatttaaaattctctacttagaaatccccttccaaagtattatggttcagatagaactggcagaagatgaggtagccatttggtgagtttcctaggggttggtaaataataaaagaatgctgtgtgaatgagtgacaaatcactataatgatgacttacttttcaaatgatcccctatgtaatgcccacacattaattaaactaatcacctcgttaaggcgcctatgagtttttgctttctaaacttgatccagagaggtgatgccgaactgttttgtcagctacccaaagagccatctaggatctcggtgtacccccaaaaagtttaagaagactaatgggtgaaacccactgtgaggtctgtggtcattagtatactcctccaggtcccagaatatcctcaggtcaaattaggatttggaaaggagccaggaagggtaaggctttcttgttaccaaagggcataggctgtgatgagtttggaaaagtgtgagaaggatcacctgctggatccatctatagtgccttaggctggccacgggaggaatgtagaagtaaaatgggactggaggtgagctggagccctgcaagatgtcatgaaccgagtgcttccagaaagaactccagagcagactgctttgtcgcactccaggatgacaactgtgacacttagtgccctttgttggagagaaacgacggatggggagaatgctaactctaggatgcctaagtgttgcagggctagagcagctagggggtctcacagcaccccaccaacagcctcttctggaggcatttccagggtctagcatatcccacagcagcctcctgtgtggttacacaccacagaggatggaggcaatcctgaccagggtagggcagagcagatgggggccttcctgtgcccatacatgggaaggtcctgactgtctctagatgtcctgagcctgcccactgagggactgatgtgaggcctgtcagccatggtcctgctctcctaagagacctctctgttccaccagctatgactgaaaccctgcacttaacttcagcttccttggcaaggggctgacctcctgcatgcttcttgaaagctgtattagtccattttcatgctgctgataaggacttacccaagacctggcaatttaaaaaagaaaggggtttaattggacttacagttccacatggctagggaggcctcacaatgatggcggaaggcaaaaaggagcaagtcacatcttacgtggatgacggcaggcaaagagagcttgtgcagggcaactctcattttttaaaaaccatgagatctcgtgagactcattcactatcacgagaacagcatagggtaactgcccccatgattcaattatctcaaaccgtgtccctctcacgacacatgggaattatgggaattatgggagtacaattcagaaggagatttgtgtggggacacagagccaaaccatatcaccagctcttccctgtgccaattaccctgtcagcttttcctgagcaaataaggagtcctgggtctccttttatccttgatcccagggctggagctgaacatagggatagcgggggctagtggcaggatgcttgttatgtcccaagggaaatccacaaaatagcatcagaggacaaagccaaggttgcccatcactcagactgagggtcagtgcaaacaagccctgcagacactgacacctacgtggatgcagtgagagtccacatgtctcatgagcactgcgctccgtcctacttgccccaccatgtatctggttgccagcctgctcagtggagttggctcgaaggaaattgttgagtcatctaatctgctgagaataaaagagaccaggccaggcaggtacacagcaaggcagggcacatgtctggacataatagcagcctctggaagactggacttctgatatccatgtcaaatggttgctgtagcttagcctgggcaactgcacttgggccatgagctgccagggtaccctaaaggtcaatggaagtcttcctggaggctggacttcctggcatatatttgaggttctaagcctgcttcaggctccaccatcttctcacttgatttatctctgggatccctttgttttatttgtgtgtaatgcattttatcttgctgtgttacgtacttctttgtagcctgctccaaatattttctgaatgaagcaggagtgaaaaaaagggggaggaaaatagtgagcgaagtcccttctcaatcccacttaactctttaatgtcttcacctcatctgcattcccctctggatccccagtgttctgttaatggagcacaagctcattgcaggggtcgcggttctgaactgcagcccatctggagctctcaatgcagaaacttgtccatcttcacaccctttatcctaggacccacctctcctccacagcatttgtctccatgtcatatggatagaacaggagagaggccattgggtaggattctgtttcaagctttcactggcaccaccacttggctcctttaagatcagtcctaggggcatattgatagggcaatagttagcagtggaagatggctggcactcccttgtttgtgggttgcagctcaacccagtacagagacagggctttgaacccataagaaagtaagtttgaatattagctctgtcgcttataagcccatacatcaagtatcctttatgtacttcagttttttcatctgtaaaatgggagtaataatagtacaacttcagagtgtttatgtgagcatcatataacatgccacttgtatgtaaaatgtttggccctaataatgtggtcattaataagtggctattattattgtgtgcccatgatgtaccttcccccatattttaatattcctgaacctgtatatgtcttatgatccacatgtgcattaattaacgcatttattttcttttccccttgaaaatctgttaccttggattgtttaatcccacatctttgagctgtatagacatgatataacttgttctagtcctgcttggggcaataaccagggctattgaaccaggacctagatcaacacataggtctgtgagagttgctttgaagaattcctccaggctcaccctccctgcatccaatctcacaccccagagctctgcaagggagagtcctccaggtgaacacactgaatgccaaagaaaaggtcccacactgtgcctgaccctggctgcccaggttcacatctctgaggagtactagagccacattccaaattctccacaccactgcttgcacttcattgggatggctcaatggttattttaaaaagtacattgttccttgcacaaatgtttttgtattttgaaaaagcctagagttacctactttccaagtataaatctctttttgtgcctaacatgttgtcaattttcttttctccctatcttaaatttaaaggagcagataaaggcaatcttatgtgcccagaaagaagagaaccaaatatttgtgaccagccctgatatgcacaactgaggtcattttagaggaggaagctgaggccccttttctccatctgcttgtcattgctctagtctaggcctgctcttatcctgtgggaatcctcaaccctggacattccagcctcttaacagttactgtatgacaatagcaacacaaagaagtagggagagaatggaactgtatgtgaacaaacccattgtatactattttaattaagttggtattaatttaaatagattggtacaagttaaactatcaattgtagtccccaggacaactgctaagaaaataataccttaaatggcaatgggattaaaatggtagactagaaaaacatatatttttcacaaaggaaggtagcattgaaaatataaagaaggaaaaatacatatgtaatataaagagtaaatcactgactacaacacagaaatattaccttaccagtaatcttaaatgtaaatggattaatcacctcgattaaagtcagagattggggaaatatattttggaatcctgttctaactatatactgattatttataagagatttatatagatgtatacatctaaatacataaataggatgaaagtaagtatatgggaaaagatatatcatacaagcagtaaccaaaagagagctggaatggctatgctaataccagacaaaatagactttaaaataaaagttgttactagagaaaaagaaagatattttataatgatgataaaagttttagtctatcaaaaatatgaaacattataaacatatatgtacctaataacacagaccccaaaatatagaaagaaagaattaaagagagaaataaataattcaacaataattattggagactttaaaccctaatttcaataaaggtataacaagatagaaggtcgccatgactatagaatatttcaacaacaatataaaccagccagacctaacccccaattatagaacacagcacccaaaacagcggaatatttttctcaagtatacatggatcacctttcaggataaacaatatgtaagcccacaaaacaagtctcaataaatataaggggattgagattgtacaaagtactttatctgtctgcaatggaataaaatatgaaattaacatcatgctacctgacttcaaactatactacaaggctacggtaaccaaaacagcatggtactggtaccaaaacagagatatagatcaatggaacagaacagagccctcagaaataacgccgcatatctacaactatctcatcttggacaaacctgagaaaaacaagcaatggggaaaggattccctatttaataaatggtgctgggaaaactggctagccatatgtagaaggctgaaactggatcccttccttacaccttatacaaaaattaattcaagatggattaaagacttaaacgttagacctaaaaccataaaaaccctagaagaaaacctaggcattaccattcaggacataggcatggacaaggacttcatgtctaaaacaccaaaagcaatggcaacaaaagacgaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaacttaaacaaatttacaagaaaaaaacaaacaaccccatcaaaaagtgggtgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaacctagttcaacccttgtggaagtcagtgtggcgattcctcagggatctggaactagaaataccatctgacccagccatcccattactgggtatatacccaaaagactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtcaggggaggggggagggatagctttaggagatatatctaatgctaaatgactagttaatgggtgaagcacaccagcatggcacatgtatacatatgtaactaacctgcacaatgtgcacatgtaccctaaaacttaaagtacaataaaaaaaaagttaacatatttaaatttccaaaaaaaaaaagaaattaataacgttggtaaatttcagatattcacaaatttgtgaaaattaaactacatactcctaaacaaccaacgggcaaaagaaaaaatcacaaaggaaattcgaaaatattttgagataaatgataatgaagatatatatacacacatggtcatgtacaaatgaacaccagctcatcgcatagttcaagtgcactagcttgcattgttgattgcacagttttagagagacatgttgatgaccctattttgccacttccagagaccagatgtactgtgcaattaaccagaaaacactgatttataaagcatgaaaataagaatctcttctgagcttataactaaacatatctaaactataataaacattaaattccaaggacttgatatggtttggatctgcatccccacccaaatctcatttcgaattgtaatccctacatgtcaggggaaggaccatgtgggatgtcatcagatcatgggggagggtccccccatgctgttctcaagatagtgagtgagttctcatgagagcagatggttttaaagtgtagcacttcctcatttgcgcaaaccctccatcctgcagccttatgaagaaggtgcctgcttccccttagtcttccaccatgattgaaagtttcctgaggccttctagccatgcttcctgttaggcctgcaaaactgtgagtcaattaaacttttttcctttataattactcagtttcaggtaatattctttatagtggtgtgagaatggactaatacaggactacagctgtgcctgaacaggttacatcaaaaataataataaaaaaactactccaaaagatgaacaatggctacctctgccaaatggaagagtttagatgggctgccttctcaagttgggaacacaatcctgtacatacgtgcttaccagtgccacaccatagatttacaagtcagcatgggtaacccaatcagagactataaaatacccctcaataaatactttgttgcacagcttcaataagtgtgcttatctgacagcctaatatctctttcagggactaactttacagctgaagtcacaatcttctaggggtggccaccaatcaatgattaggcaatgcagttttagtcaagaacatacacttctcagaaaggccaccagccaatgactgagcaagtcgagggtaaaatggcttagaaagtcccataaaagggacccctcctccaagcaatctttgcttcagagctccaaattggactagcaaagactttgtgagatctccccaaaagacaagagggagaaattgggtatgtgcaattgttaagtacttacatgacatgcgaaataatatattatttgaaggtagattgtgattaagtagagattacattgtaaactttagggcaaccacaaaaaattcactaaaagagatatacataattaggcaacaatgaagataaaatggaataatagaaaaatgagtgcctattcacaatagcaaagacatggaatcaacccaaatgcccatcaatgatagactatataaataaaatgtggtacatgtacaccatggaatactattcagccataaaaaggaatgagataatgtcctttgcagtgacatgaatagagctgcaagccattatcctcagcaaactaatgcaggaacaggaaaccaaacatcacatgttgtcactcatacgtgggagctaaacagtgaaaacacagggaggggaacaacatacaatggggcctgtcggtggtgcaagggaaagagagcaacaggaaaaatagctaatgcatgctgagtttaatacccagaaagctgggtggcagcctgagggccatcaactcatgcatttaatcagaacaaagaggtacgcatcaagcctggaacaaagaaatatattgtctcacaagacaataagcccagcacaggctgtgagggctctttatctcccaagaagaaaatgttccaggtacaaggcccatcttatgcagctgagcaggttggtcaacagacaggacatgactgcctttaccaacaatattaaaaggagaatgtatcattattgagatttgtctcagaaattcaatattcacaaatcaatctctgtaattaactgtatcaacagactaaaggaaaatgcatttgatcatattcaaatgattaaaaaatttttatgataaaaagtctagacaagtcgaattaaaaaagaaataattcaacttgatataggacatgaaaaaaaaaagaaaacctctacagttaacatcatacttaatgatggactggataaaaagctgggatgtcaattctgaccaatcctaccaacatctctgtgaaagtccagaccaatgtaataaagcaagaacaagatattaaagacatactgacaggaaaagaaaaaaatgaaaccatctctatctgcagatgacattgattgtatttgtcccttttcacactgttataaaaaaatacccaagactgagtaatttagacaggaaagaggtttaattgattaatagttccacgtggctgaggaggactcagaaaacttacaatcatggcagaaggggaagcaaacatgtccgtcttcacaaggtggcaggaaagaaaagtgcagtgcgaagggggaagagccccttataaaacaatcagatcttgtgaaaactcagtcagtatcatgagaacagcatgcacctgcaggcccaataccacctggaaaccaccaaggcttggggcttgcactttctgaagcaatggcctgagcagtacattggccccttttagccatggctgggatgcagggcaccaagttttgagattgcacaaagcagcaaggccctgggcctggcacacaaaaccatttttttttccttaggcctcaagccagccaggagtcctgaattcctagccttcccacccctaggaaccccctacccctggtaggggcgaaagcatctgatgtcaaaaagactcaagggcatcatggaccttccatatgggtacaggactgcaggacgtccatcagcctcgaaaagacctctccactgcctttcagttgctagcttctcagactcataggcccaggcgaattacaatggggctgccgctggcctgggaagagcaaaaactgtggggccttgcacgtagcaggaaaagactggaaggagactcaagaccatgacaactcctttctgtgaggagccctgagagggtgaatcggtaatgatggagggtgccaagtgagaagaatgtaatgaagggatggttgtgaaatttgaggagagaggcggtgaggtcagggaagagatgtggggtcctcaggagggtgttgaatagggagagggcacagggtcaaggggtgtggtgcttggggtctgcagaggatgtggggtcaggaaagggtcttaggatttcaggtgtggggacacacagtgaggtcccaggagtggggcccattgaagtggaggctctgttctatctgcagtcttggtccacactccttaagattaaccagagaaacacgtagaggacaacaagatagtgaatatggacagagcagtgaagatgccagtggccacggaaaatactatttcttccatgctgtctccagggagtgcttgctgcagtgtttgatggaaggtacagcagtaggagtggtgtcagcttcgacctgcccgagcagagggacagtacttgaaggaaatgctagggccagaagccatgtaaaagcttccaaatgcacgtgtgtcagggccagcagtggcaggaggagccagcaacccagaccctatgactccttctgcggggatcagtcagatggccttggcattggtcagacaggaagtgaggtgggttaggactgagaactaccaggagtcagcagggcaccaccagcttggatcctgagtctggaagaagacctatacctgaagcagtgcccctcctccctcggatttgccccaggtcatccctaggaggccatcccattcttctcctgccatctcaggaaagtacatcacagtggagggcataagccagaccagcacccccaaccaaccatcatcccatgcgtgactttacacacagatactttcctacacacaaagaccaattcaaagctgcttgtcaccatctcttaagtgaatctttaagaagcctaatgtggcagggcttcaggtcagggccacttgatcaaacccagcaccttctgaatgaccaccagggcacaccgagaatctgcctggaggaagcccaagccctgccctgactgctttttctctacttcacctttctctcctcttccaggaaataaatttgcttatgctgagggtcagttgtcaccagtctgacttatttcttccactctgtcctacaacagtgcttctggactccaggcaatgctcctccaaccgcatcacctgggggctagttaggaaccagcatctcaggccccactcagccctaagcagtgagaacctacatatcaacaagattcacaggagactcctgtgcatgtccccatgtgctaatccagacgtggtgtttcttctttgtgcctctgcctcagggagtctgtgactcactgaattcagggtcctctgttcattagtcaggtggaatcaggcaggatgtcctgactggatccttttcagaatcttccgccaacaaaatcataccacatagcaagagctgctttccactttctgaagtggatgcacttttttgcaatttaacattcccagcaacaatgtatgagggctctaatttctctaccaccttgtcaacacattattgtcatttttattgcagccattgtagttagtatgaaatagtatctcatttaggttttgactcgcatttccctagtgactaacgaagttgagcatcctttcatgttcttttggccatttgtagatattctttagggaaatttctgttcatattctttgctcatttttaatggtttgtcattatatggtggtattgtaaatgttccttatgtattctggatacaactttcttatctgatacatagcttgcaactgttttctctcaatctgtgggttgtctctctgtctagaggtgccttttagagcacaaaaaggttttttgttttttttttgtttttagtttgaggaaatctagtttatcaatttgtgtttttgtgggggaaaactatgctataaattggagggaaaaatgcaacctagccacagtatgagctcaaggaagacattttttgaaagttgaaattgtcacattatttttaggtgtcaacgatccagtaaagagcaaggattagctaataaaagagaaaaaatgagacaatttcaagagaaaaatgcttgagaaagagtccattctaggctcttagatagtgctggaatgctttgtcttttgtcagaaaagaaatgacagagaatgcaggcatattggtggcatcagaggcgagataaagagtgaactgccatcaaatagctttcgtttgccttatcagaaaggtggaaaattggccgggtgtggtggctcatgcctgtaatctcaacatttggaaatccaaggtgggcagatcacctgaggtcaggagttcgagaccagcctggttaacatggtgaaaccccatccctactaaaatacaaaaggtagccgggtgtgatgacaggtgcctgtaatcccacctactcgggaggctgaggcaggagaatcacttgaacctgggaggcagaggttccaatgagccaagatcatgccattgcactccagcctgggcaacaagggtgacactttgtcgaaataaaattaaaaaaaagaaaagaaaagaaagaaagagaaagaaaagaaataaagagaaaagaaagaaagaaaaaggaaaatcatcagatactgttgaaggctggagtgttttggagatttgagaagattcgaaatagattttttgcagagtgagaaagtgaattcactagaggaattgagcaagttgtctcaaatacttcaaaggacatcatcaaaaaattgaaaaggcaactcacagaatgggagaaaacatatgttaatcatagggataaggatctaatatccagaatattaagagaacagtcacattttaacaattaaaacacataaccccatttaaaatgagcaaaggatttgaatagacagttctccaaagaagatacataaatgcccaataagcacatgaaaaggtgctcaacatcgttagtcatcagggaaacacaaatcaaaatcacaatgagataccactttacatacactagaatggcaaaaataaaaatgacagacaataatagtatctctaaggatatacagaaattagaatcctcatacactactgctagaaatgtaaaatgatgcacctgctatgaaaaacattttggaagatcctcagaaagttaagaatggagtgttaccttatgacccagccattccattcctagtcctacacccaaaataattgaaagcaaataatcaaacacttgtacatgaatgcacatagacgcattattcataataccaaaaagtggaaataacctaaatgtccatcaagagatgaatgtataagcaaaatgtatatacatacaatgaaatgtcattcatccttaaaaaaatgaagtgctgatacacgctatcacatgaatgaagtttaaaaataatatggtaagtgaaagaagacaaacacacacaaaaagctacatgttgtatgattacattattatgaagttcccagaataggaaaatctatggacaaaaagtagattaattcctgccaagagctagaagaagagggaacggaaagtgattgttaatgaggaggtgttttctcttggggataatgaaaatgttctggaatttgctatggcacaacttattaatagttaaaaatagtgaaatgatggaatcatacttttgaagtggtaaatttatggtacatgtatttttttaaaaaagaaagcaaactgacaacacatagaattgtggtgaagaataggaaagagcatcagtagagagcctctctggggtgcagcctactgagctcataaaagctgaagagggggcaggaactctgatataacactctcacatgatagacctcactctgcacacaggtagagacagatcaccattgggagactttgaaggtgatagcaaaaacaaagcctaaacccggctaaactactgaagaaattgaccacacacttccctcacacacaaacttacaacctagctgaataagatacattccaatttacatgcattaatattatttacctcagcctctactgttcttctacacatgaggactggcattcaataaaaattataaaatacaaaaaaattaataactagtaactcattttcatgaagaaaagcaataaacagacctggactcagaaatgacctaactgctgactacattacaaagatacttgaaaagaattgtgattaatatgtgtatcagtccgtttgcacactgccaacaaagacatactcgagagtgggaagattacaaagaggtttaatggacttacagttccacatgactggggaagcctcacaatcatggtggaaggcaaggaggagcaagtcacatcttacatggatggcagcaagcaaaaagagagagagcttgtgcagggaaactccccttcatagaaccatcagatctcatgagacttattcactatcacgagaacagcaggggaaacacctgcccttatgatttgattacctcccaccgggtccctcccacaacacgtgggaattcaagatgagatttgggtggggacacagccaaaccatatcgacatgttaaagaatatagtggaaaaactgaacaatatgcatgaagagaagtatcaagaaaatcatgaatcactgcacacacttgttaaaataattaattgggaggccataagactgaagcagctctagcaccctgagttcctatgtaaacaaactgaaactttactcaatacaaatggaaaaatgaaacaaactttaccaaagttggccagctaacctctaacaggggctttgccaatcagaaaccaccaaacaaccactaactaggggctttaagactactgctccactttttttttttttgagacagggtctcactctggtgcccaagctgttgtgcagtgttgtgataacggctcactgcaacctatgcctctcaggttcatgtgattctcatgccttagccacctgaatagccaggattacaggtgtgtgtcaccacacccaggtgatttttgtatttttagtagagatgaggttttgccaggttggccaggctggtctcgaactcctgacctcaagtgatctgtccacttcaaccttgtaatgtgctaggattacaggcatgagccactgctcctggccctacagctccacctaaaccaaaaaaaaaatattttctttgccttgcttctgcatgcacatcataaaagttctgccctcatgcccttttggtgaagccctggaccacttgtggttttatgctgcccaattcatgaattgctgtttgctgaaataaactctttacaattttaatttttctaagtttatcttgtaacacaactattttcagtttactgtacatattgaaacaaataactgatctctgagcgatgagagatagaaaataaagtgagccctaaaatttccttagcttactgcctggagggcagagtacacagcaggaaagccttgatgttttttgagttgaggaggtagaatttagaggacagggagactaaaatttgcagaacaaaataatgaagaggagaaagcggtacagagagaaatctccagagcttacatgggtttgaggatagttcttgtttcctctattcagagtgaaaaactttataaagcatgggacatcagctaaaaaccttaagagcgttttgtccaggttatgaggcattataagctatagactaaaaactgctctgatctcacctaaaaagagcaagacttgaaaaaaatgccactattttcaagaaacttacccatgctgaagaataaatcccaataatattttatagaaatacaaaactatctagcactcaacaaagtaaaattcaaaatgtcttccatccaatcacaatgaccaattttgtaaaaaagcagaaattaggatcaataatgaggataaaacacacacatgacactgataatagagattgtaggcaaagacatttaaaaatttatgaatgtatatgagaaccacaaagcagaggggaaaatgagggataaaaaaatacttgaggaaataatgaaaagttttcaggtttgataaaaactataaaccccaaaatctaataaactaaaaaaaaaatcacaaaacaataaacatgtataaaggtataccaaggcatttgataatcatattgtttaaaatcactgagattttaagaagaaatcacaagaaacttttaaaagtaaacagagatacaaattatgtacattacctacaaaggaacaaagataacgatgacagcagatttcttttgaaagataatgaaagccagaggagagtactatatttaaatattgaaggaaacaaatactaaagacgtaaacttctatattgatgaaaatatattccaagaataaagatgaaacacttttgtttcgggaatgcaaaattagaatgaatttatcaccaacatatgtgcactagaagaaatgttaaagtaagtcctccaggcagatggaaagtgatgccagagaaaaatccggatctacacaaaggaatcaagagccctagaaggtgcaactgcatgcataagtataaaacatattttccttattatgtaatgtcttcatagcaaagtaactgtttaaaataacagtacttaaaggtattaagttaaaaatagcaatgtatgatgtggcttacaacatatgtaaatgcaaaatgtatgcttagaatagaccataggatgagaagggggaaatggaagtataccgttggtttttatgtatctgactattctaagtgccaatgggtagagctgaatagagatgactgttttcctcattgcacatgaggtatactaataaggtgagcctgcacataacaagacatttttaaaaaacactcatcgtttattatgtgaacagagagagtgctgtgaactccagacaattactctgtaatattccttaaatgagaaactcttatagaaagaactttaccttgttttcttaaaggaaattaagagacatatctctaataaattttggttgagatgaagccatctgaacatcagtcaaggggattgtgcaccatgtgcggaagcagaggcaacaggtaaaagtaaaatgagtcaagatccttgctcttgttgagcatgcttgtacatggtctaagaacactctcaaaagaaggaaacacagtgaacatgcccatagtgctgtttggtgatgataggcagtagcaggggcctctttcccggaggagaggctgaagcagggctaggaatgaggttagagacagagattggggccaacactaaggaagatccttgcaaaattctcagagggatagtggattggagggagggagggtaaacagtcccattttgagaatagagaatagataaatatgtagaagaacagtgtgtgcctacgtgtgtttaggtcaggggtaggacaatgaagaactgggtaaacaagaggtgacatggtgaggtatgctgatgataaaaagattgggggctatcagttgttggcagggctggagagccaggaagcaaaattgggattcagtgcattgggcagaatggcatccacatagatatgtgcctgtgcaggggcatgatgaagcccacctttgaggaaggtcttctagcacagggctttcccagcagtgcaggggcatccccagtgttctgtagcaggtaaggcatcagggcccactgcctaaaggagggagaaaggatgctgggcgaacaggactctgggactagagtgctcacttcagccagactgctctgccttctaatgttcataaattggagttctatggaaggcttcagttaaaataagggattctatgtctaaaatttggcaaccatggtctactagtgagatatgggatgcattgtggtgtcctggcatcctctacttgtgcctaatattgctttcagccctttgcttcactgactttagttactgcaaagttgccagctgcctagaacacactagattagaagaggtttaacaaggaagtgtgtaccatctccatgggttttccatctaccctccaaatatctgcactttaaaccaatcctctattccagacattatctgctgacatatagacccacttttatagtcacaggacacaggttctctgttgtgacaaggacgcagaaaccatgggaggcattctgagctgggaacatcatctggatcatttttcatagccctttatctatagttactgaattagttggtcctgggcattcccactccagcttacccctccttgcagatgcacattcccttaccttgctcattggtattcctagcctgtatcaatggtcagccatcagtcaccagctccacttgcatagcacccacctctatgaaaggggtccagtgtacacaggaaaaaaattgtcagcctccactgggggtcaagacagctccctgccctggtgagagtgcacaggattactacagtgatcaagagaatgactcaggcagccagctatacccttcctgacaggagatggggaaattttaatgtaggctaattgtatatgtatatgtatgtgtatgtgtatatgtatatgtatatgtatatgtatatgtatatgtatatgtatatgtatgtgtatatgtatatgtacatacatatatcactccatgattcctgacattcttatagatcttgttatttcctaagtgagtaaaacaatacgaatatctttcattaaaatatttgtcctgttgtctttggttcccgaagcagcttcagaacagcttcggaatagtaaaggtggaagacagtcttctgttgtaatgttggagtgctttaggcctcagaaggagacctcggaaaacacaatctcgctttctaactttcttttgcccccctttcaccttcttctttttctccctaagacaagccatagaaactaaaaacagtcatctctcctcacctgtcttagagctggtcataaagaaattctctgacctaccttgtctgattgtaggtcttaaactcccatttcagaagaggtcctgacccat

SEQ ID NO: 1431 - DNA, 5191 bp, Homo sapiens
ttaatgaccttctccttttatttctctgtttcacaacaccagttcagctttattgttaagttcttacattctccaagaaaatacctattgcaaatcacagcaagatggaagatttcccaaaatgttttacaaaatggcaaacacttgcacttgaaatggataagcaaaacaacatgtgtggtcagtatcatccatacacttagatgttgaagctaactaaaacttttattacaggaacaatatttgaaaattaccaaaaggaaacaaaaagaaatctccaagtcacccgatggaagagaaacctaaaggcagtatacaatgtgttcccttccattcactgtgccttctactactgagaacactgacttctctcatcaaacacagagggaagaatgggcctgatttcacacaggacagggaaactgctgggtgtggccctgaagcatgcattggcccatttccctgcccgctggccctggttgcatctcatgctcagactccctctccctcctctctcaaagcatcttcatacagggatgggtaagaagtgggatccctcccattggcattggctatgtactcaagaactttcatcttgctggtctcagcgtgggcccttggaccccacaggaactcatagcatgcaggatcagtgccgggcacctgccggtacaccaggtacttttcctgcacccaattttgggtgaggagcctcttgggctccccaaagaggaagtgctcccttccagcatacacccccataatgctcaggacttcccacataacctcttcagggatgcagttcccctccatgaagattacacccaggactattatcaggaggccagacttgggcatgctctgctcattacactgtatgccatcataagagaggttgagggaggtgacaaggacataggagtggctagtggggtccacttccttcacatcaatgccaaagagcagttgcatgcatacagaggcttccctaaatatctcaggaaagtagtcctcataatttttgatgacactccccagcatttctgcctttgtgatcagccccttgactcgatacttgcggagcaataaatgaaccaaatcaattatcttgtcatgtagtatatcttgggaaaaggactcagggtctatcaggtcaggcgaggtacttggcccctccttttcttggctgccagagccctcatcagataggctcccaaagatggcatccatggcagtgggagagaaggactcttcctgaggactctggggaggacttggtgactcagcagcaggcaactcctctagagtgcccacattcagagtagaggagaagaaggcagcctcctgctcctcagcttggagagcctgtgcacccaccaggcccaggtcttcttcttgggcctgaaggccttcctcaggcttgcagtgctgacttctttgctcaagaggcatgatgactctggttaggtcagcaggccgaactgtgggaaatatctgggtgatggggccccacagcctggggagagagggagcgtgagaacagactcagatgagatatgaaccatggagaatctaacaaaagcctacttacacttgttctcctccagtgatcctctgggttctcctgggactcctgtcctccaggttggcctgttctctaaaaacctgaaaaaggaagtgagaaggctgctcaagatgcagctggacatcagagcaggaggctccaggactgaggtagggcaggtgaggttgcaagctgggggtccctttctgtactggggcaggtggggccatttgtagattaagggtgaacatctcatcttgactactggcactgcctaggcttcctgtgttctgagatctgaagacattgcttgagaccaaggcctcactgctcagtttttggagcttctagaagaggaatcatggggccatcaggctgcagactgcaagcacccatcctggcaccccagcactgtcagaaaggtgggccaaactctgtgagtttctcacttttttggagtggatggtcccctctgtgctcagggccctcacctttctcctgccagggcctggaagacacagctctcctgacctgagaaactctcagatcaatagctctttcctgatatgaaagaggacatgtggggatacacatctggccacatgtacacagggctacccaggaaggacagcaagagatggtgacagtcagcagggtccatgtgtcctcgggtaaggagcctgtttggttcccatcttgatgcctatcttggcctgggaccctccctctgttgacctgacgccatctccttaaaccaaagctctacctccaggagacatcagaagaggaaatcagggaaatagaaacacccatggtcccagggacttcccatagctgacagaaggggcagggaagggctgagtcccatgtttttggtaagtgctgtcccgtcagcccccaccttgattctggtcatggcctgggaccctcccactgctgacctaagtgcagccctctcagaccaatgtctcccgctccctgagaccaatgatcccagtataagagaggggtctcagcacatagtcctgcacatgctctctggggagacagcaggggcagagcagatttctaagcagccctctgtgttctggccaggaggaaccctcaatcctccctcaggtttctcacctggactcttggcagatcctgggaccactgtagttgtggaccatatggggctctttctgttgactggaagtcgtcctctgagaacatagtgctcacctgcccaagattccaaaacagaagtaaggggccccacgtcccatcaccccatcatgtggttgtccagggctgacagcagaggctggacccttcggttctggggattccaaagtcctcctgtgggtttttcatctttacttctgccagggcctgtccttccttgactcccaacccctgagatgagcagacatatccctttacaccaagacctcatctccctgaaggtttcccaactttctgcctgtggtacaagtgaccttgccacttggggccacccgtgatgaggtccccatacagccaaggacaggggacagagagactctgtgggatcccttcattatgggatgtgggtatctccagtcctcaccaaggggacacatacaccttgagtcctaaagatcctgggactcctccctctgctgatcaggtgtggctccacctgctgacctgtcatcacccccttgaaacaaggtgctcacctccctgagcaaggtgccacccccaacctcgtggcagaaatgtgagcatggcacatgcctccccaacttgggcctccgagggatgaaaacagaggaagcaaggattggtgaggtccctttttctttggcatgtgggagggtacattcttaccttcagtcttcatcaattttcctctccttgactactggcagatcctggactccaccctgtgctgaccaggtgtgtatccctctgctgacctgaggacctgcctcagaccaagggccccacctctctgagatatgggaggcagaaagtgaaggggcactacatggacacccctcatgggatgccaaaggctgacagatgaagcagatttcaggggtgcctcctctctctgggtttcctccaggtattcagatttactcctgacaaggcctatccatgtctctcctgctgaactgtggatgagttttgcaggccacgaccaccatctcccagagaaccccaactaggaagtggggagctgcctctctttcctagagtcctgcttggggcctccaaggaccgatggcaggggcaggttttctacctcagggataattggttgcctgagtcctccctctgggactcctccctgggttgacctgaggctccactcctcagaccacaacccactccttgctgacaccccaaaggcagagtgaggatgcaccacatgtggccactgtgccttggaactccaagggccaaggtccctactgacctggagtccaaagtctcctgagtcctccctcttcttcttcctcttgatgctggcagggctgcaccccagaccccctctgcggaactgagtctccatccctcagattcccaaggctgaatgaaaaggcacctcagtttgagacggcgggactatgggggggggctgttctggggtgctgggtcccttcagttgtccctcaggccttgctcacctcccagcagggactgagccctgtctgtgctccccctaggtctttctcatgataccaagccccttccctctgtcagcccaggatgcggaaatcaggatccacttgcctggcagcaatgccaggaacttcccaggactgacagcagagagggagccttgctctgtggggcctcagccctccctcggggtcctgaccttgatgcctggcagaacctgggtcctgccccccccaaccagccctgccctggtcacaccaagctctgaccccacagtcccctgaggcttaagcggcggggggcagaagccgaggggggtgtcagaggggacggcccagcctgagaagtccatccccatggggtgatccagggctggcagcagaggcggtgctggattatctggggtcctctatctgggtagggagcatcctcagtcctccctcagcatctcatcttgcctcctcacagagcctgggcccgctgccctcagcaggtcacaagccgcccttcagaaccgggctatcacttctctctgaccccctaatgtgcaactccgcagtaccaagcccggaggtcctttgcgttgtctgcagggacaaggatggactttgtggcccctctatcaggatggggtggaacctctccataatttctcagagtcctgatgttgatgcctggaaaggccggggccccaccctttatggaactgcctctgcccgggtcacaccatagactcgcagagtctccttgggcattgaggagggggattgtctcagcctgataatttggtcccctgttgtttcagggctggctccagggttggcgctggattatttggggccctctatctgggtaggaggactcctcagtcctccctcagctctcaccttgcctcctcatggagcctggacccgctgccctctgccactctcaagacacccctcagaaagacgctttcgcttctctcagatc

SEQ ID NO: 1432 - DNA, 5546 bp, Homo sapiens
gctttgccggatgtgctttcccggcggccatcttgggagtctgaaggacctgaggcattttgtgacgaggatcgtctcaggtcagcggagggaggagacttatagacctatccagtcttcaaggtgagggccccgagggagaagtgagggacaaccccaccacagagagaagcagccctggcctgccctatccctgcggtggcacttgtaggtggcggaaacgaagatggtagccgagggctgagggacgtgtcctcacggcagaagaagggaggaaatgccggccctctagagaataaataggaaggcattgaggaggaccgggggaacccccacctcagaggacagattcccagagattcccaccctgctcctcaaatcagcccccatagagctccccaggtggctgaggctgagcggccaccctctcactgctgggtgaggggtgtaggggagggggaggaggaggccttgttctgggggtcccatggcaagtcagcatggggagctgcctccagttggcagagggaagattcccaggccctgctgggaacaagagtgaggactgaggggtcacatgtgcgtcagaacagacgtgaggccacagggaccgcccccgtggtagagtgctgggaggtggctgccacctcactacctcccactgctctcagtgatgtggagttttcctgaggtttttcctcaggccagcagagtggtgggggcctggccctgtctgagaaaatgtgacaatgctaattgaattctgagggggtcacgaacctcagaattgtgggactctgggagtctggccagccccagctgccgtcttagctggaggggctccctcccttcctcttgcaggtgctccagaaagcaggagttgaagacctgggtgtgagggacacatacatcctaaaagcaccacagcagaggaggcccaggcagtgccaggagtcaaggtgagtgcacgacctgactgtgtaccaagggccctacccccagaaacagggcagacctggcagcacccggcctgtagccacccactgtcattcctggtgcctcaggctctgcctgccagctgtgccccgaggtgctttctcgcgtccttctacaggttcccagaagacaaaccccctaggaagacaggcgacctgtgaggccctagagcaccaccttaagagaagaagagctgtaagccggcctttgtcagagccatcatgggtgagtttctcagctgaggccactggcactgtccctctctccctcagtcctgtgggatcccatcatacctattcgtgttcacacgtttacctgctgctcctgaacaatattcatcatgcctctctttctaaaccttccacgccccagctttgagcaaggcttccagaaggcaattttcatactggagttggtagatgcagaggatcccccagatgaggaagaggaggaagcttcctccattttctcttcctctttccactttttattcccctcgtcctcctcctgtttttctttctcatcctcatcctcctctctgcttctgcgttctccaggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtactcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaactcagagtacttttgagggttttgcccagtctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattgagtcttttccagagttcccctgagagaactcacagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactcatttatttgatgaa

SEQ ID NO: 1433 - DNA, 59517 bp, Homo sapiens
atgctgctgccctgccactgggtgttggatgccaccttcagtgatggcagtctaggccagtgggtgaaaaacacatgtgccacatatgccttatccccagtggtgctcccacctcagccccaggtgtggtagcccatgaatgctcatgtctaagccccaggttaacagccagctcttcttttgcatctcagcctcagtgttgcttggctccaagacagtgtgcagtctgttgggggtgaggctctaagatgctatcttgcccagccttgatgttcatgtctttcccttggttgcagtagcctgtggtcgctcatgtctgaatctccagggaaacatcagacatttagtttgcacctaggcctcaatgccactgggctccaggacagtatgtagttcatcgggggtgaggctctgcagtggtgcctcatttgtgcctcagtcctaaaagcagcagcccacgccttcgtcccacctctgcaccagatgctgtagtctgtagtcactgatgcctatgtccctggggcagcagttcgtgcttctcttgcacctcagccctgggctactgggctccaggacagtgctcagtctgttgagggcagggctctaaaatggtactttgttgtagctgcttaagtctcaagaagtgtgagggacccagcgggagctttctccctgaagcagtgccatcatacaatctcctggcagctttctatgttagtttcggggcccatgatggttgaagggatctcctgtggctgggattataggagtctatagtgagaatgtaaactactgaggctctctcacctatcctttctctgtatttggagtctctcagctcacagctgatcctggatgagcaggctgccttgattccctctccatctctgctttaagtattgcctatcacttttctaatggattccagtgatttcctttgaattatatattcaaagtgtgattatcgactcaccgtttggttatttttaatggagaaagtgagtacaaaatgcctctagtctgccatattcatggtttccaagaaataatttttaaaggtttttaaatattttatgtaattataatgattatgggcataagaaggattatggagaagaacggagcaaaataaaagcttcattcactctgctgtcatatttgattatatcttgaggtcaaattgatctttgctattgtcttggctgccggctctggctacagctaatcctgggcaggctttgcagctcctaccacttccaggcccacagctgcaatcccaagcttgctcaccaaaacaagtgtttattcattatatcttcagtagattttattttataaatatgaattgtttatatgcatttctaatatgtcaaatgctttactagctttttaatatctttatatccattttccctggatcattacttactgttcttaactcagtggttcttaactggaagagattttgccacttaggggatacttgccaatatctagaaatattgttggttgtcataattggtggcagcagggaatgctactggtatttaataagcagagacagagatgcttctaagcgtcttattggacaaaggacgacctcacacaagaaagaattatactgcctaaaatgtgatggtgctgacagtgagaaaccctgagtttaacataatttgctcagaactctaaaaatgattcactttccaaaaatttgctgcattttttcttctggtcagaatgtgcacaatggaaattcttcctgaaggatttgtgtgaggagacctattctatagctgttaaatgattggcagggaggttgatagatggaggtgaagtcagccaaaacttaactgatatttaacagccaggaaatacccaacctggaaagtattcattcatagcatcacaaaccactaaagaaaagtgatattttacctctgagaaagttaacagcaaaagtatagtctttctaattagtttttagcttgcaatctaaataaatgacaagtagagaatatcaggtcataaaatatcatttaattttaagaaatattttcataagaatattgacataaaagtgatttaagaaagtgaaagttacatttagcacaagattttgcatttttcaaaagtatatgatattggaaaaacatataattacatattattttgaatttgttctatgtagcaaactttgttcagacctctttaagaacatttcataaatttggcatcattactaacatctccatgttaagaagattttcacagaagcaatattttcttgtgtctctaaatgggagagagtgcctctcctcactaaattgccatattaaagtggactgttcagcatttattttcttcaaccattctgtctaaaattcagcctgatgtattagcattagcatgagtcctcctgcaaaattggtcagtgggtagttatgcttttgtgtgtttttcacatcaaaaaaaaaaaccccacaagaacaaaaacaaaacaaacacaaaaatgctcagtaaatagttaatgaataaattgttctattcaaggggattgagaatggaccttgctccactgcttctttttttttctgtattttcaacatctgcctttctactggctaattaactatagtttataaatatgtttaatattaaataaaaatttaagtaagaggaagcatcaggaaccactttaaaggtgaattgtaaaaaataatgtgataataacttcactctgcttttccttctcacttcttttcttctttcttcttttctttccacttaagcctcacaagagtgaagcttcttgtctgtctcttcttacttaccagtcactctttcttcaacctggtgctctctgactcctgtctctaccactcaaataaagctgtactttgcaagaccatcaaagccattttaattatcaaatccaaagactccttttggatatttcaggtctccaaacaaattgcatcttcttaaagaggaatttcctgaccacctgagttaaatctcatgacattcgcaaacatattgccgtattttacattcttgatagtccctagtacttgatcaaaaagctatctatagttattatacatattacctgggtgatgaaataatctgtacaccaaacccccatgacacagagtttacctatataacaaacctgcacatatatccttgaacctaaaagtcaaaaaataagaaatcaactgtagatatttgtttatgtgtttattttctttctgcccccactagcataaaatattattgagggaagggactcagccttgtccaccagatcctaaatgagacttagtagacacatattaagcattcaagtaatatctgtttactgactgggactgatcaatttgcctcttacctgacctctctggaacatttgtcaatgatgaccgtttgcttctagatgccccttcacggcttttgaaatagtacccttccttttcagtctattttgctaactttccaatatgatgtgatctgtttgagaaaagggactgctattagcatatttgctggcacatgaaggactcgcagaacactcataaaacatccttctatttgggcttcagtatgaaagatcttaaccgaactgtgtgtttaaaatgatgtgtattgaaagaagtattatttttgggccacgaaaatgcctaaatatttctagtgtgataattaggtattgagaaagttggaagtgtatgaatatttaaattgcttaatagtatgaactgtagtgttttggtacttggttcatacaattacttgactgaatgctgtgcagccattaaaattatattacaaattataatattaagataaacttaaattatttgttataaattaacaaggcacgacacaacattatgcataaaatataagtacaactttataagatgtatgcaacaatgaaaactagcaaggaatgaaacttgctcattttttgtttcaatgattttgttgcattgtttcaatgaaacaatgaaaattataacagactgtagtagcagctgagtgattttatggaatttcagatgtctgttcttacttttccagattctctgtagccttttaactatcgtatattttaaaaacaattcaaagctgaatacactttaagcatcctgtataacttggaatgaacttgtgatgaaatgtcagaagaggttagtggtaggtgttgtcacgtttgttcaagaaggagaggttagtggtagtggtggcatctttgttcaagaaagaaatacatccccttttattcatggcctttgtgattttctttgtgtttaatgtattccacaagtagattctcctctcaaggtatcgcaccctggaaatataaataaagacttaaattactcccatgaaagtgacttcttctagcccacacagtgaatcactggcagacccgggaatgaaacctctcaatttacactcttagacttcataaacatccctaaaacacttcatctctcctacattgttagctatataacattgttagctcctacattgttagttctacatttattagactataagtcttatgttttccctttgattgctattgctctaggtggcaacaaaagtcattctaacttcacttataagagccaggtttgtttgacacacacattgtggagttcattaaattattgcttcttctctgtcatttataattttgagaataaatctacgttcttgaaatttattgcacctgcatttgcagaggcatagagaaatgtggcaatttattcataaaacgctttatcatgtaaatgaatgatggccagtctctagttcacaagatgattagagtaacagaaaacacacaaattccagctttatacatacaacagcttcaaggctatgtagttagaaaaatatgattggagggttgatctgagtttaatgtatgaattcacagcctctgcaggctgtcccttactctacaggagtaaggccatcaacctgtgttatagaagctactaggccggagtacatctttttgtctctgcgcacaagaatgacttgctatcagctaatttagacaacccatatactcccttattagtggctagctacatatttttgtattgtttctgacttgaataagtttattgtgcatacattgtccaattatagcaaccttgagctggagagaaagctcatcttctctaaagaatacgtgtgagggaaaaataaacttccttcaaactatatatcaccccatgaacagaatgctcctcaagcaggtatacaactccagaagaaatatcagacattctcttaagaaattgaatgactcaagagcaaaaactttgataccatttagatgattgccagcataatccctacccagataatcaaaggcaaatccctctgattagtaagccttgcccacataccaagcgtgcccccatagggtttttgatgttagtttgttttcattttaaatattcaaaagagtatatataagtgcaatgtaaacaagcagacagacaccttcagaagtcttaagaaatataatattaccattaaattaaaaagctttccatgtgctctcctcaagcgcatcccttatccagggattgccaccacgttgaactttgtagtacttattccctttctcttctctttggagtgtatgatgttaatatccctcaacaatatattttgcagttgtccctgattttgaagcttatacgtatcatgtcatactgtgtaagttattctgacacttttccgtccgatatcatgtttttgaaattcaatcctgtggatatgtgcaattatagttcacttagttttactgatgtacagcattccattttatgaatacactaaaatctatgtattaatattcttccagtgggcacttacattgcttggtggcaaattttcaaactttctattgtctgaatatgtcattgtttcaccctcacatttgaaaaatatttaaatttggcgtatgagtttagcttggtgggcctaatcccttctcattcccttgctgaaaagtcagctctcagtgtagttgcaatatgtgaattatcttttccctctgaattcttttaatatcttctgtgtgcctttggtattctgctgtttcactgttatgtgtttaggtgtgcatttgttttcatttatttcacttaaaatttgttggtctttctgtatttgaagtttaatgtcttcaaaaattgtggaaaaacatcaattatctctttgactatttccttgactcctattttctagagtctattgagattttagttacatatatgtgagaccttctcactcaatacaccacatcttttaatttattttttataatttaatctctgtttttattaggcagtattccagataatttcttcagattattttcctttccaatttaaaatatctgtatagtatttgcattaacgagaaatttttatttagaagtaataaaaaccaatgccaacattaccaaacatatgattcagccttctaggaaagttttggaaataccctctagtgtaattgaacattttttttctcattagctcacaagacattttatttctcaaaagtaattggtaatttttttttaagcgctaacgttttcagccattctaggatatagtatatgtttactgatacaatattttcttcattgatatttcctttgctagttcttctgcatcagcattttgagtaatataaaaaggtagtctgaggcactttttcgtacttggtttaatttaggtatgaataatgtaaagtgatgatttgtaggaaatctcaaaaataatttcccaagttttgcagttagtgccaaggacattttgcaaatgtacttataatttcatttagatacaaataaagaactaaattaaaagagaggtaaaatgcttattttctttggagtgcaaaacttgcatacagatattgattgcgtacaactctgtttatagtgataaatgagaatagtctttatgatggtagaaaaaaatttccacacataacagcaaaacttttcataaggctttggtaagaaatatatgataaattatctttaaagtcttatatgccaatattaagctttaagttttgccgaataaaagtcgtaaatatcatcatttcagctccagtcgtatttttaacaaagggatttatatggtgacaaaacagaagttatgcttgaggtgtaaatgtattaagtgaatatatctctactgacattcaacttctatgagctagctaacctttaaatgctaacaaatttgccagtagacacctgactcccatttatttaatgttttattatagttgttatgttgtatgttgtattattttagagaaactaatagaattagttactatttaagagttacttattttgttgtggttgtattaattaagctcttataggggagaaaaagctctgtaaagtagaatagtttcgttgaaaaaggatttatgggcaactgtttatgaccaaatcctggcacttgcattcattagctgtatgactaggaatcttttctgcacttaagtgccctcatttgtaaagtggatattataatacatatgaatacatatgtgatagaggtatagtgaaagtaagttaaataataaattttaagcatctaaaacagggtctaacatcatatattgaaaatgtattatgttttagttgtgataccagatgctaagatacggagaggacagacagctcctagcacataataggtaagttcatttccaccaatttagtggttcttggtctttattccgtttcagattcagatctgcactgcttactcaacagccagttcccatgtgtttttaaattcttgttgcttcctcaccagtgtttttttttttttttaaataaatgtgttccagttactttccactccttttccaactgataggataatgtacttatgcattcagaaatctacagttgctttctattacaattgattacacctctaaacttgctggcctaagagggggagtgggtgatgagatttaacaacaggcgagttgctacaatatacaaatctctatgattggcagtttactgtgagtactgagactcccaccttttctaatagtcttgcctccttaagggatcctaacaggacaatgagatgaaaatatttaatagtacagacaaagacgctacctatgttttcagaaggcttgtaattctctcttaactcacaaactcattttaattatttattgtgccttctctttctcaagtccccccaagatggtaacaaaactaattatatctcatcatttacttttacagtatgttaattctactctggttcaacaatatctcaacaacacaatatcttcattacctagaagagtaagaatgtaactatgtgcatccaagtttttgcactgactttatatataatttgacagttgttgtcatttaatgagctccattgttaaattatgataaactactgttgttgctaactttagttcttctggaataggtcatattactctcattttatgggaagctgtagtttacttccactggacaaattcttgagtctcatttttctcattcataagataatgataatggtacctgtttcattgggcttatagaattaagtacaataaaataaaagcaattaccccagtgcattatttactatacactaaatagatggtaatttcacatgaatgagaatatctgaataaaatcccattcacctatattatgtattagatgaactttagaatcatagaatttagaaatagggcagtatgttgggaattctgtactctagtgatttccaactgtgttgtaggacacattgggtttctgaggctgttgcatgagaggagaacaagcacttgttaccctctttcacgttattcaaccaaaagagttgtagatttcattcacatcataatttcattaccttatagagcacttattgggcagatttacctcattcaattcatgatacaccacataatctgaaataaccaaccatcccaacatagcaccttctgaagatgttcataggtcattatggatggatttcttaatcactgccacagtccagtcatagttatagatatcaaatgcttcagagaagactgaatattccaaaagaaagtatgtgtaatattgataagtatgttctccaaaacaatgaagttcaattagaaatcaacaaagaaataaatttgtgaaatacacaaacaattgaaaaattaaactacacatttcaaataacccataggctaacaaataaatcgtacagataattagaagaatgtctttagctgaataaaaataaaaccaaatatcagaatttatggggtctggctaaagcagtgtttagagggaaatgtatagctatgatgcttatattagaaaagaagaaagatcttaagtaaattaatctcaacttctaccttcagaaatagaaaaagaagagcaaattaaatccaaagcatacagaaaaagtaaatataaagattaaagcagaaattaataaaagaaaaaacaaagtaaatacagaaaatccatgcagctaaatgttgattctttgaaaatgaaaacaaaattgacagccttgtacctagactgaacaagaaattaggagagtggatattgcatagtcaggattatccagagaaacaggaccatcaacagggtatgcatgtgtgtatgtgtatgtatacatatgtgtgtgtagtatgtatgtataaatatatatacacgcatctatatgtatacatatgtatacacatacatgtgtatctaaagaggcagctatatagagagatatttattttaatgaatggttcacttattattctcagaactggaataagacaaggatacccactctcacaactcctattcaacatattaccgaaagtcttagccagaacaatcagaaaggagaaaaaaaaatgaaagatgtagaaacagaaaaataagaagtcaacctatctatcttcactgacaatatgattctataaataggaaaccctgaagactccaccaaaaggcttctagaactaataaacgactttagtaaagtttcaggatacaaaatcaatgtacaaaaattagtagcatttctatacacaaataacatccaggctgagagtcaaacgaagaacacagtttcatttaaaatagccaaacgaaagtgaaatacctagaaatatatctaagcaagtaggtgaaagatctctacaaggagaactacaaagcatagagaaaagaaatcagtgacaacacaaataaatgaaaaaaaattacttgtttatggattgaaagaattaatattgttaagatggtcatactgcccaaagcgatttatagattcaatgttatccctatcaaactgccaacatcattctttacagaagtagaagaaactattctaaaattcatatggaatccaaaaagagcctgaatagccaaagcaatactaaggaaaggacaaatacctgaggtgatgtataccccatttactttgatgtaattatcatgcattgcatgtctgtatcgaaatatctcatgtaccccataaatggatacacctaatatgtactcacaaaaattaaaataaatacatttatagaaagaacaaagtcagaggcctcacattacccagttacaaactatactataaggctacaataaccaaaaaaacatggtagtggtataaaaacagacacacagaccaatgtgtctcttacagaaaagaaaactcagaaataaagtcacacacctccaatcatctgatatttgacgaggccaacgaaaacaagcagtggggaaaggaccccttgttcaataaatagtgctgggatacctggctagccatatgcggaagaatgaaactgaaccactaccattcattaaatatatagaaattaactcaagatgaattaaaaatttaaatggaagacctcagactataaatatcctaaaagaaaacctaggaaacactttttttgacattgactttggcaaataatttatggctaagtccccaaaagcaacagcaataaaatcaaaaattgacaagtgggacctaattaaattaaagagccaaacagagtaaacagcctacagaatgggacaacatatttgtaaactatgcatctaacaaaggtctaatatccagaatctataaggaacttaataaggaaaaatcaaccctattaaaattagtaaaggacataagcagacacttctccaaaggagacatgaaagtagccaacaaacacgaaaaattgctcagcatcacaaatcatcagagaaatacaaatcaaaaccacaatgagataccacctcacaccagtcagaatggctactattaaaaggtcaaaaaataacacacgctggcaatgctgcagagaaaaaggaatgcctatacaccgttgttgggaatgaaaatttcttcagccacggtggaaaggagttggagatttatcaaagaacttaaaacagagcaatcccattacttgatatatactcaaaggaatagaaattattctaccaaaaagacacatgcactcatatgttcatcacagtgctattcacaatagcaaagacatgcaatcaacctaggtgcccatcaaaggttgactggattttttaaaatgtggtacatgtacatcatggaatactatgcagctataaaaatgataatatcatatcctttatggcaacatgaatggagctggaagccattatgctaagcgagttaatgtagaaacataaaactaaataccacatgttctcacttttaagtgggcgataaacactgtgcgcacatagacataaacatgtgaacaatagaaacagcaggctactagagcagggagggaggaagggaggcatgggtaggaaaaccacctattgggtactatgctcgctacttgggtgataggatctatactccaacctcagcactgtgcaatataccacgtaataagtctgcacctgtaccccttatatgtagaataaaagctgaaatttttaaaaaaaggttcacttgaatgtggaggtgtacgttcaaaatctgccagataggcaaataagctggagatgcaggaaagtgttatagtccaagttcaaagacaatcagctggcaaaattccttcttactcagaggaagtcaatatttattctattaaggcccttccatggttcaacaatacccccacacattatggagggtaatctgtttcactcaaagttcactaatttaagtattaatctcttccaaaaatcaacttcacaaaaatatccagaataatgtttaaccaaacatctgggcagtatgccccagacaaattgacatataaaatcaaccatcacagacaaatcaccgaagccagtgctgaaaagaagacatcactatagactttaaagaagataaaaagattataagagaatactatgaaaattttatgcccaaaattagaacatttagatgaaactgattaattccctagaaagactcaaaattgttgaatcagactcaagaagaaatagaaaatctgaatataactatcacaaaagattgaatttctaatgaaaaagccacacacacacaaagaccaagctcagattacttcagtaataaattttaccaagcttttttaagaaaaattaatattaattcaccacaaactcatccaacaaatagaagtaggattagtgattacaaattgagacttgacatactaactaaaaaacagtttgttttggttccaatccatgtgattcttcagttttccttttatttctccatcacttccaatttaaccattgtccctgtgacagttggcctgttggatattgggggtagtctcagtctgtccagatcactgaagcatctttgtcaacatggtaggtaaattgatgatgaaaatgattgtctttagagcttgaattcttactatgtgctacactccttgtttggcacttttaatatattatattaaatattattattttaagtactattaattgcatcagattgtgagggctgtgtttctgttaatgccaagattgaaatacaagtttgtcttatgtgggttgtgcttaatattttaaaaaattaggctgatgttcttattaagattttatttgtatatcataaaattaattattaaaagtatacagttcagtggttttgggtatattcacaagattgttcaactgtcaccactatttcgagaacattttaataacctgaaaggaaattttacacctgttagcaaccactctgcattttttccttgtcccagactctgacaatcactaatctattttttaatccctatgaatttgcctattgtgaactatcttaggacccttcttggcaatgaattgaccacaaatgtgtgaatttatttctgaactcttctattccattgatctgtatgtctatacttgtgtcagtatcatacagttttaattactgtaacattgcagtaaatttcaaaatcagaaagtatgacaattccaactttgttcttttttattaagattgtcatgggtattctgggtcccctgcatttccatatgaaattatgatcagcttattcatttctgcaaaaattgacagtttgaattttggtagggcttgcattgtttctacagatcaatgtgagcagtattgccatcttaacaatattaagtcctccaatccgtgaacatagaatgcctttccacttgtttaggtcttttttttttttttcaaatcactattatagttttcattgtgtaagcattgtaattctttacttaaatttaatcctaagtatttattttactgttgctattgtaaatggaattatcttaatttcattttcaagttttttactagttcacagaaatacaactgagtttttgtatattgagcttgtattctgaaaccttgctgagctcatttattatatctaataatagtatttttgtgtgtatgtgcggatcctttaggattttctatatatcaaatcacgcagtctgcaatagagagagttttatttctttctttccaatttggatgccttttcctccttttgcttgcctaattgcactaggttatactttcagctctatgttgaatagaaatggtcgttgtcttgtttttgatattaggagaacagattacagtctttcatctttgagtatcatgttagctgcaggggttttttatgcactctttgtcaagttgagggtgtttctctctattcctagtttgttgagttgttttcttttttcagtcatgaaagggtgtgttagatttggtgaaatttctttccacgtctattaagatgattgttctttattctatttgtttggtgtattacatcaatttctttttgaatgttaagctaatcttgatttcctgggatatatccgatttggtcttgtcatattactatttttgtattgctagattttgttagcatttttgaggatttttgaatatatagtcacatgagatattggtttgtagttttcttttcttgtaatttttaaaatctggtttggtattatagaatgagacaggtagcacttcatctgtttctactttacaaactattttctaaaagattcatggtaattctgtttttaaatctttagtgaaattcaccagtgaagtcactggacctgggcttttccttgtgggatttctttatgactaaataaatctctttatttattacaggtctattcagatttctatgtgttatttgtaattcgaaaggcaacccttgtggtatgtggtatgctgactacatccgccttttaaaaagagggaaacaaaggttaaatttcttgcccaagcctttgaaggtaataagtggcaaagctaggttcctggtcaatcgtgctccaagatgcatgtcagtttttgaatcacacgcacttccacagagactgattaaaattatgtattccctttgatatagcctgggtgctttgaagtaaatgtctactggaaaaccaaactccggggagtattttggtgcagattgtggacatcttgttaaaagatttaatttgagccatttttgtttatctctcctccatctggaagtaatattttggtaatgtttttatttgcatcttatctaatgatttatttttactttatatggaatggacaaactgaattcctcctgctaaagaaaattatatttttctgctaaatttatttctctttctgagacacttgtttttataagacagatttctggactttcactatgaagaatcgagagattaggtggcacataagaaaagtgttacagaaaaaaagagaaaagtaattttaaaaaatcatgcagggtaaggttttgtgggtgttttaaggtgatggtttgagaggtaagagctgaggaaaggcaaagcgatgaggaaaagtggttatgattaattgaaccccctcttatgtttcctgataaacagaagttaatgattctttttttgccaatagactaagtgtatttagttacaaggctagtccatgtttgaaccatgagggtcccaacttatattaccatcacactcttatcccacaataaggatgtatgtgactttgcttttgtacatgtgccaaccttatataaaaggtgatagtggacttgaatctagtttgcatgggactagattgatttaatcactcattaagttggcagattattttgagccaattttgttctaagccctgcgatagattatgggtgaataagatagtcatgatctctgtctttatgtaatttatagcccaggaagggagattgatatttaatggttattatatacgatagatatttagtggttgcacacacacagatgattacaatttatggtatgtcctatgaagagaaagaaaaaggaattatgggagataaacattctagatgtaagttaagtggatgggagtggtcaagaaaactacctgtgaggtagtgatttcaagctaagacctgaaatctgagtaggagtaactaaggtgattgaaatggtttggccctgtttccctgcctaaatctcatcttgaattgtattctcataattcctacatgttgtgggagggacccagtaggagataattgaattgtgggggtggtacccccatactgttctcatggtaatgaataagtctcaggagatctgatggtttgatcaggggtttctgctttttcgtcttcctcgttctccctttgcctgctgccatccatgtaggatgggacttgctcctccttgccttcttccatgattgtgaggcttccccagccacgtggaactgtaagtccaattaaaccttatcttttgtaaattgtccagtcttgagtatgtctttatcagcagccagaaaacggattaatatggtgatgaatgttccagtcaaaagattctgcatgtggacaagtccaaaattgggaaagagttggtctcttttgagtaattaaagtcaccatgtaaaaatatacaactgaagaggtaggcaagggtgagatcacacagatagtgttaataactttaaaaatatgttatcttgtgctcacatgggagttagtcataggtacatttgggaactaatttcttcatctttccctaactggaattttcagacattcaagagcaaaatataagtatttcagaagaccaagtttaagaacatctagattttgagagtgctcactctcaggagcatatgtacacatttgctaagtggtaagacaggtaacacggaaaaattcacattgtgtagttggctgtccactaatccaacagtgtgcaactgacactagccggacaaggttataggtctttggctagaagatagttgttttttttttctggatcagcatgttatctactgctgtgctctatgcattttcctcattcaattagaaattatatctagaattatatctagaaaatcctattcaatcaatattttaaaactactaatcatttattcactaaaactaataatgtattaataactaatagtcattaccttgttaatttttcccaaaacattattcaataagttagaaatacttgtgaactgagactacactcaagaacatctagacattttcatgtatctttcacagctataatctatatatatgatataacatgtgtagaaagaataaatgaaaagcatattttattttggtgaaagtttgaaaaatcaatacctaactgaaagctagaaaaatgcacagttcccaatatatcctgcgactcagaatcttaagaaggttccatttttaaccacgtgcaggttcaaaatgtaagtagcaacattaaacttatgcttttcatttcacgaaccatgtataaaacaggtagctaaattgaaaatagttaattttaggttttattgtatcatctaacatccatgcatggggaaaataaggctttggagtattatctttctttctattctcttgtttattggattacatatttttcagtaagcatatttgaaatagaactacaggagaaattgaaagaaacaaaaacagtgcatccaagttggcgactagaacatcaatggatggcttttaaacttctaagaaaccatctggagcaataacagtattgatcagtattcatcatagtacccaagaaaggctaaaggtgtccaggttgtgatatagatggacatcagacctaacccttgatctaatatttctgagacatgtacccatcatcttgtgaacatgtggctggatgaatccatctttgttagttggctttggtttttcataacttagaaagcgaaagacaagcctaagtaatatgcacaccgtgatgctagacaatggagcacatccttgtgagggagttgcattgcctgaagtaaggtggccatgaccacatgtgaggcgaatttagtgctacataatttaggagtccttcttaaaacatctcaaagtttttctaccagagctttaaaaagtttcctaacaggggaaaatttgccatatttgcaaaaaaggatggcccttttctatactttaattctggatccactgaatgctaccaactgagagagtcggctttttaaaatatttaatgattacttttaactgacacacaattatacatatttattgggtacagtgtgatatttcaatacatgtgtacaatgtgccataatcaaataaaggtatatatccaaaaaaaactatatcaatatgttgaaaaagattctcatgttcattgcagcattattcacgatagccaacatgtggaatcaacctaagtgttcatcaataggtgaatagataaagaaaatgaggtactgacacataatgttatactattcagccataaaaagaaggaagtcctgttattcacagcaacatggatgagcctggaggacgttatgttaagtgaaataaatcagacacagaaagataaatactgcatgttctcacacatatgtggaagggagcagttttaaagcaaaaattgtaccacaatttggctttcattacagggagagagaaaacaagtaattgcaaatgcaaacaccctgacaaagaagagaacttcagtggatctgtccagcatccctgaacgtttcggatgagaagttctttggagaatttcatgagagccatggactcacttgccagaaaaattcatgctgtagaggcagccattagtatattcagtaaaatctgcatgtaatttcaggggatcatcgacccttttatgtgcttaaataagcccttgtctcccaagttaagaactcttggactaaataattatcacattagaatgtaattgtgaaaaaaaaaaacaggctttcagaacttggcattgataaggaaactgggctccagaaatagatctgcttatctgtaagtagtggcccaaatccactgatttttgcctacaggtgcaaattgattagctaatcaaagctgcttttttactgtagattacctttagaattctttcccagcttccaggataactgggtcccttcagttctccacaaacctctatattttccacattttcgcatcaggtttctgtagcaccctgtcatgtttggaatataaaccaaactcctttcatgtcctagtagtgtctgcttcttctagttcttgtccgtttcctgtatcccctgctgtaactccctccttcctgcatgaagctttagttatggaaacgttgcacagcttcttgaacatgtcaggcttgttcctgcctaagaacttggatccttgctgatcttaatgcctggaatgttctttcctatactccagatgactccaccccactttactcaagtctctcctccaatgttaactactcacagagcctttccttgacacctgaaacacgcaccaccctcactccatgaatattttcctcaccttggtttttctttataatacttaaaactctctggtaactatctggctcatttgctaattgtattgcactccagtataatatgcagttcaaaagagtgagaaatattaactgctgtattttgagcacctcgaacagagtctatcacatcataggttcttaatgcctatatcttgaaaaaataagtgtatgatgaatgaatacatgcatagtaactactgtgatggccagcattaatttacataaattaatttgagggaggatactaatttcccatttaaggtgatagttacactttatataagttataactttatatacttataacttatgcatataagttagtctggatatttcattgaattattactcaatagagaataaagaacaatatcattaaagtttgttgttaccagaaaatgtcaggatgcatgcagctttttttggtaagattaaataatccacatttacaactcagatggattatctgatgcttcttcagcaaaggaagggtcaagtttgtcttgggctgaaaaatattcgtttaagtaattccaggtatcggttgtttgctcaaatccacatggaatttaatgatttaaggtcatggggaagcgcattttgttacacttctaatttaagtgagggaattatcttatatgggtgcctttctcatataatcaacaatctctaaaacctcgtttcttacaagtaatcgattttgttttatttttatgactttattttatttacatacataattttacataaatgcattatctgtgctcatattcacatattcattttttaaaattcttctttatgttgtttgatttccaattctcccaacttagcatctgcctggtaacccaaatatgtgtgtatgtatttgtgagatacatacacacacaccatggaagcccttgttaaaaaccgaatacatattactgcatatttatttctgctccccacacatatataaaactatatatatagtgtgtgtatgtttgtgtgtgtgtatgtatatatataacaacacacaacatacatacattcattcataaataatgagtgtggctgggttttttggggggtttatttttaaaaaatgaaatattatcctacacattttcctgcatttgtagtttctcagattagcctagcttgtggaaattcttccagtcaccttgtgtaactctaattcattattttaatagctatataatattccatagtatggtatattacaagtcatatgactaaccccaaatgaatgaccattcgctttgtttctgtcttttttttttttcaaattaacttccaagacatcctcgggaaccctagagcattttgtacctatgagacagattcctctgaattagtttgctaataagtgagggttgtatctttctatattaataagtgttatcagatagctttccaaaaagattttagtgaattgtgtatctattctatttgaaagtttccttttgatttgtatttccaccaagcgctgtcattactgattatttaattgtttgatgagtgtaaagtgatatccatattgctttaacttgcatatccctgactactaatgagtctgaacatgcttgcagactgtttagatttacttttttgtgaataccctatacatatctgctcactacatttttatctattgaattggtttttattagcatcagtaggagaccttggacattacagatattaatcttttgtccgttatctgtattttaaaaatatatattccaaaacacttctgatgctaccaaaatggcatagcaccatttatctcatatcctccaccttacaacttaaaaaccctgcacgtaacatttcaaacaaacatcaagtgactctaaaaggtggaataaagaaggtaaactacagagggatttaggacttaaggaacaacatgacagtgagttttgggggttttcttattgtctcccctatatcccagatagggcactgcagacatttccaacccagagctgtcaacaaaaaagacaaaattatcttccaaggaaaacctatttcccaaagccaaaagagaaggaacggcttggcctaatgacagaaaagctttttgcaatacgtgtcctattctagccaaacatgaaaagacaaagctcaataacctcttctgcccttccctcctaccacttagttttatcagggaggactgggaatatgatctcacatcccctctattgctgaaactgctggtattcagattcccttgtcagggtaatgctgtcaaggcttagcagggagttagccttccatctctacctggcaaaagcaggcaacagttttcctaaaggatggtgtagatgagcctagcagagagctgatcttccatcccccagttggcagaggtaggatgtgctctgattcccctaccagggtagtgtgagcaggatccaaaggcaagccaatccagttccatcacactgatgacactaatctagacagttcaaaacaagtatagttggcactttgctccctcttgattcgaataaatggaaagacagcttatgtttataaacataaaatgatacagtttatgtggaataaagtttaatggtttcacaaaaaattaaacataaaattgccatgtgatccagtaattctacttctgagtatatatctaaaagaagtgaaaatggcaactctaacagatatgtgtacacccacatatatagcaacattatttcccaaagcaaaaatgtggaaacaacccaaatgtctgctgaaagatgagtgaataaacaagatgtggtacagacaacccgtagaatattgttcctccttaaatatgaaggaaattctgacacactacaacatgaatgaacctggaagacattatgctaaattaaataaaccaatcataaaaggacaaatactttataatcctacttatgtgaggtatctagcatagacaaattaaggcagacagaaagtagaatggcaaatgacaagttgtaggagtggtggtggggaatgtggagttgtttaatggataaagagtgtcagtttggaatgcaaagtggttctggaagtggatggtggtgatggttgcataacaatgtgaatgtacttagtgccatggaactgtatacttagaaatcatagcattcgcagcaacctggattgagttggagaccatttgtaatagtaaaattgttattatatatatttcaccataattaaaatgtctttatttgtaaaagtacaaagataattttgaaactttatatttaaagaaggaatgtatggatgtgatctggccagatggatttaatgccttggatagatatgatgagcaaagatgtctattgattttggtatgtctaaggccatccgaggacgctagatacactgaattgaaagggtattaaaattatgtcattaaaatggaggtaaaagatctttacaagaaaaaagatctctacaaaacatgtcaaaaataattgcaaaggacacaaagaaatggaaagacatcccatgctcatgcaccagaagaattaatataattaaaataaccatacctgccaaagaaatctacagattcagtgcaatttccatcaaaatatcaatgccgtttttcacagaattagaaaaaaaatatgaaaatttgtatggagccaaaaaagagccacaataaccaaagtaatcctcagcaaaaagagaaaagctggaggcgtaacactacctgacttcaaaatattgtataagctatagtaaccaaaacagcatggcattgatataaaaagtagacacaatggaatgaaatgaaaaacccaaaaacaaatccatatatttacaaccatctgatcttcaacaaagccatcaagaacatacactggggaaagggcagcctcttcagtaatggtgctggaatatgtggataaccagatgcagaagaatgaaactggactcctactttttaccatatacaaaaatcaacttgagataagacaactgaagattttacttaaaggtaaaacctgaaagtataaaactactggaagagaataaggaaagctcttcagaacattggtccaggcaaagattgtatggctaagatttcaaaagcaaatgcaacaaacacaaaaataggcaaatgggactatattacactaaaaagtttctgctcagcaaaggaaccaataaacaaagtgaagagacaattcccttccttgaaaggaagaaaatatttgcaaatgatttatccaaccagggactactactgagcatatatcaggaagtcagacaactcaacaattttttaaaatcccattaaaaagtagacaaatgacacgaatacacatttatccaaaaaagacatactaatggccaacaagtatgggaaaaatgcttaatatctctaagcatcaggtaaatacagatcaaaaccccaatgagatattatcttaccataggtagaatgcctattatgaaaagacaaaaaaaaatcagatgctggtgaggatgtgggaaaaaggaaactcttatacactgttgtgagaatgtaaatcagtacaaatgcaatggaaaacagtattgctatttctcagaaaactgaaaaaaagaactatcatatgatccagcaaatccactactggctatttatccaaagggaaaggaatcaatatatcaaaggaatacctgcatattcatgtttactgaagcaccattcacaacagcaaagatacagattctacccagatgtccaccaagggagaatggataaggaaaatgtggtatatatccacaatggaatattattctgccatgaaaagaaagaagttttatttgcagcaacatggatggaactccaggtctttatgttaaatgatgtaaaccaggcacagaaagacaaatatcacatgttcttactcatatgtgtgagataaagtgttgatcacatggagataaaaagtggaatgacggacaccagagactggggagtgtgagtgaatggtttcagcaggggttggggtggtgaagagaggttggttagtgggtacaaacatacagttaggtagaattaatagtttctaatgttgactgcagagcagggtgattgtagtaacagcaatgtattgtaattttcaaaatagctagaagagagagcatgaaatgcaccagcacatagaaatgataaaaacttgggtcacagatatcccaaatacccagacttgtttattacacattctatacatgtaaccagatttcacatgtaccccataaataagtacatatatttttatagcaaaaaaacttaaaaatgattcttaaaaatcttgaaattgcagaatctgagaaatggatatacggagtttcactactaccttatctattttgtttattttaaaaaattatttataaaggtttttaaagtgtgaaaaaatcctacagagtatatcataccaaatctatgatattctagaacaagcaaaactatagagacaatgcaaggataagttgttgttggaggttcgttggaaggaggaagagggatgactagatgggacacaggggcattttaggacggtgaaacgattctatgtgatactgtaagagtggatacatgacattatatatttgtcaatatctacagaatgtaaaacaaagaatgaaccctagctaaattgtaaattttagttaataataatatattaacatacattcatcaattgcagtacgtgtaccacattacaagatgtaaacaatatggaaaactgtggggaggttagtggatatgtgagaactctgtattttcttatcaatttgttttggtaaaacataataatattctagaacataaagcctattcattttaaaatatgcaaggtatttgaaaatacacttcaataaaaaagatatacagatcacaaaattatatgaaaagatgctcagcataatttatccttggggaagtgcaaattaaaccacaataagattctactacatactaattagagtggctaaaaatcctaaaatatcagatataagagataatgtgaaacaaaaggaactactctcatttattgctggttggaaaaaatatatagcactcgttcgatgaaagcattgtattatctgatttatagacattccaaaaaaggtaaaaagatacgaaaaacagatcaccattactagggacttggaggaggctgttagttgactacaaaggtgaggcataggggattcaacccaaattgctgtgcatgtcaatagttgattcctccttgttggtctatagaattccattgtgtggatgcacctcaatttgttaatccattcacttacagaaagacatttcatatttttcagcttttggaagtatgaatagagctactataaacattcatgtataggtttctggcctgggcatggtggctcacgcttataatcccagtgctctgggtagctgaagcaggaggatctcttgagcccaggagttcaagaccagcctaggcaacatagtgagacctcatctctacaaaaaaaaaaaaaaaaaaattaaaatgaaaaaagataataaaaatgaatgtacaggtttttgtgagaacataaggtttgcaaatttatttcacacagtaatggtatttctgagtcatatggtaagtgtatgtttataatgagatcatgttctttgcaggaacatcgatggggctgtaggcgattatccttaggaaactaacgcaggaacagaaaacaaaatactgcatgttctcacttataagtaggagctaaattatgagaacacatagatgcacagagaagaacaacacacagagaagcctgttggaggttggaggatggcaggagggagaggatcaggaaaaataactaatgggtactaggtttaatacctggatgatgaaataatctgtacaacaaacccccacaacacaagtttacccatgtaacaaacctgcacatgtgctcctgaacttaaaataaatttaaaaaaaagaagtctgggggaaataaaagaaatttccagatagtgactgcacaattttacattcacacaggaaacacaatagtgttcaagatgctcttcatccttgctagcagttagtaatgtcagtggatttttcagcagtcctcaaaaatatgatgcatctaccttgattttaatttgtttttctgtaaaatctaatgatgtaggataatttttcaggtgcttatttaacatttgtatgtcaattttagaaaagtgtctattggtgtattttgcccattttgaaaatgttttctaatttttggattttgaaagccctttctgtattctggatacaggtgctttttggatatgtaatttataaattttttttcaacctgttgtttgactttttctgctctcaacagtgtctttctcaaaactaatttttaaaattattgaggatgtctgatatattgtttctttttgaattttggttttatttttgaggcatcttttcctaattccaagtcataagatttaccttatattttcttataaaattttatactttttaatttgacattttttttctctaattgctttcactcatcaagggaaagacactaaagaagaatagagtagatcttccatcacaggtagaggttgccccagcctagtcctgcccctgatatttgacctgagtagccccggaaaaaggccacagataaggactattctgcctttcatcttgggcatctgagggaggtgaggctttttctgaggggtggaacttcagatcagcgaatggatagtcttgtcctctgccccacatacttcaaggtaaggactctaaggaaagactgaggggacctcctgccacagatatagggagttttagccctgccctccctgtgctgttagccctgggtggcccaaggcaggtttccccagttttgatgtccgtagacttcatttttggggcctgagggaggtgaggcttcctcaccttagactcaagtcagcagagagagaagttccagctccagcatgcattaaggtgagaatgcagagaaaggacaaagatagccttcctctatagatggactgagcttcaaagaaccttcctcttcgtgtgaatcctgagaggtcccatgcatgggtatcaggtagcaacaactctccctatcccctgacatccttttagaggatttcatggaggtgatatccttggtgtgaggaagccagcctcaagtcagcagaagggccggggtgaagaccctgatcaagagtaaatatgattaccttgagaaattgagaagtacacagggacctcacagaatccagtccgtttccactcttagccctgggaagaaaagatttttaaaattgaggaagtctaatatatcattttcttaaatgaatcatgatttagtttcaggtattacatctcttcgcctaagtccagttcaaaagatttcctcctatgttttctcataagttttatagcttctaatttaattataatccatggagctgtaatccatgttaaaaaaatttttatattaagtatgcaattcaggtaaattttattttatatttttgcatgtggatgtccagttgaactcatagcactgattaaaataccactttacacacatttaattgtcaaaaagtagaaaaacaaacaatatcaagtgctgatgacaatgtgaaaaaacaaaaacactcttgtagtgctaatagaaatgcaagctagtgcaacctttttggaaagcaatcaagcctacagcgcttgtactctacaactttgtaatttccttcctggatataggcccacagaaactcatataaatgcacaacgaaacatgtaaatgaatattaattgagcataatttcaaagagtaaaaagtaaccactaggggatttcataagtaaaatgaagtaacacataaaaaaggaatttatccaggtatctgataaataaaccaaatctatatgctgcaatgaaaatgaagctcaaataaggcttaccttcaaaataagaaatgaagcaagatttctgaccaaatactacttctgtacatttaacacacacacacaataatattacatactttcacgtatgcgtaaattaatatatgaatagtgaaatagacattcacaaaacaagcaagaatgggtgcctttgagtgaaggacaatagccaagggaggttagatgaagaagagagaaagtgatgaaataaaatataaacaaaagaaaggttttcagaaaaaaaaaaaccaccactaattttctcaattcagttgtcttgagacatttgtaaacactgaatggacctcactggggccttcctttggattatctcttctgttccattaaaaaaaaatctatcctttaaccaatgccatactttctttgttattactgtagccttacagttgtaagaatcaaagaaagaagaaagaaacaggaaaggtggcttgacagctaaagacagatttattaacttcaccttcatacagtgggccccagtaaaacaatgggccttaataagcacattcctttcccttcaggtgcactaagagaagttaaaagcagactcagggagtatgcctgcagctgcaggaagatgtatgggaacagacccaaaattctccctcccagataagcacaacaaagaaacacagaggcagtccaagtctctgataaactctcccgccctaaatccttaaaaactcttagtctgtaaaaacaaaacaaaacaaacaaacgaaaagagtgcctctaacctaacttgcccaaaaacccctctcgggtgtatttttctaaaataaaactggaaaggcctatgcattattttttgttagtaactgttactgctgctatgaggataataattgagcaaaatgttatagtaactgagattttctgtctgatattttaccttgagggtgttacagtatatagtcctcctgcaaatagtagagtgagtaaagcaattcctgcaagggttgcatagtaaataatttttattaaaaatgttttaatatttggcttaaaaggagaggtagaggctgggcatggtggctcacgcctgtaattccagcactttgggaggccaaggcgggcggatcatgaggtcaggagatccagaccatcctggctaacacggtgaaaccaaatctctactaaaaatacaaaaaaattagccaggagtggtggtgggcgcctgtagtcccagctacttgggaggctgaggcagcagaatggtgtgaacccgggaggcggagcttgcagtgagccgagatggcgccagtgcactccagcctgggcgacagagcgagactccgccttcaaaaaaaaaaggagaggtagaaatgaaaaaaagtatttggtgaggtaggggtgagattgagtaaaatgggtaatttttactccattacttattttttatgattttcagcttaagattttttatttatttacattaatatttaggactttttctgggctgttaggggttgctttcttagctttttaggctttgatttgagtgtgatgtatccaggagttaatttctgtaacagatatagtttaaactgtagcaaataataaaaattgaaaaacattaggccagactagaatttaacaacaggtgagctacagtttttgaaacataattttcctttttcagtttcccatttttattaaaagacaaattatggtaggattgatttgctttattatacttggcttaattatttatatacagtgcagcaagaatttgctactagaccttttaaattggctttgatggaactttgtttcatggaaggaatttgagataagacttttaaaagccaagcctagccatggatttgtaccattaaatacctatgagttgggcaaattttttttcttgaggttctaagatcacttgggattcctggcctgttagaaagtgacattctttacttaccatagattagaaactctgtacagggactgtgtacacaaaatacgaggtcgatttttcaagggttttattggctatataagttctttgattttttttaaaatttttattttatttatttatttatttatttatttatttttatttttatttttgacatggagtctcgctctttcacccaggcgggagtgcagtggtgctatctcggctcactgcaagctccgcctctcgggttcacgccattctcctgcctcagcctcccgagtagctgcgactacaggtgcccgccaccccacctggctaatttttttttgcatttttagtagagatcgggtttcaccgtgttagccaggatggtctcgatctcctgatctcgtaatccacctgcctcggtctcccaaagtgctgggattacaggcgtgagccaccgcgcccggccagttctttgattttttaaaggagagcataccattccagttaaagccttggtaaaataaccagttttttttttaattgtgttctgttacaaaagaaaacaggttcttattgtgcttatgcaaacaactatattgttgtaatgtaagaatacttacaactagtttttaaattttagaggaactaggcagaaagaaacaaacaacctttaaattcactttacaggagtatactttgcttagttgttaaaggctgtagctagcttaagacaagttttcttgactttgaaaagtaaaataaggattagcagtgttttaagcaaaaggtaaaacttgtttctgttttttattagtttagtccattttattaacttttgttttgcttgatatttataaacattttagctgttcatgagttctgtacattttttgttgttgttgttgtgagaaacctccatttgagagcacttgctaaggcgacacagcttgattataaatcatgttttgaagagaattaaaagaaaataacgattgtctgtaaataacaaaatgtctagtttggatacaattagaaacacaactgacaaagaaatttggttatttctgtggtttacaataacctaacataacaactttaattatgattaatagcacatatttggacacgagaactttagacataccatacagttttggaacatatattattattccctaaaatataacctattagacatcatttttgcaattgtatctacctaagcatgttaaataattctgtttacctcttttccagatgcttcaggggccctgtgcagtacccaaaagccaggggttaggaaagacaaccttgacactaaagtttgattttgggaagcgtattaaatatgtttaaaatttaaaacacttgacattatgaaatagaattttagatcaccctaagttggtttttgttagtttgttttgttttgccaaaatgatgagttaaaaatttggaaaagcaaaacccatttattagcctttttattacatgaaaatcctgtttaagagagaaagttaaattttacccttgcattagtttgctagtaacgttaacctgaattttaatgaaaccttatagacaatcctgtttaattttaaccagtttgaccatgaagtgcgatttttatatacctgttaagacccttgacaagttttgctaaagagtagattagcattttaagaaaactttgtggtgctttaattttagtgtttaatttacagaaaaaaaacccatataatacccttttgagtttagttaatatgtttacacaggttttttttgcaagattaatttttacaatgtttttataatttgctgaaaccattcactttattttatttaattttaagacttttttattcttaagaaaaatgtgtatttttatgccttcttataatttttaactaaaaacactttttactgtttttatacaccttgcacccaaatccatgtttagtagctttaattacatgttataatggtaacttttagcaatttttaactttcatgtataacctgttaagttttttaaattatgtgctagatgcagatgaagttggactttttccagcatagttaggggcatggttacttccatacctgtctggccttaccaattgtgacacaggcaagttgacagtttttaaaggccaaagaagcaggttacaaccttgaaacatttagcaaacctaatatctgacctgcataatgtagaccacatttttacaccttgaagacattagtattttaccaataattcctaagactgtttttatttttaaatattaaagttaggtgaactaaaaggtaccacaacttttatttttgccttaaagatgtttgatttaagcacttatttttcttaggccaattaattaaagctttttttaaatagacattgcacacataacacatatataaccacacgggcaacagaagaagatctagtagttataagattttttatttggtaatttcccaattggattattggccttcaggtgaggccctttaagaacagagctaggaatacagtttccagggcctaataaacaagcatagattgaagacaaagacagatttcgagaggtacttatttacgtctaattccagggattccataaggaaaacagagattttttttccaaaatgggatttgtgatgccttttctgttttcccaaggagtcccaggccaccagaagtcattttagggtttcttatgcatgcaccaagagtgtggcaagacagagtggagagaagtaattcagatggctgagggaaaacgttttccaggaaaacaagatttatgaagagataaaggtcttttgaatataattatagcttggatatccattttaattaagctgagcactcttttttaacaggcggaggttagaattatataaatgttatgccaagttaaattaaaggattaggttatgtgcaggaattccctgtgaaaaggagagggattttcagagaaagaatccagatgctgtttgatttgtgacagattagacatggagaaagggacatgattgtgagcaatgcctttaaatctagccacttcccagagagggagaatggcaggggttgtctgactggctggagtagtttttgaatgggtaacaggtggagaagtaggaggggcaaggttaggggctaaaggcttggggacaggaggggctgctggggcagagggttcacacgggcaatgagcgggtgcagggggttgagaatacagaaggggttcatctgcagggttgaaaggaattttggagaaaggggttttaggggaaggagagacctggggaggatttttattaagaagaaggattttatgaggggtgaaagcttgacatagggagggtcaggatttaaggtaaaaataaaaaaggctgaaaatagagaacctcttgccatttgccattcctcgttatgaagttggtaaggtccctgatagtatgaacattaaaggtttcatttttgggccattggctgtcgttatctaatctgtattggggccaagccattttacagtagaaaattaaacgctttggctttagggtctccgtaaaccaagtttggtgaggttgcaaagaagacagcccagagggaaggacgtaggaatgtgggattgtttgtgacccatgtgagctggtgagaggaggccgagggtgtctgttttgttctaggcatccccagacagaagacagagacccagaatcctctttctgaaagaggacagttaatctgagaagaaactgcacatccccaagatttcctctagcttagtcccactggttctctgaggaccaggatggcaggccagactttctcaggtaccaggagaaagccaggagaaggcaaattttaccagccggctgaattagtgtccgatgttggatgttccagttggaattggtaaagggcctcctagactggagccacatgaggaggagagagagagagagaaagacggaggaagaaggaagagggagcaagggttagggagtgaaatatccactgcaggtcattggtggtggaatcttgagacctgagggttttgagagtccactggggagtagccccggcctgagcctcacagtccccttcaggttagttgtcctcctcacgcaaatcacttgaaaagtgaagtgagagaaaagatggggtgggtggctagagaccctcaggatccaggagttaactcaggatgaactgccattgcccactgcttcttgggttgcaagagagcctttgcccccaacacccatcctgggttttggcaccaaatgtaagaattaaaggaaaaggaaagaaacacaaaaggtggcttgacagtcaaggcacatttattttagggaaaacaaacctgagaggagcttctggccgagttaggtgagaggcactctttcttacagactaagagcttttaaggatttagggtgggagaggttatcagaggcttggactgcttttgtgtttctttgttgtgcttatctgggagggacagttttgtatctgttcccatacctcttcctgcagctgcaggcatactccctgagtctgcttttagcttcccaatcttagtgcacctgaagggaaaggaatgtgcttattaaggcgcactgttttactggggcccattgtatgagggtgaagtttggcagttacctaagatactcccacctcctccaccaccaccccaacacccatacccaagctgttttatctgtgttttactgtctgctctttctggctgcttgttgtcaaaagagaagtgatttccttgaaatgcatgaggctagaaagggagctggaacttaaagtggcgatgtttgtccaagatgacagtgctcctgctctgtcaatagtaaataatataattgggttgtgtgattcctccaacttcactgtctttttaaaaattgttttagaaacctaacacagtaggcacaaggtctgtataaagaaaactataagactctaatgaatggaatgaagggatattcaattttcaaggatagaaagactcattattgtcaagatgtcaattctaacttgatctatagattgcctaaaatcccagtcaaaatcctagcatgttgttttgtggataccaacaaacttattttaaggactaaaatatgttttatgtggaaaggcaaaagactaagattagccaacacaatattaaagaagaagacagtgggaagactaacacttcccaacttcaggtcttactataaagttacgataattaagacagtgtgatattaaagaaataatagacaaaaaagtcaaagaaatgcaatagacatcccagaaatagacctacagaaatatagtcaaccaacttttgacaaggaatcagaggcatttaaattaagaataatcttttcagctaattataccagaacaagtggacatccacatggagaaaatgaagttaggcacagaccttaaactcttcacaaaagctcacataaattcaatcacagacctaaatgtgaaaataaaattttaaaaaacctatgaaacacatagaagataccacaggggaaaacctaagtaactatggttcgagaaaacttcttagatacaacccaaaaaggaacatctgtgaaagaaaaaattgataagtttggcttcataaaaatgaaaaaattctgttaagagaacaaaaaggaaaaacgagaaacgaggataaaagttttgcaaaaaaaatctgactgaagatgtgtatcaaaaatatattcagaaccctcaactcaataacaagaaagcaatccaataaaaatggacaaaagatctgagtagatacacactacaccaaagaatatatacacattgcaaataatcatgtaaaaagatgattagcatcttatgtcactagggaattacaaagtaaaacaggataccactacacatcttttagagtggctaaaatcaaaatgcctgaaaatttcaaacactcaacaggaggctgaagaacaggtaccctcagtcattgctgattttaatttgaaaaaaaaatacactcactctagaaacagaattgtattattctatgcattttaaatctggaaatggtaaaaaaaaaaaaagtagataaagaaaacacactaaacacactgtttttgctgtgatttgggtagggggtggtggttgactatcaaggtgaagcaagagaaattttaggctaaaagaagggatctctatgacattttagtggtagatgtaagactctatatttgctatgataaataaaaatgttcattatagtgaacgctgatctatacaaagttttaaaaatcagccatgcattgggttttcaaaaggatgctgagaaaagaatggattttacaggactgaatgtgaaaggagaggcaccagcaaaagagggtttgtcttagtctaggtgagagatgaaccacagaggtagtaatggagatcaattgaagtggagggacttcacatgggttttagaggttggggtaacaaatgctgctgttggatttgataaaaattgagagaaagggaggcatcaagtatatcaaaacatgtgccacctatagcaaaaaagtcacattgagctattattttttaataagttgtcagccctcatgtttattttataacttctctgaaccacacacaaatgctccttcttccttgaactcagggaatgccctcccctcccccaaacctgtgcgcaaaacatctatattcatggcaactatggtaaatcttcggtgacagaggcagcatgttctttgaaggctgaatctacgtgagaataaggaactgaaggtgagtcatttggggcatgtttggaaaatggttgtgttcactcctttaaaaggtccctgacactccccattgattgaatcccaagaacgttagtccctctctcttctggacaggagacttatttccaataccaggaggtaaaagaataggtttccattttctttttatcatccataagaaatgctcccttcttgggacctcagaagaacaactccatgaagataattcccgagggcatgggaccagagctggaatttacccaccagctgcctcccagtctaggagaagagcttccttgtctgtgggtttccaccttgagcgctgaggtttggtccaccaatcctggctatgagcagagtcccactgccccgggacactgagccaaagctgaagaaggaagtcagctcatgaacggctgagttgatcctggccatagtcaatgaagagggccccaaccctcagggaagtctctggcaaagccacaagtcagccttttttggaatctcagggttcctgaatcctgctgagggtcctgtcaggagtaagaacagctgaaaggaagtatgtgaatctcctatctatgtggagaggaaaataaacctctattcccatcacatttgggcaaactggcactgcctcttaagtcagtaaagtatttgtggacctggtcaggtttctgtcatcaacacaacatcccccattcatgactttctggagtagaactgctcacattatatttcttggacccccagagttccagaggtcagcaggaggactggccaagtaagagggaattaatgcaaagttgtcccaggtagccttcccccagccactattgagatttcaagtcctgctctcaggaagcaaaggttcatgaaagcagtcaggccttttatggctgagacaagggggcagaagtagctgctatttcctgtgctcctctttgactcttatcttacttctccctggtactgaagtgaccaaagaccccagcctctttcagtgctttcaaatccagccttacagatgctctaatttactcatactgcgaacttgcttaaagataatttatacaaagacttattattctaagaatgtctgtgtatttctgaggttttttataataaacatattttaaggtaggttttgaatttccctgtaattgttttttctgtttaatatgaaaaagggttccacttacattagggtttttgtatggatattctgttgttccactgacacttatttcaagaagactgtctcctgttctaaagctgcaagttttaaaaatcagttaagcacatgtttatacatgttttgttggttttgtttttcagaactctccattcagttcctttggtctatctgtcaatctctgcacccaaatctcaaactcttcattatagtagctttgtaattcttactgtctggtagactaatgactctttttcaagtgtatattgactatgcttgtccatttgcatgtctttatattttagaatcaggtgattcacacatgccttcatgtccaaagccctttggcagttttgatttaggattgcagtcgatctgtagattcctttttgggaagaatcaacatatttaaaatattgaatcttcatgcccatgaatttattttattttatgttcaggtaggtctttgttaatatgcctcaacagcattttaatatttttgtctgtaaaaattttttggttaagcttttttaaccaaaaaatattttaaccagccatcagctgcctcccagtcttatttggttaaaatgtttttggttaaattattttcctaagatacttgatattttggtactataggttaaaattatatagtctttactttcattttcatactctttccctgacaaaaaacgaagttgatattcttttgaatattgaccttatactagcaaactgatatactattatatattgaataaattatctttagttgttttggattcttttcatgcacagtctaatcatgcatgaatcacaaacgctttgtttccaactggccaatcctcattccttcatttactgctctttggattactacactggctactacctctagtataaaaagtaatagaagtacttgtagcagaaactctaggttaggtctcaagttcaaactagaggcttccaacatttccttaaaagatgtatctgttgtaggtttttcatgcatatccttttatctagtttggtaacatttttcatatttgataaactttatgtttaaataattttagatttacaagaaaattataacaatagtaagaaagttctcatatgttccacactcaatgcctcctgttattaacaccttaccttggtaaggtttcctaaaactaatgagccagtatttgtacattgtttttaacaaacattctttatttattattgaacatacttcagtcacattttcttacttttcacgaaattctattttctatgccaggatcccctaaggatactccattacatttagttatcatgttccttcgatgccctttggctgtaccggttgattgagacatttctcgattttgaaaacattgacagttttgacagtttcgtatggttaggtattttgtaaaattgactttgactgggatttatgtgatttttttctgtcatgatttgatgtaggtaatgtttcctggaaggatgaacagagaggtgaagtgccgttcttatcataccgacagcacatagtaccaacaaaatttgtcactgatgatgttaacttgattaccatggcatcatcgtgctttttagctttattcagggtaaaattacattattttttgccgtatgttatactgtcatcatgagaagaacagggagacccaggaccagccagtagtcacatgaagcctctgagagataactgcaagactccctgcccacaaagagaaggatccacagaatccagctccactgctgctgtcagccctgggaggccctggggcatggtggcccactgtggtgtccccctgacattttagagggtagaaagaggagaaggctctgcctaggtgagtctcacttcagatcatgagaggtgaagggactcaggcccttccaggcatccccaggatgacacagaggaaggactggtgagacacccctcccaagaaacagaaggacacacaaatccaggccctgttttcacccctgggaggccttgggcagggccctcagtcagagatgctagcgcttttcacttcgtcttggggggcgtctcatggaaatggggaccttgatctgaagaacatagtctctggacagcaggggaagggctcccaggccatgtcaggaataataactgcaggaaaacagagagtcctgcccaccccattttagaaaaaggacaccagagtcctgccttgggcctgggaggccccaccccactgtgggtggatgtgattctccctctcttgcaccttgcaggtctcagggatgggaggggcttattcggaggtgaaagactcagttgcacagaggcaggaaggccaggcggtttccaggagtccaggcacagcctctcgggaaggcaggaagggaacacccatgactggtagtgcccctcccctgtccctgtgcctgctgccagctctggaggaccctatcagggtccccaggtttacaactttctgacttgcattttgggagtcagccggaggggaagttttctctgaggagggcagtttcagttaagcagagggaggaaccccaggactggccactcaacgagaagagaactctgtggaaggacagtgaccttccaacatggaggagaggcacaggctacaccctttcccttcctgccgtcagccctggaaaaaggttgtggggggagaaagcggggaggtgggcagggaaatatggacgagggctttgaagtgaggaggaaaaggtggagggataccgagaggtgggcaggaaggggtggaaagggtcggggaggtaggcaggaaggggtggagggggcccaggagatgggcaggaaggggtggagaagggccgggaggtggtcaggaaagtgtgggaaagaggtagagaggtgaggggtggttcctccatagagaggagacctagccccactgggagtctgaagtatttgaggcattttgtgagaaggcttaattgagatcagcagacagaagactcttagaactggccgatcctcaaggtaagggccctaagggagaactgagggacctcccaccacagaaagaagaagctcttgcctgccctctacctgctgtgagattgtaggtcgcagacaggaagagggtaaccgagggctgagggacacgtcttcatgacagaagaagggaggaggtgccagctctctagggaataaataggaagactttgagaaggacaaggggaaacgccacctcagaggacagactcccagagattcccagcatgctcctccatatcagccctcgtagagctccccagtcagctcaggctgagcggcagccctctcattgctgggtgagaggtgcagggaaagggaaggccttggtctgagggtcccgtggcaaatcagcacagggagctgcctccagttggcagagggaagattcccaggccctgctggggataagagtgaggactgaggagtcacatgtgcatcagaacagatgtgaggccagcccaactgcccccgtggtagagtgctgggaggtggctgccacctcactacctcccactgctctcagggatgtggagtttgccctgagttttggctagaagagtggtagggacatggccctgtctgagaaaaggtgaggatgctaattaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggtgagtgcacgccctgactgtgtaccaagggccctacccccacaaacagagcagacctggcagcacctggccatagccacctactgccattcctggtgcctcaggctctgcctgccagctgtgccccgaggtgctttctcacatcctcctacaggttcccaggggacaaaccccctaggatggcaggtgacccgtgaggccctagagcaccaccttaagagaagaagagctgtaagccggcctttgtcagaaccaccatgggtgagtttctcagctgaggccacttgcagtgtccctctctccctcaggcctgttggatgccatcatccacatccctgctcacacatttacctcctgctcctaaggaagacgttatgcctgtgttttgaaatgttcctagcggcaactttgagaaagacttccagaaccaaactgtgatagagaacttggcagatgcacaggattccacagaggaggaagaggagaaaacctcctccatttcctcttcctctttctacttattattcccctcctcttccttctcttcttcctccttctcctcctctttctcctcttcctcctcctcctcctcctcatcctctactctgattcttggtgctcatgaggaggaggaggagtagctgtctgctgggatgctgcctcttccccagaatcctcctgagagtcctccccagggtcctctccagggttccctgtcctgctcctcctccactttatgaagcccattcaatgaagagcctagcagccaataagatgaagatacaagtacctggcacagcttgccagagagcgagcccttgttcacttatacactggatgaaaaggtggacaagttggtgcagtttcttctcctcaaatatcaagcaaaagagcctctcacaagagcagagatgcagatgaatgtcatcaacacatacacgggctactttcctatgatcttcaggaaagcccgtgagttcatagagattctttttggcatttccctgacagaagtggaccccgaccatttctatgtctttgtaaacacattagacctcacctgtgaggggagtctgagtgatgagcagggcatgccccagaaccgcctcctgattcttattctgagtgtgatcttcataaagggcaactgtgcatctgaggaggtcatctgggaagtgctgaatgcaataggggtgtgtgctcagagggagcatttcgtctatcgggagcccagggagcttgtcactaaagtttgagtgcagggacattacctggagtagcgacatgtgcccagtagtgctcctccacgttatgaattcctgtggggtcctagagcccattcagaaactagcaagaggaaagtagtgagattttggtcatgtgaaacaataccgtctctagttcctttccaatctcttccaaggatgctttgaaagatgtggaagacagagcccaggccataattgacaccaaaaatgatgctactgccatggccagtgcaaggttccgtgtcatctccagaaacttctcctgtcctgagtgaagtatagggccgtttcttacgtctgtgtttgaagagggcagtcagggtcctaggtagtggagggcccgggtggggcttgagggaacaatacagtgttctttgcatttctgttccatatgggagagatagatttacctcgtttccttttgtgtactttttgaatgattttccttttaatagtaggttgaattagcttcagaatattattttataaatattagtcacacatatattgctgtttatctagtttaagagtaacagtttgatattttgtaaaaaaaaatggaaaaagcttgtctcttattttgtgatctataacaggataacatggtattgtactaggaattttctttaaattatgtaagaactcagcagttaaatagtggaacgaaataaaggatggtgaatagttacatttccttatcccgtttatactgttgttcttgaaaattaaagaaatagacctggctttgcttagctcattcaagaaagtagcagaaattaaatgttaataaataaaagcatctctgacggctttatttgcctaacattctgtgagcatttgcttgcggaggggactcttaatagtggggatacagtgaaaagcaagagttatgccttacctataaaacaatagagtctaggagcagaagccatgtcaagaaggtggtaagatgctctctacaatcataagtttcaaaaaagtggggaggtgagactccagatggagtcttcaagtataaagtccctgagctaaggtagtgtggggcttcgggaaactgcaggtgcttctgtgggagctgattgttatgaagctgggtggtggcaggggccagactctcagaaggtgagagaaaagcctgcaatggaaaactgctctgagcagttccttctgggtggatgatgagggagagaggagtctccatgtggggaagtaatggaagctgtcttgcagctctctaactggtgagcttgaacacagtgcaaggactaggtgattgatacccatcatttgcaagtgtttcctgagaaataaggcgataattccttgaaatgctgcccagaagcttctaggctggcactcattttcctagcctgggagagccagagtccattccattgaaaggtcatttaattaggttattttaaatgtaatgtgggcaactgtaagcaagggctagatttttagtggaggataaatagaaatagttgtttggatggatgagcaaaggggaaggtgaaaaggagttggtccttgattcaaattcagcactttgatgtaaattttcagtttggatagtgacaattccatatctatcctgggcatcttcaaacactctcaaaatactcccacatagggtggtgagtagaatctgatttgccacataatatactggttctagggatgtaatcttagggtaagagatagagtttttgagatcatcctaatatttgatatttgtattgggattttaatatatgatatttgtagtaacattgtttgaagcaggccactgaagagatacacagatgaatgagctataccaggtggtcaaaaagcaaagcttccttcataaacttggtatatgagataaaattttggaaatcactttgtaaataaattacaaggagctgaatttctaaaaacagaacaataacaaaatccttaatactgcttagaaggtgacaagtgttccttgacagacaggctagctctgatgagaaaagaaaattatggttaaccatccttccattgtctcttttctgtgtacctgccccacaggaaaatcttggtttgcagtgtgccacaggcacatgtacagctgttcaggaatgttcagtcatgtagagggtattagaatctctcatggtaggatatttaccgtataccaaaagcagtgagagaattctcagtctaaagagattgtattgtgtgatggttaatactgagtgtcaacttgattggattgaaggatgcaagtattgttcctgggtttgtctgtgagggtgttgccaaaggaggttaacatttgagtcagtgggctgggaaaggcaggtccacccttaatctgcatgggcacaatctaatcagctgccagtaggaccagaataaaaagcaggcagaagaatgtaaaaaggctagactggcttagcctcccagcctacacttttttttcctgtgctggatgcttcctgccctctaacatcagactccaagttcttcagcattgggactcggactggcttccttgctcctcagcttgcagatggcctattgtgggacctcacgatcatgggagttaataaactccataatacactcccctttatatatacctctatcctattagttctgtccctctagagaaccctgagtaatacagatttttgtaccaggagtggttctagagaaacagaatattaaggatggaggtctttcattggttttggggtttctggagttggatgcttaatgtgattagacccaaaaatgctaaggactctaattctaatggcgtggagaacaccgatagcctttggcgtgaactgtttagagaattatgcaaaataaatgcatttgacactcctgattaactgcttgtgagaaaaaagtttagtgaccctatatttaatacctttgaccatatgtggagaatcaaggaacataatgaagttggttggttgctcctaaatgcactggacaaagggatgaaagaaaatgatgaactcagggattctgactcctggctccagaagcagatactgagcctcaaatctgctaggattgccctgagtgagagtcttatctcctgtagagaaagacctgaaatttccacctttgtctgaggagataaaccctgtgctgcctgagtcaacagtgatggcctcctctgaggcagttgccaggcaagatagtgttgcttcttctcaggacccacccccaaaatccctgttgttttctagacctataactagactaaagtcctggcgggcgcctagaggtgaagttcagagtatgaccccgtgaggaggtgcattacactcgaaaagaactgcttgagttttttaatttatataagcagaaatctggagaacaggcatgggaatggatattaagggtgtgggataatggtggaaggaacacagagtttaatcagactgaatttattgatttgggtccactaagtagggattctgcatttaatgttgcagcttggggagttaaaaaaggttctaaggccgggcgcagtggctcatgcatgtaatcccagcactttgggaggctgaggcgggtggatcatgaggtcaggagttcaagactagcctggccaagatagtgaaaccccgtctctactaaaaatacaaaaattagctgggcatcgtggtgcgcgcctgtaatcccagctactcaagaggctgaggcagagaattgcttgaacccgggaggcagaggttgcagtgagccaagatcgtgccactgcactccagcctgggtgacagagtgagacttcgtctcaaaaaaaaaaaaaaaaaaaaaaaaagttctaatagtgtacttgcttggctagctgaaatatggattaaaagatggcccactgtgagtaatctggaaatgcctgatttcttgccttggtttaatgtagaggaagggatccaaatgcttagggaaattgggaggctggagtggattagtcattttagacctactcatcccagctgagagggtccagaagatacacccttgaccaatcctttgtgaaacagatttgtgagggcagcacctgcatctttgaagagatctgcagggattggtcttctctgtatgccagatctaacagtgggaattgtagtcactcaactaaaaaatttaaatgcaatgggaataattgtatcccgaggtgcaggggtcaagtggcagcactcgaccatcaaaggcaaggcgggtatagctaccataatggacagcagaggcaaagcagcaatcagaatagtttgactcctgtagagctctggcattggctgattaatcacagtatttctagaagtgaaattgataggaagcctactgcattcctacttaatttatacaagcagaaaacttccatgttaagtggacaaaaaactgattcaaattataaaaacagagaataacggcccctcaatttccagacttgagccagtttgcagacccagaaccccctgaatgaaggggaggctgggtccccttgaggaaggactccactacactatcaacaatttatgctgttaatctttctcccatccttccccaaggacacctctggccttctactagggtaactgtgcactggggaaagggaaataattggacatttcgggactactggacactggctctgagctgacattgattccaggggacccaaaatgacattttggtcctccagttaaagtaggggcttttggaggtgagatagttaataaatatttagctcagcttggacttacagatgatccagtgggtccccggactcatcctgtggccattttcccagtgccagaatgtataattggcatagacatacttagcagcttgcagaacccccacattggctccctgactgggagggtgagggctattatgaagggaaaggctattatgaagggctattatgaagggaagggaaaggccaagtggaagatattagagctgcctctacctagaaaaataataaatcaaaaacaatatcgcatccctggagggattgtggagatgagtgccaccatcgaggaactgaaatacgcaggggtggtgattcccaccacatcccccttcaactctcccatttggcctgtgcagaagacagttggatcttggagaatgacagtggattatcgtaagcttacccaagtggtgactccaattgcagctgctgtaccagatgtggtttcattgtttgagcaaattaacacatctcctgatacctgggatgcagccattgatttggcaaatgcctttttctccattcctgtccataagtcccaccagaagcaaattgccttcagctggcaaggccagcaatatacctttaccgtcatacctcaggggtacatccactctcctgctttgtgtcataatcttattaggagagaccttgatcgattttcccttacacaagatcactggtcgactacattgatgacattatgccgattggatccagtgagcgagaagtggcaaacacactggacttattggtgagacatttgcattccagaggatgggaaataatctgactaaaattcagggaccttctacctcagtcaaatttctaggggtgtagtggtgtgggggcagttgagatattccttataaggtgaaggataagttgctgcatgaggcccctccaagaaagaggcacaatgcctagagggcctatttggattatgaaagcaacacattcctcatttgggtgtgttactctggttcacttatcgagtgacccaaaaggctgccagttttgagtgaggttcagaagaggagaaggctctgcaacaggtccaggctgctgtgcaagctgccctgccacttgggccatatgatccagcagatccaatgctgcttgaggtatcagtggcggatagggatgctgtttaaaccttttggcaggcccccattggtgaatcacagcagggggctctaggattttggagcaaggcccttcaatcttctgcagataacaactctccttttgagagacagctcttggcctgttactgggctttcatggaaactgaatatttgactgtaggtcatcaaatcaccatgcaacctgaactgcctatcatgaactgggtgctttctgtcccatctagccataaaatgggtcatgcacagcagcattccatcatcaaatggaaatagtgtatatgtgattgggcttgagcaggtcctgaagacacaagtaagttacatgaggaagtggcacaaatgcccagggtctccacccctgccaccctgccttctctcccccagcctgcactgatggccccgtggacagttccctatgatcagttgatggaggaagagaaagctagggcacgatatgcaggcaccatccaaaagtggacagctgcagcactacagcccctttctaggacatccctgaaggacagtggtgaagggacttctaagtgggcagaacttcgagcagtgcacctggttttgcactttgcatggaaggagaagtggccagatgtgcgatgatatacttatgcatgggctgtagccaatggtttggctggaaggtcagggacttggaagaagcatgattggaaaattggtgacaaagaaatttggtgaaaaggtatgcagatggacctttctgagtggtcaaaaactgtgaagatatttgtatgccatgtgagtgctcaccaatgggtgacctcagcagaggagcatgttaataatcaagtggatagtatgagccgttctgtggacaccactcagcctctttccccagccatccctgtcatcttccaataggcccatgaacaaagtggccatagtggcatggatggaggttatgcatgggctctgcaacatggacttgcactcaccaacactgacctagccatgaccactactgagtgcccaacttgccagcagcagagaccaacactgagccctcgatatggtacctttcctcaggatgatcagccagctaccttgtagcaagttgattatattggacctcttccatcatggaaagggcagcagtttgtcttcactggaacagacacttattccagatatgggttcgcctgtcctgcacacagtgcttctgccaagattaccatctgtggactcacagaatgccttattcaccgtcatggtattccacacagtattgcctctggccaaggcactcactttatggctaaagaagtgtgacagtgggctcatgctcatggaattcgctgatcttaccatgttccccatcgtcctgaagcagttgcattgatagaacagtggaatggccttttgaagtcacagttacaatgccaactaggtgacaatactttgcagggctgggacaaagttctccagaaggccctgtatgctctgaatcagtgttcaatatatggtattgtttctcccatagtcaggattcgtgagtccaggaatcaaggggtggaaacaccactcaccatcacccctagggacccactagcaacacttttgcttcctattcccatgacattacattctggtggcctagaggtcttatttccagagggagaaacgctgccgccaggagacacaacaatgattccattaaactggaaaataaggttgtcacctggacactctgggctcgtcctacttttaagcaaacaggctaagaaaggagttacagtgtttgctggggtgattgacccgggctatcaagatgaaatcaatccactactctgcaagggaggtgagaaagagtatgcaaggaatacaggagatccattagggcatctcttagtattaccatgccctgtgattaaggtcaatgggaaactacaacagcccaatccaggtaggactaccaatggcccagaaccttcaggaatgaaggtttggttcactccaccaggaaaaaaatccacagcctgccaaggggtttgctgaaagcaaatggaatacagaatgggtagtagaagaaggtagtcatcaataccagctacgaccacatgaccagttgcagaaacgaggactgtaattgtcatgagtattttctccttcttttctttagttaaaaacatgtttgtgcgtgtacacacttgtactaagaaaatatctttattttatttcttattttcctttatcatgtgacataagatgtgttgacttcatatcagcatttaagtgtgttaactttatgtaatagcatttggattggggatcggtgcatttctggttgtatgaaggagagttgtattaactcccttaataaactccccttaatatgtacatctgtcctattagttctgtccctctagagaaccctgactaatacatattggttatttttatttttattttttgagacagagtctcgctctgtcacccaggctggagtgtagtggtgtgaactcggctcactgcgaactctgcctcccgagttcaagtgattttcctgcatcagcctcccaagtagctgggactacaggtgcgtgccaccaagcccagctaatttttgtattttttagaagaaacaggggtttcaccatgttgtccaggctggtctcaaactcctgacctcaagtgatctgcccgccgcagtctcccaaactgctggaattacaggcatgagccccaccacacctggcctatattgattgttaaaaggacagtgcagaaaagtgctgttgagaaataaggttgcccgtccctgccaagacatctaaaattgttttaaacctagatgcaattctgtatttgaaacctccagtcacctagtaggtgcaagaaaaagttgaaatatttcaaggtaatgttggcattcccagaaacaattccaaaaatgaggagacttactatcataaattataacagttgcttttaattgagcaacagcttatgggagagaacacaagcgcccatctccatcttgtataccctgtctttatggttggttcatttgtagttagatagaagccagtatatcattccaatgttttcatttctgttcagcagttaacatctgttgtgatgtggaactgcaaggtgaaagcagcttggattcctgggtgacgtgagagccatgatccgctatggattagtttattattccataactaaatactacagactgtgtgattaaacaatagaaatgtatttattcacatttctggaggctaaaaaatccaagatcaagatgttgactggtttgaattcttctgtgggctctctttggcttgcagatggccaccttctcgctgaatttttacatgattgtccctctttccgtgtgtctgtatcctaatctcctcttcttgtgaagacgccagtcatattgaataagatcctaaccataaaacctcatttccccttaattacctcttcaaaggctctatgtccaaatgcagtgactttgtatgtgtgcattttgaggaaggggtataattcggcccataacaccctgccaactaaaatcagaatttctatgcacaaaaataaacttgttgtgttaaatcatttaaatttcaggaaatgttttcattccattagctcactgttactttatctgactattacactgctcctcttccttttattaggcttactttaatgcttttcttacaaataaatactgcatatattattgttgcaaaaaaaatgataaaaatacatggaaatcacaattctctcctctgcaaagttcctccaaaattcagccccctactcagaactttccacaatgtggtgtgtaaattttaaaagctaatttcaagtttttaaaagatagatgtggtaatgtgtgtgtgtatatatatatgcatatataaatatatatatttatatatgcatatataaatatatatatttatatatgcatatatttatatatgtgtgtataaatataacaaaacatgagtaatgacatacatgtaaatatgccacttgcctttgccactctgataggttcaattgcattcccctaaagttctatcttgaaattaaaaacgtgacattatttggagataggattatttcagaggcaatcaagttaaaatgaggttattaatgctggccctaatcaaatatgatgggagtcattttaaaaaggggaaatttggacatagagatatgagtagaaggatgataatgtcagcatacttggactgaagacagccatctacaaggcaaggagagaggcctggaatataacttttcatcacagccctcagaaggagtcaaccttgtatacaccttgctttttgactaccagactccaaaactgtgagacaatatatttccgttgtttatgtcatccaggctgtggtacattgctatggcacccctaacatgccaatataatcatttattgaaatggatccaagatcgttccatgacagcacaaatgttaataaatctatcttacttttgcaactacttcctagaattccagtttatttctgtgcaataatgaattgaacaaatcttctgacagacaaatatatgtttatcttttgtggctataattcatgtaaataaaatcaacatctctgagcataaattctgggacaagtacatataattacttataaggaatgcattttaatgaggaaactgagtcagtatgaatattttctattttttaaatgttactgacttttttcctaaaatatttcaccaattaattctctcacattaacagaggaaattattattatttaataataatgattattattattccccataattgtctatggggaaatgattcatttattcacaaacacattttatcagagttttaaatgtttgtcaaacttatgggggcaaaccctaggtgactttgggtttggtgatgacttttttagatgtaacaccaaaatttggttaaacttatgggtgcaaaccctaggtaaccttggttttgatgacggctttttcagatgcaacactaaaagtaccagctacctaagaaaaaagagataaattggacttaattaaaactaaaaacttttgctctgaaaagtcactgttaagatcttgaaaagacaagccagcgactggcataaaagttttgtgaaacacatatctgataaaagatgtatatttaaatatgcacaaaacgctgaaaacccaatcataagaaaacagaaaacccaatttaaagtggacaaaaactataaataagtacacaaacaatgaatatataggaatttaaaatgagcatattaaagagttcaatgtcatatggcattttagagaagtgcaaattaaagcacctaggagatagcgctctacacccaggagaatggctgacgtccaaaacactgaaacatcaaatgttgacctgtatgttgagcaacaggagctttcagtcattgttagtaggacagacctggaggaatcataaaagcataaggctaagtgaaagaagaaaatcttaaaaggctacataatgtatgattccaatcatacaatatttagaaacagttcattatgaatacactaaaaatatcagtggtttccggaggctgaggagttagggttggggcaagggggattgataggtggagcacacaagagatttaaaatggtgtaacaagtctgtgtgatactgtaatgatgaatactcaccattacacacttatcaaaacctacagcatccccaacgttgagtgattcctgatgtaaactgtggacttgacctaataatgaggtatcaatacaggtccatcagttgttgcaaacatgccataataatacaaaatataaataataggagacactgtgtgtgtgtgtgtgtgtgtgtgtgtgtgtgtctgtgtgcgtgcatagggcagggcaggagggcaggaattgggggggggggcgtagatatgtgagaactctgtaactttgatgaagttttctctctgtatttttggattagcaatgctctaaaaatgatgtctattagtttttaaaaagacacaaatgatttgaagagaatataccaatcaggaaaaggcatataaaaagatgaccaacgtcatttgtcattaggaagatgcaaacaaaaaacaaaggagattcaaatacaggcttattagaatggctgaaatctgaaaatctaaaatactaaatggaagaggggatatgcaacaagaggaattctcattccttgctagttgagatgaaaaatgatgcagccagacttttaaatccatgttttgtggacctactcatatgacaaattgtgaaagttaaaactatatgaactgcaaacagagcatagttgctagagtctttggagaagtgccttgactgacctcaaaagagatgcacaggggacttttcgggtgatggaactggtcagtgtgacacttggttcgtagatatggaactccacgcatttgctaaaatacatataatttcacataatagttaaatctgatgagtgtattttaaaaattaataaaaattataataaaaattaatgacattaaattaataaaatgttaaaaataatttttttaaaagatcacgcacaggctgctgaaaagacaatggatttttctgggacaaggatagggaaagaagaaaactaagggagcctttgacataggtcaggagagagattctattaacttcacacacggtagtacttaaagtagaaggttttggaatggattttagaggatgacagaacaactgttgctgtcgggacaggagaaggggggagtgccggccctggaaggagtaaaaccttgaggaagactgaggggccttcccacctcatttcagacacggggcagcttcagttaagcagagaaaggagccccggggctggccaacaagcaagaagggaactctgtggaaggatagctatctcccaacacggagggaaggcccaggcgtcgcccagccactccttgctgtcacccctggacaaaacagatggagaggtgaaaacggagaggtgggcagggagaggtgggcgaagggcagggaagtggacaggaacaggtgggagtggggaggtaggcaagaaggggtgggagggggcaggttggtaggcccgaaggggtgggaggaagttgggaggtgggtaggaaaaggtgggagggagtgggaaagtgggcaggaaggagtgggagtggtgggaatatgggcaataaaaggtgaaagggggcagtaggtgaacaggaaagggtgggaaggggcggggaggtgggcattaaggagaggaaggggtcagggaggagggtgggagggggtagggaggtgggcacaaaggggtcggggggcgctgaggagggcaggaagaagtggagtgcggggaagtggtcaggaaaaggtggaaggaggcggagaggtggggggtggtttttccatggagaggaggccccaccccacgctgcctctgctgtcagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtaagggccctaagggagaactgagggacttcgcaccaaggacagaagaagccccggtctgccctgcgctgccataggacttgcaggccacagacaggaagatggccgccgagggctgaccgaggcgtccccacaacagaagaagggaggaggtgccagccctctagggaataaataggaagacattgaggaggactgggggaacccccacctcagaggacagcttcccagagattcccaccctgctcctcatatcagccctcgtagagctcctcagtcagctcaggctgagcggcagtcctctcattgctgggggaggggtggaggggagggggaggggtggaggggaaggggaggccttggtctggggggttccatgacaagtcagcagggagagttgcctccagttggcagagggaagattcccaggccctgctggtgataagagtgaggacggagaggtcccacgtgcatcagaacagacgtgaggccaccccgactgcccccgtggtagagtgctgggaggtggctgccacctcgctacctcccgctgctctcagggatgtggagtttgccctgagttttggccagaagagtggtagggacatggccctgtctgagaaaaggtgaggatgctaattaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggtgagtgcacgccctgactgtgtaccaagggccctacccccacaaacagagcagacctggcagcacctggccatagccacctactgccattcctggtgcctcaggctctgcctgccagctgtgccccgaggtgctttctcacatcctcctacaggttctgagggagcaaacctcttaggaagacaggcgacctgtgaggccctagagcaccaccttaagagaagaagagctgtaagccagcctttgtcagaaccatcataggtgagtttctcagctgaagctactcacactgtcactgtcttcctcaggcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 1434 - DNA, 3167 bp, Homo sapiens
gaaaggagccccggggctggccaacaagcaagaagggaactctgtggaaggatagctatctcccaacacggagggaaggcccaggcgtcgcccagccactccttgctgtcacccctggacaaaacagatggagaggtgaaaacggagaggtgggcagggagaggtgggcgaagggcagggaagtggacaggaacaggtgggagtggggaggtaggcaagaaggggtgggagggggcaggttggtaggcccgaaggggtgggaggaagttgggaggtgggtaggaaaaggtgggagggagtgggaaagtgggcaggaaggagtgggagtggtgggaatatgggcaataaaaggtgaaagggggcagtaggtgaacaggaaagggtgggaaggggcggggaggtgggcattaaggagaggaaggggtcagggaggagggtgggagggggtagggaggtgggcacaaaggggtcggggggcgctgaggagggcaggaagaagtggagtgcggggaagtggtcaggaaaaggtggaaggaggcggagaggtggggggtggtttttccatggagaggaggccccaccccacgctgcctctgctgtcagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtaagggccctaagggagaactgagggacttcgcaccaaggacagaagaagccccggtctgccctgcgctgccataggacttgcaggccacagacaggaagatggccgccgagggctgaccgaggcgtccccacaacagaagaagggaggaggtgccagccctctagggaataaataggaagacattgaggaggactgggggaacccccacctcagaggacagcttcccagagattcccaccctgctcctcatatcagccctcgtagagctcctcagtcagctcaggctgagcggcagtcctctcattgctgggggaggggtggaggggagggggaggggtggaggggaaggggaggccttggtctggggggttccatgacaagtcagcagggagagttgcctccagttggcagagggaagattcccaggccctgctggtgataagagtgaggacggagaggtcccacgtgcatcagaacagacgtgaggccaccccgactgcccccgtggtagagtgctgggaggtggctgccacctcgctacctcccgctgctctcagggatgtggagtttgccctgagttttggccagaagagtggtagggacatggccctgtctgagaaaaggtgaggatgctaattaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggtgagtgcacgccctgactgtgtaccaagggccctacccccacaaacagagcagacctggcagcacctggccatagccacctactgccattcctggtgcctcaggctctgcctgccagctgtgccccgaggtgctttctcacatcctcctacaggttctgagggagcaaacctcttaggaagacaggcgacctgtgaggccctagagcaccaccttaagagaagaagagctgtaagccagcctttgtcagaaccatcataggtgagtttctcagctgaagctactcacactgtcactgtcttcctcaggcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtga

SEQ ID NO: 1435 - DNA, 69204 bp, Homo sapiens
ttagattgtaaaagtttattgatatggtcaaaaagcaaacagccagacatttggttatctttgccactacaatgtgtcattctgaactgtatcttaaaaatgcataacaaatgatatttaaaccattaccagaaaagtaaatgaagagtctacttaaggcacttcatatgaaagctaattcaaaattttcacaaaagtcacactattttataagtgtagtaaattaccttctacacattttagccagaatgctgcctttctccttacagaagaatgtgctcttaaagggagaaaaagcaaatacaaaaaattgtcattctgtcaatgttcatgacaaattatctggaactatacagattacatggcagtagtattcccgtggtcaatctgtacaaatcagggcatcttcatacaagtctcataagaaccacagcatagatttggcctgagacaagtacaagaatagcaggtaaggaattcagaatctcacaatttacaagtgagtaattaacaaaaactggctgctccattaaaaagtaaaaggtcaaccatatcccctcatccatgaaatctagtaacgaaaaacaaaaaacccacataaaatatttcttctgaggctactatatccatctctttctgcaaaccacatggcagggttattagaaggtaaatggcaggtggcagtcatagtatctttttaatgtaatacttgtaagatttccttaaaattattttttcacaattacaattatcctatttccacaatagtggcatttcaggttactcttcataactatgggggaggttatagttagatataatgataaccatgaaaacattcttcacagaaatttggttagcacatatggttatttctactgacagaaaccaaaagacaaaataaaaaaaatcccttcaaattggtactttgtttctccacctaaaggaagagaataaagactaaaataacagcaaaacatagaacagctttcgagaaacgcttaatttctatatacaggcatcagctcaatattttatgatttttctttcccattctaagggagtccttttctttcttacttttttttttttttttgagatggagtctcgctctgttgccaggctggagtgcagtggtgtgatcttggctcactgaaacctccatctcctgagttcaagtgattctcgtgcctcagcctcctgtgtagctgggattacaggctcctgccaccacacccagctaatttttatatttttagtagagacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtacaaatggaataagtgacaaactctaatttgtagaaacattttaggccatgtataagttacactgattttagcactaagctatatttttatcacagatgggtcaccttaaaagaaaactaaggagatggaatgaatctgaaatctttctaaatacaaggtagttaacaccatactcaagcagaaattataatcctgtatttagagatacttttttttgagacagagtctcactctatcactcaggctggagcgcagtagcgtgatctcggctcactgcaatctccgcctcccaggtattaagcaagtctcgtgcctcagcctcccaagtagctaggattataggcatgagccaccaagcccagctaattttcatatttttagtagagacggggttttgccttgttggccaggctggtctctaactcctggcctcaagcaatccacctgcctcggactcccaatagatgtcttttcatgttcacagctatcgagaagcatagacattgctggtgtggtagctcacacatgtcatcctcgcactttgggagactgaggcgggcggatcacttgagcccaggagttcaagaccagcctggacaacttggcgaaaccctgtctctactaaaaacacaaaaattagcctggcatggcggtgcacacctgtaaatcccagctacttgggaagctgtgacaggagaatcgcttaaacctgggaggcagagtttgcagtcagccgagctcacgccactgcactccagcctgtgtgacacagcgagaccgtctcaaaaaaacaacaaaacaaaaacaatcatagacagcactgtatttcagtaggaaatatgcaaggaggaggagaaacaactgtcttgctgagggctagacgtgtgctctgaagaatggtgttccattttcagaagaccacatgacacacataatttctctactcaaaaggaaagatgcgtaaagtatacacatccacacaaagatgaagaagctaagaatgaattcctaatgtagttatctgtaacaggcatatgtgggaacacctggtcaggacttactttccccatctttggataaggcaatataaaatcagatgaccaagttaactaaagtagttttgagctttgttctaactaaaacaaagtagtagttttacaatttttataatatacttaattgtactaaattaaatgttccataaagttcactgggaagagaaggttaagaggataattattttcaaatacctcagattttgacagaggattgcttgttaaggcactacacatcttctttggttaaatgattaactatttaaatcacttgaaaaaaagaggtaatacaaaatatacaagttgcattcttcttttcaaacacacacgattttcgtttttcaatttccagtactccagtgtctatatatctctgggacctttttaactcatcagaaagctgaaacaaaaatatattccaatctattagtctctgaaagaaaagtaggatttacttttaatcaataagcagtatgttggttttaacagataaaagagcattttggtacgtacatgataatctttgggtatcaataacaaaaagtgagaaacactgagagacccgttagtcttatgacaaaaggaaatagaataacctcaagttaaaatatctcctgaatagagacactaattaataattttattttttcatttttttagagatggggtctcactgtgttgcccagtctggtctgggactcccacgctcaagtgatcattctgtcttagccttctgagtagctgggactacaggcacatgacactgctattgaatcaactctgctgatcaaataattaacagaagtcccagcaaaattaccttcacatctcaattagtattctgtagaggataaattattataattattatttttgagatggggtctcactctattactcagactggagtgcagtggcactctatttcttaaaaaaaagtagaggcgagaagaagtttttaacattaaaaaaaatcatttcttcttcaaaaggaagtataatatgcagacaaggagctatgtgaatagataatggcataaaatgttctaatcattatgtatttctagaatacatatgagatttctagaataaattaggtatggcaaaataaatctaaaagatgttcctgagaaatcacatactaatattgtccattatactataattaatttttatatgggaacatatctgaattacagctgtttgggcatggtggctggctaatgcctataatcccagccctctgggaggctgagcaggagactcgcttgatgccagaagttcaagaccagcctgggtaacatagcaagaccctgtctttacaaaaaataaaaatattagctgggtgtggtcatgtgcagctgtagtcctagcctcttgggaagctgaggtgaaatgatggcttgagctcaggagttcaaggttacaatgagctatgaacacgccattacacttcagcctgagtgacagagtgagaccctgtctctgaaaataaatgaataggccgggctcagtggctcatgcctataatcccagcactttgggaggatgaggcgggtggatcacttgaggtcaggagtccaagacctgatcaacatggtgaaaccccgtttctactaaaaatacaaaattagccgggcatgctggcacacgcctgtaatcgcaactacttgggaggctgaggcaggagaatcgcttgaacccgggaggcagaggttgcagtgagccgagattgcgccattgcactccagtctgggcaacaagagcaaaactccatctcaaaaataaataaataaataaataaataataaataaatagatgaataaataaaaataaagcctatatctttcctttataagctaaaatagtttggaagcaaagcaaaaagaaggatattataaagcaatatcaactctaatcattccaggtattggtaatcactgtataaacaaaaaataagaatcatacctgtatgggtagccatgatatttagatctaaaaatagagagcatccaactgaagaataatacaacaagtccaataccagccacacacattactgcagaaaaataaaaggagagtaaaatgagcaggttgagtataataaataaccatggcagtctatactttctttttttattttattttattttattttattttattttattttattttattttattttattttatttttgagacggagtctcgctctttcgcccaggccggagtgcagcggcgcgatctcggctcactgcaagctccgcctcctgggttcatgccattctcctacctcagcctccagggtagctgggactacaggcgcccgccactgcgcccagctaattttttgtatttttagtagagacggggtttcaccttgttggccaggatggtctcgatctcctgacctcatgatccgcctgcctcagcctcccaaagtgctgggattacaggcttgagccaccatgcccggcctggcagtctatactttcagagagtgaaaaggaaggggtatacattattgataaatctcaacttttcaacaattttcatccctatttcttaatcttcaggaatctgccttcccctttaatttgctccattacaatgtaatagagtaactcctttacataattatgcaattcaaatgtatgaaataatgaattcctttaaagtcatcacactgaaaggtttactgttagaaacactgttacaatcgacaagaaaatcacccatttggttttttggttttcttttttttttttttttgagtcagggtcttgctctgttgcccaggctgaagtgcagtggcacaatcacagctcactgcagtctcaacctcctgggctcaagcaatcctcccactacagcctcttgagtagctgggactacagatgtgtgccaccatgcctggctaattttttaatttttttgagaagacggtgtctcactacattgcccaggctggtgttgatctcctgggctcaagtgatcttccgcttcagcctcccaaagagctgggattacaggcatgagccacggtgcccggcttacttatttattgaactttaaaacccctaaaagtggccttgtagtattgataaacattaacttagacatctgatgacttcattgtgatagcctcacttgaaagtactttattcatgcacagataactacacagccttatatatgtaactcaataaacatggatttcttatttgaatgagaaaaaaaatctgatccctagccctagattcatagctctctccactaatcccacatgtcatgtcctacattagcacagcagttattaaagtgaactacaaatactaatccccaaatgcgcaagtatggattgtcatgatgtgaagctctttcaatccccggactaaaaatggctaagaactatagagatagggatgtagggaagcatgtgtccaacagcaaaggaagctctagggcaggggtgtccaatcttttggcttcccagggccgtactggaagaagagctgtcctgggccacaaataaaatacactaacactaatgatagctgataagctgaaaaaaaaaaaaattgcagaaaaaaaccctcatgatgttttaaggaagttgacaagtttgtgttgggccgcatgtggcccacagactggacaagtttgttctagggtaacatacttagtgactgataagaaaatcaattttcggccgggcgctgtggctcatgcctgtaaccccagcactctgggaggccaaggcgggtggatcacgaggtcaggagttcaagaccagcctggccaagatgatgaagccccatctctactaaaaactacaaaaaaaattagccaggcgtggcggcaggcacctgtaatcccagctactcgggaggctgaggcaggataatcgcttggcaaagcttgcagtgaaccaagatcgcgccactgcactccagcctaggcgaaaaagcaagcctctgtctcaaaaaaaaaaaaaaaaaaaaaaaaaaagaaaagaaaagaaaatcaactttcagttttgttttacttatggaacaattcttttgccttttctaattgttacacaatatgactagggcttaatgtgtaaatgttaaacaatatttctctttaattcttttctaatttacaaaaaagaagtgcagcttgctgccaatgctcatttaattttatataatcacgctgtttgaggctgaagtaaatctgactgattttcaatgtgaaaataaaacaaaaactgttgttggagttattactaaacagaactaacatcagaatcgtctgaatcatcacaatagtctatttcagaaaaattgaattcatcaaatgaatctttggccaacaactgttcgagaatggtgtaaacattacacgtggaatgctacattttctaggatttgacattttcagtgatcaagaattactatattttgtaaatggaaataccactataatggaaataaaaatggactgatgtctagtatattagtatattattctatttacagcactctgttttcagtagtggtaatggatcacttgaacccagtgatatctaacatatcaattttgtttccaaagttgatatactagagtggatgtgaaaacaataattaaagcacgatattttgtggcagagttatctcagcgtaaacactgcagccacaagcactgccagtgagtattctcagggcaaatgggaaaagggttaacttaaccaaagaagtgaaagaactctatgatgaaaactataaaacactgctgaaagaaactgaagaggacatcgaaaaatggaaagatgttccacgttcatggattggaagaatggatgttgttaaaatgtccatactatctaaagcaatctatagattcaatgcaatccttattaaaataccaatgacaacttcacagaaatagaaaaaacaaaatttatatgaaatcacaaaagaccaatgatagtcaaagctatcctaagcaaaaagaacaaaactggaggaatcatattacttgacttcaaattatactatagagttatagtaaccaaaacagcatagtactggtgtaaaaacagacatacagaccagtgggacagaagacagaactcagaaacaaacccatacacctacagtgaactcattttcaacaaaggtgccaagaacatccactggagaaaacacagtctcttcaataaaaggtgccaggagaactggatatccataggcagaacaaaactagacccctatctcttgccatataggaaaatcaagtcaaagtggattaaagacttaaatctaagactgtacaccatatatatatatatgcatatatgtatatatatgcatatatatacatgtgtgtatatatatgcatatatgtatatatatgcatatatatacatgtgtgtatatatgcatatatgtatatatatgcatatatatatatacatgtgtgtatatatatgcatatatatatacacacacacacataaataaaagacaagagtcttgctctgttgctcaggctggagtgcagtggcatgatcttggctcactgcaacctccacttcctgggccaagcaatcctcctgcctcagcctcccaagtagctgggactacaggcacacaccaccacacctggctaatttttgtatttttagtagagacagggtttcaccatgttggccaggctggtctcgaactcctggcctcaagtgatctgcccttcttggcctcccaaagcattgggattacaggtgtgagtcactgtgcctggcctaagactgcaaactattaatatgaaacaactataagaaaacaatggggaaactctccaggacattagtctgggcaaaaatttcttgagtaataccccagaagcacaggcaaccaaagcaaaaatagacaaatgagatcacatcaagtttaaaagcttctgcagagcaaaggatacaatcaacaaagtgaggagtcaatccacagaatgggagaaaatatttgcacagtacccatgtgacaaggggttaataaccagaatataaaaggagctcaaacaactctacaggaaaaaaactaatgatctgatcgaaaaaacataaaatcttttttttttttttttgagacggagtcttgctctgtcgcccaggctggagtgcagtggtgtgatctcagctcactgcaagctccacctcccgggttcacgccattctcctgcctcagcctcccaagtagctgggactacaggtgcctgccaccatgcccagctaatttttttgtattttttttcagtagagatggggtttcactgtgttagccaggatggtctcgatctcctgacctcatgatccacctgcctcggcctcccaaagtgctgggattacaggcgtgagccaccgcaaaaaaagaaaatatttcaatagacgtttctcaaaagaagacatacaaatggcaagtaggcataaaaaaactactcaacatcaatgatcatcagagaaatgcaaataaaaattgcaatgagatatctatcatctcaccccagctaaaatggcttatatccaaaagacaagcaataataaatgctggcgaggatgtggaaaaaagggaacccttgtacactgttgtacactgttggggggaatgtaagttagtataaccactaagaagaacagtttggaggttcctcaaaaaactaaaaattgaaccaccatatgatccagcaatcccactgcttgggtatacacccacagaaaaataaatcagtataccgaagagatatctgtactcccatgtttgttgtagcactgttcccaatagccaacatttggaagcaacctaaatgtccatcaacagatgaatggataaagaaaacgtggtacatatatacaatggagtactattcagtcattaaaaaaataagatcctgtcacttgcaacaacatggaactggaaatcattattattattgttgagatggagtctcgctctgtcacccaggctggagtgcagtggcgccagcttggctcacttcaacctctgccttccaggttcaaacaattctcctgcctcagcctcctgagtagctgggattacaggtgtgcaccactacgcccagctaatttttgtattttagtagatacggggttttaccacgttggccagggtagtctagaactttctgacctcaaataatctgccccacttggtctcccaaagtgctgggattacaggagtgagccaccatgcccagccttggaagtcattaagtgaaacaattcaggtacagaaaaaaaaatcatatgttctcacttatttgtgggatcaaaaaatgaaaacaattgaactcatggacacagagagtagaaggatggttaccagaggctgggaacggtagttggggaatgccgggggaagtacggatggctaatgggtaccaaaaaaaatagaataaataagacctactatttgatagcacaacaggataactatagtcaataataatttaattgtacattttaaaataactaaaaaagtataattggattgtttatgacacaaagggtaaatacttgaaggatggatactgcagtctccgtgatgtgactattacacattgcatgcctatatatcaaaacatctcatgtatcccataaatatatacacctactatgtacccacaaaaattaaaaataaaatacttttcctgagtattaacacatgctgagtgtagacaagttagccttttattctctaagaaaatgtactcatagactgcgtgtgatggctcacgcctgtaaatcacagcatttggggaggccaaggcagaaggattgcttgagcccaggagttcaagaccagcctggacaatgtagcgaggccccatctctacaaaaaattacccaggtgtggcagtgcatgcctgtagtcccacctactaggaaggctgaggtgggaggatcacctgagccagggaggtcaaggctgcagtgagttatgatctctccacagcactccagcctgggcgacagagtgagaccctgtctcagatttaaaaaaaagaaaaagaaaatgtgcacatacgtatatacagcatcactctgtatatatttgtatcctcctcttttcatacatctaaaagtgcttagagcagttcccagaacatgctaaagaaacgtctattaatttgtgatcattttgttaggtaagaaacttaggagatcaaattgtgactatttcagtatatgttgccaaaatgtttaacaatttaagttcatgtcagtaatgtactttgatggccttttcccaagaataaacactgaaataggcaatttttaaacagtcaggcaaagtctacagccatagcaccctgaacgcgcctgatctcgtaaaaagtcaggcagtgaaaggacatatactgactggattaaaaactataaaatgcttactttggcagcatatatactaaaactggaatcatacagagaagattagcatggcccctgtgcaaggatgacatgcaaattcgtgaagtgttccatatttttttaaaaaaattttaaaaactgatacattaattatttttctaacacgtaaaaattcatttttttagagattgagtctcgctctgctgcccagactgaagtgcagtggtgtgatcatagctcactgcagcctctaactcctggcctcaagccatcctcctgtcccagcctcacaagtagctgggactacaagtgcgttgtaccacatccagctaaaaaaaatctattttaattgagcaaaacaagtatttctcaaattttaagttcagtatcttcatcttttttctagaagttaaagtaaatattagactttatttaggtagggtaatttttatgacatttaacttttttatttatttatttattttgagatgaagtctcactccgtcgcccaggctggagtgcagtagcgcgatctcggctcactgcaacttccgcctcctgggttcaagtgattctcatgcctcaaactcccaagtagctgggattacaggcacgtgacaccatgcctggctaatttttgcttttttagagacggggtttcgccatgttggccaggctagtctcgaactcctgacctcaggtgatccacctgccttggcttcccaagtgttgggatttacaggtgtgagtcaccacgcctggttgacatttaactttttaatcataaaaggaaaatcttgacttatttcatgaaagtaaaaccaaattacattgttagattctctctgcaacagataacaatgtgtgaatattctaatatataaaaagttcatgcaggctgggcatggtggctcacgcctgtaatcttagcactttgggaggccacagtgggaaaggttgcttgagcacaggagatacagaccaacctcggcaataaagtgagaccccatctctacaaaaaataaaattaaattaactgggagtggtggcatgagcctgtggtcatagctacctgggaagctgaggcagtaggactgctggagcccaggagttcgaggctacagtgagtcattattgtggcactgcactccagcctgggcaacagagtaaggcctggccttaaaaaaaaaaaaaaaatgtccagctgagcacggtggctcacgcctataatcccagaactttaggaggctgaggcaggcacatcatgaggtcaggagttcgagaccagcctggccaacatggtgaaatcccgtctctactaaaaatacaaaaattagctgggcgtggtgacgtgcacctgtaatcccagctacatgggaggctgaggcaggagaattgcttaaacccaggaggcggaggttgcagtaagccaagatcacaccactgcactccagtctgggagacagagcaagactccgtctcgaaaaaaaaaaaaaaaaattccttgcaaaccaaataaaagggctaagactctaacagataaatggcaaaagacaaaaggacaatttatagaaggaaaaacataaacacaaatgactagtaaacatttaggaaaatatttgaccttataaaaataaaaggagtacaaaataatacatttccaccttatctgattggcaaatatatatgtatctataaaacagatacatattaatgagattaatgctgataaaattacaatgaaatggctgggcacagtggttcatgtctgtaaccccagcactttgggaggccgaggcgggcggatcacgacgtcaggagatcaagaccatcctggctaacacagtgaaacctcatctctactaaaaatacaaaaaaattagccaggcatggtggcgggtgcctgtagtcctagctactcgggagactgaggcaggagaatggggtgaacctgggaggcagagcttgcagtgagctgagatcgcgccaccgcactccagcctgggcgacagagcaagactctgtcttaacaacaacaacaacaacaaaaccaatgaaacaaacattctttttttttttttctttaagatgaagtttcactcttgttgcccaggctggaatgcaatggcacgatctcggctcactgcaacctctgcctcccaggttcaagcgattctcctgcctcagcctctcaactagctgggataacaggcatgcgccacaacgcctggctaatttttttttttttttgagatggagtctcgctttgtcacccaggctggagtgcagtggcgtgatctcggctcgctgcaacctctacctcctgggttcaagcaattctcctgcctcagctgcctaagtagctgagattacacacgcacgccaccatgcccagctaatttttgtatttttagtagagacgggggtttcaccacgttggccaggctggtctcaaactcctgaccttgtgatccacctgccttggcctcccaaagtgctgggattacaggcgtgagccaccgcgtctggccaaatttttgtacttttagtagagacagggtttcatcatgttcatcaggcttgatggcctcgaactcctgacctcaagtgatccacccgcctcggtctcccaaagtgccaggattactggcataagccactgcgcccggccaaaacaaacattcttaaataccagtagtagaaatctaaattattttaacttgccaaaataatctgtaatgattaaaacatcaagagaattgaaaatactcagacagaggaccacacagttattcttcttctaggaatctaccttaaggaaacaatattaaataagaatgatggctgggcgtggtggctcatgcctgtaatcctagcacttcaggaggctgaggcaagtggatcacctgaggtcaggagttcaagaccagcctggccaacatggtgaaaccccgtctctactaaaaatacaaaaaaaaaaaagaaaaaaaaaaccccaaaaaacaaaaaaactagccgggcgtggtggtgggcgcctgtaatcccagctactcaggaggctgaggcaggagaatcacttgaacctgggaggcagaggatgcagtgagccgagattgcaccactgcactccagcctgggtagtaagagcaaaactctgtctcaaaaaaaaaaaatgatgcttaatgtatcatgatagttactgaagaataattatagttaaaattaggaaaaaactaaacattgaaaaaaatcggaatagttaaattataatatagagtataagtcagccaggcacggcagctcacgcctgtaatcccaacactttgggaggctgaggtgggaagatcacttgagtccaggggtttgaggccagcctgggcaaagtgacaaaaccccatctctacaaaaagtacaaaatataagctgggcatggtggcacatgcctgtagtcccagctactagggaagttgaggtgtgaggacagcttgagcctaggggcggaggttgcagtgagctatgattatgctactgcactccagcctgagtgacagagtgagaccctatcttaaagaaaacaaacaataacagagtataagtttaaaattatgtatatagaaaaagttattagttatttaactccagtttaaaaagggggtgtgaagtgtcaaaattttatatatacagtttttaaggtttttataagtggaaagaaatatattacaatttaaaaataattagtttttcagtggtggaatgtttcatgctcctgtttttttacattttctataatgagcatatattaattttaaaatagtaaaggagtttaataacagatatgacatttaaagaaaaaaatagtaaaggggtaaaataacctacttatcctataagtaagaggaaaagtgattaagagatcactctttttccatagtacaggcagcactgttacattttgagtaaggtgacttactctttcgctttccaatatccatgtcagaggtagcagcttcacataaaagcaccattcctaaggtaactccaccatctaagaaaaattgtttaaggagaaattcgcacagacaaaaaagacataccattttactatttccagtttctcatgaagaaaattaaaatgaatatataaaccttcaactcttcattataaaaaaccaaaataaggaatcttgtatctatacggcatgacaattatttactatgaagatacaaaaaattaaaattggaagattacttcatttgtgcaaagaaaaattgatattttaaacaaatgtcccaccataacttacagatgaaatatgagttttcccgaaattgtactttgaaataacctgtctggacattcagttattgccctgacctcaaacacatttaaaaatattaaatggcttttttttttttttgagacagggtctggctctgtcacccaggctggagtgcagtgacgcaatctcagctcactacaacctccacctcccaggctcaagccaccctcccacctcagcctcctgagtagctgcaactacaggtgctcaccaccacgcccagttaaattctgtaatttttttttttttttttttgtagagatggggttttgccacgttgcacacgctggtcttgaactcttgacctcaagcaatccacctgcctcggcctcccaaagtgctgggattataggtgtgaatgaccacgcccagccctaaatagccattttgaatatttcaccccacctccctaaagaacacatttgaaatatatatcatttagggagaacagtaactactttttatttgaaaattaatttctgaaaaatctctcctggcctagtttagcggttcacacctgtaatcctaacagtttgggaggccgaggcgggccgattgcttaagtctgggagttcaaaaccagcctgggcaacatggtgagaccctgtttctaccaaaaaatacaaaaaattggccaggctggtggcacatacctgtagtcctagctacttgggaggctgaagtaggaggatcacttgagcctggaaggttgaggctgcagttagccgtgatcataccactgcactctagcctgcatgatagaactagactgtgtcaaaaaaaaaattctccatattttcaataatactttattttttaaatttttcccatgccaagatgccaaaagtacatcaataattagcctttaaagcacaaattactactaacctatctaattttatcctattctaataaaaaagaaaaatcctggccgtgcgtggtggctcacgcctgtactcccagcactttgagaggcagaggtaggcggatcaccttaagtcaggagttcaagaccagcctggccaacatggcaaaaacccgtttctactaaaaatacaaaaattagccgggcgtggtggcaggcgcctgtaatcgcagctacttgggaggctgaggcaggataatcacttgaacccgggaggcagaggttgcagtgagccgagatggcactactgcactccagcctgggtgacagaacaagactccatctcaaaaaaaaaagaaaaagaaaaagaaaaatcccacatgtgccatgaccacacttttattcagcttaataggagctgcataaatacaaaatacaacaacccatacaaataggtaacagatggcatggttgaatattaaaataagcaagttcaaattttaaagcaaatagaatgtgttctagtagaaaagagagacagattcaccctgcagtttagtgaatactaacagcagtaaaacactcccaaatcaattatacatatgtacatacatgttgtatgctaccgcatgtgggtatcattaagcggaaagggaaaaatatgtgccctttagatgaggcctgaatttataattggctctaaaatttgacttgtcatcccttcattaccatcttgcattcttttttaaattttttaatttaatttatttatttgagacagggtctcactctgtcacccagggtggagtgcaatggcataatcacaactcactgcaacctccacctcccaggctcaagagatcctcctgcctcagcctcctgagtatctaggactacaggtgcataccacgccacgttcgttttgttgatttttttgtagaaacggggtctcactatgttgcccaggctggtctcaaactcctggactcaagcaattctccagcctgggcctcccaaagtgctggaattacaggcgtgaaccaatgtgcctgtgccccatcttgcattctttcttcaatagcctcttgttagggatgatgcccattcatcatgttttcagttgttcagccaagtctcttctccagcaattttttctgagttctttatctgcaggtttgtgcaaagattgatcatttcgttttttaaaatttttatttattatactttaagttttagggtacatgtgcacatcatgcaggtttgttacacatgtatacatgtcccatgttgctgtgctgcacccattaactcgtcatttaacattaggtatatctcctaatgctatccctcccccagtatttttttgccagtattttattgaggatttttgcatcaatgttcatcaggaatatttggtctaaaattctctttttttgttgtgtgtctgccaggctttggtatcaggatgatgctggcctcataaaatgagtcaaggaggattccctctttttctattgattggaatagtttcagaaggaatggtaccagctcctccttgtacctctggtagaatttggctgtgaatccatctggtcctggacttttttttggttggtaagctattaattattgcctcaatttcagagcctgttattggtctattcagagattcaacttcttcctggtttagacatgagagggtgtatgtgtccaggaatttatcaatttcttctagattttctagtttatttgtgtagaggtgtttatagtgttctctgatggtagtttgtatttctgtgggatcggtgatgatatcccctttatcattttttattgcatctatttgattcttctctcttttcttctttattagtcttgctagcggtctatcaattttgttgatcttttcaaaaaccagctccaggattcactgatttttttgaagggttttttgtgtctatttccttcagttctgatctgatcttagttatttcttgccttctgctagcttttgaatgtgtttgctcttgcttctctatttcttttaattgtgatgttagggtgtcaattttagatctttcctgctttctcttgtgggcatttagtgctataaatttccctctacacactggtttaaatgtgtcccagagattctggtatgttgtgtctttgttctcggtttcaaagaacatctttatttctgccttcattttgttatgtacccagtagtcattcaggagcaggctgttcagtttccatgtagttgagtggttctgagtgagtttcttaatcctgagttctagtttgattgcaccgtggtctgagagacagtttgttataatttctgttcttttacttttgctgaggagtgctttacttccaactatgtggtcaattttggaataggtgttgtgtggtgctgcaaagaatgtatattctgttgatttggggtggagagttctgtagatgtctattaggtccgcttggtgcagagctgagttcaattcctggatatccttgttaaccttctgtctcgtggatctgtctaatgttgacagtggggtgttaaagtctcccattattattgtgtgggagtctaagtctctttgtatgtctctaaggactcgctttatgaatctgggtgctcctgtattgggtgcatatatatttaggatagttagctcttcttgttgaattgatccctttaccattatataatggccttctttgtctcttttgatcttttttggtttaaagtctgttttatcagagactaggattgcaacccctgcctttgttttccatttgcttggtagatcttcctccatccctttattttgagcctatgtgtgtctctgcacgtgagatgggtctcctgaatacagcacactgatgggtcttgattctttatccaatttgccagtctgtgtcttttaattggagcatttagcccacttacatttaaggttaatattgttatgtgtgaatttgatcctgtcattatgttagctggttattttgctcgttagttgatgcagtttcttcctagcatcaatggtctttacaatttggcatgtttttgcagtggctggtgccggttgttcctttccatgtttagcgcttccttcaggagctcttgtcgggcaggcctggtggtgacaaaatctctcagcatttgcttgtctgtaaaggattttatttctccttaacttatgaagcttagtttggctggatatgaaattctgggttgaaaattcttttctttaagaatgttgaatttggcccccactctcttctggcttgtagagtttctgctgagagatcagctgttagtctgatgggcttccctttgtgggtaacccggcctttctctctggctgcccttaacattttttccttcatttcaactttggtgaatctgacaattatgtcttggagttgctcttctcgaggaatatctttgtggcgttctctgtatctcctgaatttgaatgttcgcctgccttgctagattggggaagttctcctggataatatcctgcagtgttttccaacttggttccattctctttgtcactttcaggtacaccaatcagacgtagatttggtcttttcacatagtcccatatttcttggaggctttgttcgtttctttttattcttttttctctaaacttctcttcttgcttcatttcattcatttgatcttccatcactgataccctttcttccagctgatcgaatcggctactgaggcttctgcattcatcacgtagctctcgtgccgtggttttcagctccatcaggtcctttaaggacttctttgcattggttattctagttagccattcgtctaaccttttttcaaggtttttaacttctttgccatgggttcgaacttcctcctttagctcggagaagtttgatcatctgaagccttcttctctcaattcatcaaagtcattctctgtccaggtttgtttctttgctggtgaggagctgcattcctttggaggaggagaggcactctgatttttagaattttcagtttttctcttctgttttttccccatctttgtggttttatctacctttggtctttgatgatggtgacatacagatgaggttttggtatggatgtcctttctgtttgttagttttccttctaacagtcagcaccctcagctgcaggtctgttggagtttgctggaggttccctccagaccctgttggcctgggtatcaacagtggaggttgcagaacagcagatattggtgaacagcaaatgttgctgcctgattgttcctctggaagttttgtttcagaggagtacccggctgtgtgaggtgtcagtctgtccctactgggggatgcctcccagttaggctacttgggggtcagggacccacttaaggaggcagtctgtccgttctcagatctcaagctgcatgctgggagaaccactactctcttcaaagctgtcagacagggacatttaagtctgcagaggtttctgctgccttttgtttggctatgccctgctcccagacctggagtctacagaggcaagcaggcctccttgagctgcggtgggctccacccagttcgagcttcccggccactttgcttacctactcaagcctcggcaatggtgggtgcccctcccccagcctcgctgccgccctgcagtttgatctcagactgctgtgctagcaatgagcgaggctccgtgggcgtaggaccctccaagccaggtgtgggatataatctcctggtgtgctgtttgctaagaccatcagaaaagcacagtattagggtgggagtgacccgattttccaggtgccatctgtcacccctttccttggctaggaaagggaattccctgaccccttgcgcttcccgggtggggcgatgcctcgccctgcttcggttcacgctcagtgcgctgcatccactgtcctgcacccactgtctgacaatccccagtgagatgaacccagtacctcagttggaaatgcagaaatcacccgtcttctgtgttgctcacgctgggagctgtagactggagctgttcctattaggccatcttggctgcacaaaggtcttttgttaatgtgatcatttctttctttttttttttttttttttgagatggagttttgctctgccactcaggctggagtgcagtggagccatcttgactcactgcaacctctgcctcccgggttcaagaaattctcctgcctccgtctcctgagtaagctgggattacaggcacatgccaccacgcctggctaatttttgtattttgagtagagacggggtttacccatgttggctaggctggtctcgaactcctgatctcaggtgattcactcacctcagcctctcaaagtgctggggttacaggcatgagccaccatgcccggccaaagattgatcatttctacaggctttgatttctgggtactctctgattaatgattgagacttgctctggggaaagcttgtctttttatcatggtttatgtgcttttgctttgaatgagctttccttcttgctaaatacctcaaggtcttttgtgtactcttcttagctgtcaagagctatgatgcagttctatgtatactgttttatttcatttactgatctttaaatttttactaacactgcctactatatggcaggcactataaactgttggaaataaaaagttgaacaaaataaagatcctaccatgaagaagattacactctagtgaggaatacaaacaatgaaatacataaattacacagtcctgattaaatgttactccaggagaactgagcagaaatagaggagacattattccataacatacaacaactaggctattaaaagctagtagaaggccaggcgtggtggctcacgcttgtggccaagacgggtggatcacctaaggtcaggagttcgagaccagcctgggcaacatggatatgatatatccattatataaacattaaaaatattgactacttttctttttcttcgtattttcagatttctttgtaatttttatgtatttttataaatataaaggccatacaacatagaaaatgcttataatatattaagatagcaaactccatacacaacatgtctacaagtataaaaaatgaacacccttaccatgaaacattcatatagaaatgaatgcaagataatatgcaaaagtaaatgtagtttatactattagggtttcaggttataggtgaacattttccagactgctactttattttaaaaattcaggaggccaaggtacgaggattgtttgagcccaggagattgagaccagcctggacgacagggcgagactccatctctagaaaaaaatacaaaaattagctgggtgtggtagtgctcacctatagtcccagctactcaggaggctgacgtgggaggactgcttgattctgggaggtcgaggttacagtgagctatggtgaccccactgtactcaagcctgggcaacacaagatttcatctctaaaaaaataaacataaaaaaaatccatatatatttattctgggattccatttattgtgttttctttttttttttttttattttgagacaaagtctggctctatcagccaggctggagcacagtggtgtgatctcagctcactgcaacctctacctcctgggctcaagccaccctcctgcctcagcctcccaagtagctgggaccacaggcacgcagcaccacacccagttaatttatgtactttttttagtagagaaagggttttgtcatgttggccaggctggtctcgaactcctggcctcaggtgatctgcctgcctcagcctcccaaagtgctggtattataggcatgagccaccgcacccagccctgtaggattccatttatgtaagttaaaaaaaaataggtaaaataaacccatagtgttagcagtcaggatagcagttatttctgggtgggaaggtggcaatcaggaggaatgatgatggaaaatgctctgagatgtgggtaaaattttatttattgatgtgagttctggttacataagtgtgttaattctgtgaaaattcatcaaactggactgggcaccgtggatcacgcctgtaatccttacactttgggaggccgaggcaggcggatcagttgagctcaggagttcgaaaccagcctcgccaacatgatgaaaccccatctctactaaaaatatcaaaaaaacttagccaggcatggtggcaggtgcctgtaattccagctactccagaggctgaagcaagagaatcgcctgaacctgggaggtggaggttgtaatgagctgggatcacaccattgaactctagcctgggcaacagagcaagactccatctcaaaaacaaaaaacaaaaaaccaaaaaaaaaaaaaaaaaaggaaattcatcaaactgtaaacttttgtaaacttttctgcataactgcaacacttaaaatgtaattttaaaggttgcttagatcaggcaactgattatatagtctgctttattaatcatgcaataaactgtacattaaactaataataaatatgtgaatattttccaaaatcataactactacttagaggtggcctcagtctattaattattatcaacctggaagctgtaaacaatgttaccggtcttgaggtttcatatttactttaaaagaaagtgggggccgggtgaggtggctcacgcctgaaatcctagcactttgggaggctgagatgggtggatcacctgaggtcaggagttcaagaccagcctggccaacctggtgaaaccctgtctctactaaaaataaagaaattagccaggtgaggtggtgcacacttgtaattccagctactcaggaggctgaggcaggaggatcgcttgaacccaggaggtggaggttgcagtgaaccaagatggtgccactgcactccagtctgggtgacagagcgagactccactcaaaaaaaaaagggggggggggtggggagtggttaggccttttctaatattccttacctctgacaaaattattcattttctcactatttctggtacacagcacttaagtcactgtcttataatctgtatacatgtctgactctgaaaaaagttcactttttgcatcctaataaccaaacacaagacattctatatcccaacaggattgtaatccgttccaaatgtatactaaaccttaggctgatgctcagtcttaaagcagaggtaaaatgacaattttctaatttcttaaacttcttatatatttaaaagtttaagacaaagctaaaagaccaacaaaccccaaatcaactaattaatactttacaattttaattgctcttttgctccattattcaatttcaaagtactagtgagaagaactgattcaagatactgaaaattttctaaggtataataatttgttaatccatcaaaccatacttttcttttctgttctttttttttttttttctttgagacagagtctcgctctgttgcccaggctggagtgcagtggcagtctcggcttactgcaacctccacctcctgggttcaagcaattctcatgcctcagcctcctgagtagttggaattataggtgcacactaccgtttctggctaatttttgtatttcttgttgagatgaggtttcgctatgttggccaggctgaatccatcaaaccataaatgaacattgtctttctttttttttcttttgagacaagagtctcaccctgtcatccaggctggagtgcagtggcaccatcttggctcactgcaacctctacctcctgggttcaagcgattctcctgcctcagcctccagagtagctgggattacaggcgcccgtcaccatgcctggctgttttttttttgagacagagtctcactctgttgcccaggatggagtccagtggtaccatctcggctcactgcaacctctgcctcccaggttcaagcaattctccggcctcagcctccccagtagctgggattacaggcgtgcaccaccatgcctggctaatttttgtatttttagtagagacagggtttcaccatattggccgggctggtctcgaactcctgatctcaggtgatccgcctgcctcagcctcccaaagtgctgggattacaggtgtgaggcagcacgcctggccgtctggctaagttttgtatttttggtagagacagactttccccatgttggccaggctggccgcgaactcctgacctcaaatgatccacctgcctctgcctcccagagtgctgggattacaggtgtgagccaccacacccagcccataaacgaacattttcaactaaaattttaggattaaaaaaaataaagtttgagtaatatttttctttcagtcttcccccgccccgccgcccgccccctgagatggagttttgctctaattgcccacgctggagagtaatcacacgatctctgctcactgcaacccctgcctcctgggttcaagagattctcctgcctcagcctcctgagtagcagggattacaggcacccgccaccacgctcagctaatttttttttgtatttttagtagagatggggtttcaccatgttggccaggctggtctcgaactcctgatctcaggtgatctacccgccttggcctcccaaagtgctgggattacaggcatgagccaccacgcctggcctcagtcttctttcttctcatatggactaggtgtatattgttaatctttcagcccaccatttcatggttgaatagattaattctcccaggtttgggctggatgtgaagcagtaagtatattttccatagtgcataagaacattttcccaaatatccttcaattaaaatcagttaaaatcaaaagcttaatatttttttagaatgctttccttaaaatctctctaatcatcaacatagtataataaaactgggaaagacatacacaaacatttactaaagatagaattttcagtggttttgaatttttttctttatacttatttgtattctaaattttctttaatttatattccttttgcaatcagaaaaaaatatatttaagtttcgttttttttcccttttttattagagacagggtctcactgtgtcgtccaggctggagtgcagtggtgtgatatcagctcactgttgccttgacctcctgggctcaattgatcctcccacctcagcctccctggtagctgggaccacaggcatgcatcaccatacttggctaattttttgtgtgtatttttttgtagagatggggttttgccatgttgcccaggctggtctcaaactcctgggctcaagcaatctacccatcacagcctccaaaagtgctaggattacaggtgtgagccaccatgcccagctgattcttgtatatcaatgtcaggacaccctggctgagaagcacaattccaggaacattacatttgttcaccttgttgatttgttccagagtcagtgcttatgtactcaggtgggtaaactatgtttagtcatattatgaaatttagattcttacttatctgacatcgcttttacctgtctttgcagcttacagaggcatccacttttagatataagaaaataaaaattagcttgggccaagaaagtaaaaatattccttgtcattcaagagaatggaacaacacaaacataaagcagctgcaaagtccacaggaagtatttttccctagcacacacttcagctgtaaaatgtcaaaatatccccatctttgagtaattactgttttcttactgaggaatattggtctttaaatagacttcttgcaattatatgagtaaaaatgaaatattcttgcttggcagatctaagtcactcaatttacacgtataatttctaagtagcctcaatttacaaccaaggtatagagcttcaaagaagaagtttttgaagacaaaaatcccacatttatgttaactttgtagtttccaagcaaacagaaccctgggtctgattgacagttcagacctgatgttgacccctttacacagccttacactgcttttagcctatcaaaacaatgctttgtttaaatttcacataaactccactattctcccaaatcctattacaactctatcttttctttgttaagatgttccatggttcttctaatgtacagtattcctcatattaatgagccaataaacctggccctatcagactacagatttgtccctagtagtctttggtttattgggctggagaggatgatacagtaatgattttcaaaggatattgtgacttgcattaagagaacagccccagccaaatgctgtagagagaatactagactgtgagaaaacagacaaaatacagcaagaaagacttattgtaaaaggatactaaacagaagaacaatgtgtgtttcagctacaaactgggcttgactgcttccatggatataattctaggagggaaaaaagacaaaatggaatctttaagtatacattaaatgttggtatgctaaccctaaaacggggtattttaaactatgaaattattaattcacctgataaaccatgtgacatactccgggtctgtggcattcatcagtaagtctggttactataaggctatttttgtattatctattctcgatttgtcttttcattgtactaatactatgtttatttttgagacagggtcttgctctgttgcccaggctggagtgcagcggcatgatcatagctcattgcaatcccaaagtcctggctccggtgatcttcctgcctcagcatcccaagtagatgggactacaagtatgcaccaccatgcctgctcagctaatttttaaattttcattagaaatgacatattgctatgttggccaggctggtctcaaactcctgggctcaagcaatcctcccacctcagcctcccaaatgcttgaatactgtacttatattttcaacaacagaatatgtcagaaaactagttgttgttgttgttttttcttttcttttttgtttttcatagagatgacgtctcactatgctgcccaagttggtcttgaactcctggcctcaagtggtcctcctgcctcagcctcccaaagtgccaggattacaggtattagtcaccacacctggccccattttttttttaaggagatggatcttgctatgttgtccaggctgggctagaactcctggattcaagtcatcctcctgcctcagcctcccaagtagctgggactacaaatgcaaaacactgcacctgggtgagaaaactagtatttaagtgtacaagaccatgaggtacaataatgtaggctccatgaagacagggatcatgtttttcttatcactatatttaataataattagcacagtgcttagaaacagtggatgctcaggtacttgatcaatttttctatttagttgaaggctgtctttcattcttagctagcttggttagaaggattcaccaaatgggaaaaggaacttcccacttttaagagcactgcggccgggtgcggtggctcatgcctgcaggcctgtattcccagcactttgggaggctgaggcaggcgcatcacctgaggtagggagtttgagaccagcctgaccaacatggagaaaccctgtctctactaaaaatacaaaattagctgggcgtggtggcgcatgcctgtaatcccagctactcaggaggctgaggcaggagaatcacttgaaccagggaggtggaggttgcagtgagccgagatcacgccattgcactccagcctgggcaacaagagcaaatctccgtttcgaaaaaaagaagaaaaaaaaaaagagcactgcatggtcttatcagtgatggaagcttgttaacacaagagagattgaaaagtgaagactaaatccagctccttcatatgctggcactgttctcacagggtaataatcattgagttaactttggtctacaaaggaaagaaatcccagacttcccttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaataatattttcagaacaactagagattttcatagagatgacagtctgtcatttaggttgaataaaaggcaggtacaatcagttccttgaagttctggccatccttatgagataatgaatgaaacaaactgattttaagacagaaaattaaaatatataaaactattttcctcaggtaagaaataaaatgctacttctcacataaataaaagcttacctaaaaatacactattaggaattttattcaaataattttttgtcttctgaaattcactcaccaaagctgcaaaagcccatccagttttattaaagagaaattccatattacttcttcgaagatacacaagtccaccaataacagccaaaagcaatcccaacataaggggaccagcataatttgggggtctaatcactctaatctaatggaaaggagagaaaaacatgttaaagtataaaatttttttactaattatatgggtcaaaataaaatctgaaatgaaagcaatcaaaattattgtggttactttcggaaaaatgatcctttttatgttatcccaatcaaactagtctataatataacctaaaataggatagaataggtacaatattctatttaaccacaacataacatcttttagattaagaaggatttgccaagtacaactagataatccatggacttaaggtcgaaagagtggtttccatgctgaattcaatagggtaatagagagtgttctgtaatttcactcattcatcaagatgattctgtttaatgctacttatgaagtgactgccaaactagtaccacctcagtgatatggggacaagactaattagggcctcccagtaagattcaaaggggataatggccaagaaacagtctacatagttgggaaacttacattgacatcagttctgtcggcgatccaccgggcaatctgctcagctgaaaaaccccgcacctgtaactcatatgtatcaccccgtttgggtttcccttttgcaggaaagttgatgaaagttggagctgaattcatgtttagctgaataaaaacgagccatgaaaatatacattatcaggaaaataatcttaattgcagttaacatcttgaaatttaggcattttacaaagatgaggaggcctgggtttaggtaggttaagtgatttggtttgcccaaggaaagtggtaagtggtggagcaggctttaaaagcaaagctgcctgtgaccttaagtattacatactactcaccaaatacacattcctcgctaagaaacctgtattttactccactagaatggaaactttgccataccacagatattttaatctgttcagagattatgcaaaatgaatacatttatgagcactaaaataatcttatgtagctgagtaagctccaaatagagtatattctcaatttggaggaaccaagataataaaataatgctctaaaacagcagtgaaaagcaatacaaaatggtggctatatgcagaaatagtctattctaagaaggtccataaatgtttactgatgagcaccacatttctctattctccatcatgacatcatgatatatttgagaagacaacaccggaaatactaaggtaaagaaaccataaccatctcatctgcattatatctttttttatttttttgagatggagtctcgctctgtcacccagactggtgacaatcttatagagattggcttgcacaaatcaatttttatttatttatttgtttatttttgagatggagtctcactctgttgcctaggctgaagcacagtggcaggatctcggttcactgcaacctccgcctcccaggttcaagtgattctcctgcctcagcctcccaaggagctgggattacaggtatgtgccaccacacccagctaatttttgtatttttagtagagacaggggttcaccatgttggccaggctggtcttgaactcctgactgcaaatgatccccccgcctcagcctcccaaagtgctgggtttacaggcgtgagccaccgtgcctggccttacaattataattttaaaacctcagccaataaaataatccaactcccatgctttgattctttagttaaaatccttctaacagtaagttttcaagctttcccataaggtgagagcatgtactgactgttgcttatcattattttggtctctttggctgtataatgtggtaaattaatgaattaatagattactcctttggttaccaatgtccatagatttatatgccttggtcagtaggcacaaaatccctagaggtagataaattctggctatcctgttaaaattcaatttctgtgattgcaaagctaggaaccaaatcttatacaatgttcagtctaccaaatgctgcccaaattttaggccaaactctttattcaatatttgtttagttacaccacctctacatttttgaaaatgtgtataaaaaataaaaactggccgggtgcggtggctcacacttgtaatcccagcactttgggaggccgaggtgggcagataatgaggtcaggagttcaagaccagcctggccaacacagtgaaaccctgtctctactaaaaatacaaaaattagctgggcgtgacggtgggcacctgtaatcccagctactcaggaggctgaggcaggagaatcgcttgaacccgggaggcggaggttgcagtgagccgagattgtgccactgtactccagcctgggtgacagagctagactccgtctctaaataaataaataaaaaataaaaaataagtaacatataaatacacttctcttgtaaaaaatatttttaaaaacattacatggttataaggaccaattctagtacattctggcagccacagttaccatttacagatatttttgaatttattcatatatatgtttataccaccagaaaacatataatattgctgttttaacataaatggtatcatattaatggtattttcctggttgtcttcctttttagcaactaaaaataatgttgcagtgaacatccttgcacatatctccctgtacccatgtgaaagtgattctctagaaatgggattgttaggtcatgggatagaaatattttttaattaaaatggatatagtgcccaggcacggtggctcacgcctgtaatcccagcactttggaaagccgaggcaggtggatcacttgaggtcaggagctcgagaccagcttggccaacatggtaaaaccccatctctactaaaaatacaaaaattagctgggtgtggtggtgggtgcctgtaatcccagttactcaggaggctgaggcacaagaattacttgaacctgggaggcggaggttgcagtgagctgagattgcaccactgcatttcagcctgggtgacacagtgagactctgtctttaaaaaaaaaaaaatggatatagccaaattgtcttccaaagtggctgtgccaaaatatacttctacttaacaatgcagtaatgtatccatttccctacatccttgccaaaagttgatgtgatgggtgaagactgtactttatcattatcatactattaatttgtgtttccctgtttactaataaaacatctttaaaacaaattagttatctgaaaacatctttgtttttttttcttgagaaggagtctcactctgttgtccaggctggagtgcgttggcgcaatcttggcccacacaatctccgcttcctgggttcaagcgatcctcctgtcttaccctctcaagtagctgggataacagggatgcgccatgacatccagctactttgtttttgtattttcagtagagacaaggtttcgccatgttggccaaggtggtctcgaactcatgacctcaagtgatccgcctgcctcagcctcccaaagtgctggcattacaggcgtgagtcaccatgcccggcctgaaaacatcttgtagcccaacgatacaatcaacagagtagaaagaaaacctgtgaaatgggaggaattatctgtaaatcatttatctaataaggagttaatattcagaatagtctgggcatggtggcttatgcctgtaatcccagcactttgggaggccaagacaggtgtatcacttgaggccaggagtttgagaccactctggccaacatggcgaaaccctgtctctactaaaaatacaaaaattagccaggtgtggtggcgcatgcctataatcccagctatttgggtggctgagacacgagaattgcttgaacctgggaggcagaggttgcagtgatccaggactgcgccactgcgctccagcctgggcgacagagtgagactctgtctcaagaaacaaacaaacaaaaacaaaataaaaacaacaacaaaaatttggaatatataaagacctcctacaactcaacaacaacaaaaaacttgatttaaaaaatgggcaacacaggtgggtgcagtggctcatgcctgtaatcctagcacgttgggaggccaaggcaggtggatcacctgaggtcgggagtccgcaaccagcctgaccaacatggagaaaccccgcccctactaaaaatatgaaaaaaattagctgggcctggtgacgcatgcctgtaatcccagctactcgggaggctgaggcaggagaatcgcttgaacccgggaaacggaggttgtggtgagccgagatcgtgccattgtactccagtctgggcaacaagagtgaaactctatctcaaaaaaaaaaaaggcaacacacacacacaatgggcaaagaacttgacatttctccaaagaagatatacaaatggccaacaaaacacatgaaaaaatgttcaatattactatcattatggaaataaaaaacaaaaccacaatgagataccacctcacactcataaagatggctattatccaaaacaaacaaacaaacaaacaaaaaaccccagaaaacaagaagtggttgcgagcatgtggagaaactggaaaccctgtgcaccattggtgggaagtaaaatggtgaatctgctatggaaaacagcatggaggttcccccaaaagattaaaaatagaattaccatatgatctagcaattctacttctaagtatataaccaaaagaactgaaagcagggtcttgaagagattatttgaacactcgtgttcatagcagtattattcacaatagccaaaagctggaagcaacctaagtatccactgacagatgtatgggtaaacaaaataaggtgtatacatacaatgcaatattattcagctttgaaaaggaaggaagttctgacacatgctataacatggatgaacattgaggacatgatgctaagtgaaataagccagtcacaagaacacaaatactatataattccacttatattaggtacctagagtagtcaaattcatagagacagaaagtagaatggtggttgtcaggaactgggggagtggggaactgaagttgtttaatggctataaagtttcagttttggaagatgaaagaattctggagattggttgtacaacaatgtgaatgtatctagcactactgacctgtacatttaaaaaatggtaaacataataaattttatattatatatatttacaaaacaaccccaccaaaaccccttgtagactctgaaattccttggaggttaatgaaccaaaataagatacactattttttggtaggtatcagttttcacatacgcttagcttttgcatactgtggcatatgacactgttacttagagaaagatttgaatctcttccacagatggacacactaccatccttatacctttggctctaaaatctagctctaaaatagagtaatggaaattaatattaaaaactattcaaggtacgaaagtgtacgtaacaaaaacaaaaatagacaaatgggactatattaagctaaaaagcttctgcaaagcaaaggaaacaacaaagtgaagagacaatctgttgaatgggagaaaatatttacaaactattcattcaacaaggaactaatgtccagaatatacaaaaaattcaaacaactctaaaaagaaaataaaacaaaaacaaaaacaaaaaaaattcaaatcactcaacagtaaaaaagcaaataatcccattaaaaagtggacaaaggacatgaatagacatttctcaaaagaagacacacatggccaacaggtgtatgaaaaaatactcaacatcactcatcatcagggaaacgcaaatcaaatctacagtgagatatcatcttctcccagttagaatggccattattattattattagaaaagctccttttctgctcatctgtctgttgcctccttgcaatacattttcctactttctctaataaatctgcctttctttaccttaaacgaacaaacaaacaaaaacagatgcaaggatatggagaaaagggaactcacggccaggcacggtggctcattcctataatcccaacactttgggaggccgaggcgggtggatcacctgaggtcaggagttcgagatcagcctggccaacatggtgaaaccctgtctctactaaaaatacaaaaattagctgggtgtggtgatgtgcgcctgtaatcccagctgctcaggatactgaggcaggagaatcgcttgaacccaggaagcggaggttgcagtgagccgaaatctgcactccagcctgggcaacagagtgagactccatctcaaaaaaaaagggaactcatacactgttggtgggaaattaaattagtatagccactatgaaaaacagtataaggccaggtgtggtggctcacgcctgtaatcccagtactttgggaggccgaggtgggcggatcacgaggtcaggagatcgagaccatcatggctaacacggtgaagccccatctctactaaaaaatacaacaaaaattagccgggcgtggtggtgtgcacctgtagtcccagctactcgggaggctgaggcaggagaatggcgtgaacccgggaggcggagcttgtagtgagccgagatcacaccactgcactccagcactccagagggagactccgtctcaaaaaaaaaaaaaaagaaaaacagtataaagatttcccaagaaactaaaaatagaactagcatttgatccagcaatgccactactgggtatgtatccataggaaaggaaatcagtatatcaaagggatacctgcacccccatgtttactgcagcacaatagcaaagttatggaatcaacctaagcatccatcaacagacgaacagatcaagaaaatgtggtattaggccaggcgcagtggcttgcgcctgtaatcctaccactttgggaggctgcggcaggtggatcagttgagctcaggagttggagggagaccagcctggccaacatggtgaaaccccatctctactaaaaatacaaaaaaattagccaggcgtggtggcgcacacctgtaatcccagctactcgagacgctgaggcaggagaatggcttgaacctgggaggttgcagtaagccaagattgtgccactgcactctagcctgggcgacagagaaagactccatctcaaagaaaaaaaaaatgtggtgtgtatacacaatggaatactactccaccataaaaaagaatgaaatcatgttacttgcagcaatatggatggaactggaagttattatgtgaaataagccaggcacagaaagacaaatatggcatgttctcatatgtgggagctaaaaaaattgaactcagggaggtacagagtagaatggcagataccagaggctgggaagagtgtatgtgtgtgtgttgtggtgggcggggtgggggggaggggtgcgggagcgggcaatgaagagaggtcagttaatgggtacactcatacagttagaaggagtaagatctaatgttccatagcagagtagcgtgactataattaacaaaaatgtattacatatttcaaaacagctagaagagaggacttgaaatgttcccaacatatagaaatgataaatactcaaggtgatggatactccaactatcctgacttgatcattctatgaatctaacaaaatatcacatgtaccccataaatatgtacaaatattatgttatcagtaaaaaaactaaggtagaaaaaaatgggttttctatttttacaaatcactaacagaagttatgtgttaccttgttaaaataaatggaattaaaaattgtaatttccaaaaataactgcagcctaaatagtagagaattaaaaagcaatttttttttttgagacaaagtctagctctgtcacccaggctggagtgcagcggctcactacaacctcctggctcactacaacctccacctcctgggttcaagcgattctcctgtctcagcctcccaagtagctgggattacaggtgcccgacaccacacctggctaatttttgtatttttagtagagatgggatttcaccatgttggccaggctggtgtcgaactcctgacctgaagtgatccccacgccttggcctcccaaagtgctgggattacaggtgtgagccaccatgcctggcctcaatttcttaaactccagaaattgtttcctttagtctaataaatcctaaatgcactaaccttttaggttacaacatttttataaatgcactgattttgatttgtggagatggctaagtgagactggaatatgaatagcacaatgaatgatatactgtaaaatggaaacattaagccatttttttcaacatttaccgaatacccgttatgtgcttagcactgatagctacaggatatggctctgccattaactaagtagtaactatattcttttatttatttatttatttatttttgagatggagtctcgctctgtcgcccaggctggagtgcagtggcgcgatctcagatcactacaagctccgcctcccgggttcaagccattctcctgcctcagcctcccgagtagctgggactacaggcgcacaccaccatgcccgtctaatttttgttgttttttttttgtagagacagggtttcaccgtgttagccaggatggtctcgatatcctgacctcgtgatctgcctgcctcggcctcccaaagtgctgggattacaggcgtgagccaaccgcacctggctgtaactatattctaagggagactgtcaaacaactacagagctaactctactgtaagacaaaatgtggataaatgtataacagaaatttaaggcaagtgatataacaatacaagaaaaggagtgactcactttttatctggaaaagttgagaaagcttacagggagtatctgaaacaaggcttaaaatgtaagcagaattttgagagtggagagaaagcagacagggaagaaaattgttgtaacccaacaatcaacagtgctgacatacgagagtgcatcaggccaggcgtggtgtctcacgcctgtaatcccagcactttgggaggccaaggcgggcagatcacccgaggtcaggggtttgagaccagcctggccaacatggcgaaacccctgtctctactaaaaattaaaaaaaattagccaggtgtggtggcgcgtgcctgtaatcccagatactctggaggctgaggcacgagaatcgcttgagcagaggttggcagtgagccgagatcacgccaccgcactccagcctgggtgacagcaagactccacctcaattaaaaaaaaaaaaagagtgcatcaaagaatatgattatgggaaaggtgtgactggagtaaagagcacatgaaattaggactaaggaattctggcttcagtctatacactactcctttcaaaagtgtgttctatggaatctagccaaatgctccattaagtggtccaataatatgagaaattctgtgtattagagcccccattggaaagtataacacatatcagcatcagcatgttaacatctctgatctctcaaaagctgtgttgggagacaattcttcatgagtttctcatgtttctgcacatcttgtggacaagggccctaactgcctttgttctggacaatcttctcaaggatatttgtatatctttggaagatagttgaaatggccttcgcaaaattatgactgagacagtgaaagagatctaacttaactgactccgacttggttctaacctccaagctgtccttgttcattcctggccataggctgaactaactttaggagaaacttagtttatagtttaaacaaagactgtaacagccctttcccaaagcagacctccttcttgcctgagaactagattgcctttgtaggactaatattagccacaagatgaaaaattatggtttaggagtcatgtagctagaggctacaagattctgaccctccctaaactgctcctaatatcatcgcttgagatattttgcagactctgcacttgatggatcagctgacaccacccagatcaataaactggctcatctgatcttgtggccccctcccaggaactgactcagcacatgaagacacctttaactccctatgatttaatctctgagcaatcagcactcctggctcactggcttccccccacccacgaagctatccttaaaaactctgcaccccgaatgctcggggagactgacttgagtaataataaaactccagtctcccacaaagctggctgtgcatgaaatactttctctattgcaattcctctgtcttgatgaattggatctgtttaggcagcagcaaagtgaaccccttgggcggttacacagtctccctccacagcaaaggggaggcacacttactatccattacagaaaatgtgggttcccagagcttggtgttcctctcccataatgcagcccattggccctctttgttattgttgttttcttaagagttggggtctggctctgctgctcaggctagagtgcagaggcacgatcacagctcactgcagcctcaaactgatctcaagcaatcctcctgatccagccttccgagtagctgaccactggccctctttggattgccctatgggaaatggggtttggggaacctatgacattttggctacttgttgtgagtagtaaagtcctttaacttgagccaggcatggtggcacaagcctgtaatcccagctactcagaaggttaaggtgcaaggattacttgagcccaggagttcaagactagccagggcaacatagcaagacccaatctcaaaaacaaacagcaaaaagtcctttgctggactctgactcaggagtgtcatattttctgccagcatccatgaaactgtggcaggttaacttgttagcttgcaagtagggtaagaacttagatccttcccagcttttgaaccctgaagtaaaaagaaaacttaattttgtttaaaccagggtttcccaagtttatttttttccaagaatacttattaataccatgtagaaaaaactctgggaaatgttatagcaggcaatatggacagagcgctaaatggaaggtaagtggaccagttaaaaggttactgcattagcttgaatgagagatgaatgtgagccttggaatgtaaagggggtatggctatgacacacgttgtacaagaagatgaagatgacaaagaagtgtcattaatgatacagaacataagatgaggcttgggtgaaagtggaagagaaaacagtttaatttgggatataataaatttttagattgggaagtcattcatatgaagatgtatagcaaggcattatatccagctttttccttttatgtttgatacaattgagtaaaatatgttcaaatatatgaattagacacatttataaacaaagacaaaattgaatctatgtccttaagtatttatatgcaaggggaaagaactagtagagatgctgaagctaaaaatggaccaggtgtggtggctcacgcctgtaatcccagcactttgggaggctgaggtgggtggatcatctgaggtcaggagtttgagaccagcctggccaatacggtgaaaccccatctgtactcaaaatacaaaaagtagccaggcgtggtggtgggcacctgtaattccagctattcaggaggctgaggcagaagaatcacttgaatccaggaggcagaggttgcagtgagccgagatcaagccactgcactctagtctgggcaacagagcgagactccatctcaaaaaacctgaaactaaaaagaaaaattaaaaaattaaccaggcgtggtggcaagtgcctgtaatcccagctacttgggaggctgaggcaggaaaattgcttgaacccaaaaggcagaggctgccagtgagccaagattgtgccattgcactccagcctgggcaacagagcgggactcttgtctcaaaaacaaaaaatagttgtgagaggtcatgattgacagagcaggtgggtatgtgatccagggcccaggaaaaaggttcagtttcaaacaacaaaagatctacttttctactaagactagaggtaaggggacaaaagaaatcaactcaagatggaccagaaacttaaatctaagacctgaaaccataaaaattctagaagataacattgtaaaaactctttttttgagactgagtctcactctatcacccaggctggcaatctcggctcactggaacctccgcttcctgggttcaagtgattctcatgcctcagcatcccgagtagttgggattacgggcgcccgccaccacacccggataatttttgtattttagtagagatggagtttcaccatgttggccaggctggtattaaactcttgacctcgagtgatctgaccaccttggcctcccaaagtgctgggattacaggcatgatccaccatgcccagctgaaaaactcttccagacattggcttaggcaaagaattcatggctaagaccccaaaagcaaatgcaacaagaacaaaaataaataaatgggacctaatttaactaaaaagcttctgcacagcaaaaggaataatctgcagagtaaaccaacaacccacagagtgggagaaaatatttgcaaactgtgcatctgacaaaggactaatatccagaatctacaaagtactcaaacaaatcagcaagaggaaaacaaacaatcccatcaaaaaatgggtaaaggacaagaatagacatttctcaaaagaagatatacaaatggccaacatcactaattatcagggaaatcaaaaccacaatgaaatactactttacacccgcaagaatggtcataattaaagcaaaaaaaaaaacacaaaaaacaaaacaaaaaaaaacaaagatgtggtgtggatgtagtgaaaagggaacacttttaacactgctggtgggaatgtaaactagtacaaccactatggaaaacagtatggaaattccttaaagaactcaaagtagaactactatttgacccagcaatcccactactgggtatctacccaaaggaaaagaagtcattatatgaaaaagacacatacacatgcatatttatagcagcacaattcacaattgcaaagatatggaaccaacctaagtgtccatcagccaatgagtggataaagaaaatgtggtacatataaatcatggaatactactcagtcataagaaggaatgaaataatgtattttgcagcaatttggatggagcgggaggtcattattctaagtgaagtaacttaggaacggaaaaccaaatatcgttatgttctcacttatgagtaggagttaaactatgaggatgcaaaggcataagattgatataatggacgttgggaactttgggggaaaaagggtcagagggggatgaaggattaaagactacgtatttgggtacagtgtacgctgctcaggggatgggtgtaccaaaatccagaaatcaccactaaagaacttatccatgtaaccaaaaaccacctgttgccccaaaactattgaaataaaaataaaaattttaaaaaagaggtaaggggataaagatatctatagtatagatagctatactaaagacttcaatattacataatggtgggactcgtgctgtgatttaaaaaattccttaataaattatatacttaaaatggttaaaatgataaagtttgttttatatattttactacaataaaaatgtatgttatttaaatactactcaatttccatattctagtaggttagcattgataactacattttatggttagctcaagtttaacttttagtttgctactctagatcttacataagagcaatcccatttaatgtcttatagccactgaaaaaaatatattccactttcactatattttacctatttttatatagcagaataaaccaaagatcttaccatctgaaatacatcagagccttcatcaaaatccaccatggcaaaaaatatcctgttggtgaatgcactggagtatcgccaggagtttgccaggatctggaattcttcatcagcttgcctggatgcaatgagattcgtaaagataacatataaaacaatttttgaaagcaatctcgtttatcatcagtaaaacaggtccaagcaagcaatagcaggttttccaatgggagaaataataaaaaacactgacaagtaggtcagactctgctgacagggttaagacaaatcttgttttggcataagagaagccttatcccaagttagggatttcatgagaagtagtaattacctgactccgcttcatactttgtgcctgtttcttatcccaaaactctttcaacaatcattggaaatatatagctaatcgcctctacaataactttccataccctaaattacttctaagagttcaaagacaagacagaagtgtattccctaaagaaagcagaaatacaatattaattcatttttaaaaatctaaagtgcaaaagctacttggtaaataacacaatcagataaattattaggatgaaagataagaagagtctaggaattgaaattaattgaggccagctcatacctgtaatcccagcactttgggaggctgaggtgggtggatcacctgaggtcaggagctcaagacaagcctggccaacatggcaaaaccctgtctctattaaaaatacaaaaattaggccaggtgcagtggctcatgcctgtaatcccagcacgttgggaggctgaggcaggcggatcacaaggtcaggagttcgagaccagcctggccaatatggtgaaaccctatctctaccaaaaatacaaaaattaaccgggcatggtggcaggcacctgtagtctcagctactcgggaggctgaggcaagagaatggcttgaatccgggaggcggagattgcagtgagccgagatcacaccactgcactccagcctgggcgacacagcaagactccatctcaaaaaaaaattattgaaacctcaagtcatctttgaatttttccatatctcccatatgctttcagttctcatgatctgtcaattctcatttgcgataaaagtttcactccatatcctcctatttttattgctatcatctaaggtcagatttttgttatctaatagtaggatatttaaaaatactgactctggtttctcctccttcaatccttctttttttttgagacagtctcgctctgtggcccaggctggagtgcagtggctccatcttggctcactgcaacctctgcctcccagtctcaagcaattctcctgcctcagcctcctaagtagctgggattacaggtgcccaccatcatgcccagctaatttttgtatttttagtagagacagggtttcaccatgttggccaggctggtcttgaaatcctgtcctcaggtgatccgcctgcctcagcctcccaaagtgctgggattacaggtgtgagccaccgtgcccggccctcctccaatccttacactgcaatatacatccatcttcctaaattactactttcctgaaacacttctcagaaatcactgttgctttcttattaccttcagaatacattctctaatctctttcactagttattgaaggttctttatcacatagcttcaaataatacatctagtttttatctagtcttactactaatcaatctcaaacagtaacctttagtcccaatattttatttactcctatccctgtacccttgtgtacatcatgcttctaaccagaatatcctgcctgtatcaacatcttatccatttgtctagccctagcacaagtcttatttcctccatcaggccaatccaaatcactcctattaaccttctttcctgaaattttacagtatttattatatgtacagttgatctggtacttaatcacaaattgccttatattgccatctaaattttcatatgtgtaactcatttccttaaccagatgataagggtaggttatctattttacaattctcatcccaacagcaccacaactacagtataattcatgttgctgttgtttaatttttatttgttgaatgagtgtagaaaaatttgagttaatattaaatttggtctcatagaaaataagatgccagtaaaaacttaggttagtaagaattccattaatttgcatttaatagagaattatgaaggagtttgtgtttgttccctgctatttttgtatactcttgattgctactgagtgaactgacggaattagaagtaattctagatttcaagtttattcatagttattacttacgattcctttttcttcttttatttatttttaatttatattcagcacatactccacaaaataagcactatggaaccaaataccttgactataccctagctccagggagaaaatcgttaaagaaaagttatcaaggcttggggtggcagaacacaccattctgaaacaagctgtctattcctttgcatggctatcaggctgtcagaatctggagaacctccaagtttttactaaactaattcttcatacagtagctttgtcattttatttaaagttaattaccagatcagatacactgatctaaaaatataaataaaaagacactaaaaagcaaaagctattttattttttagtatccaccattttgaattgttcatggtgtttttatttaacagaatagcaatctttgctcctaagatcattaagaaacaataaaataaaatcaagaaaccattgtttgatgaaaacttaagcaagattagtctccatctccaaggtttacaatcactataaaacaactgggaaattagaaacatcgctaaatcatggatctttgggattaaaaaaataataattaatatacccatcaccttacctatttattattttttggtggtgagaatatttaaaatgtttttagcaatttcaaaatctacaatacattaactatggtcaccatgctgtgcaatagatcaccagaacttacccccctcatctaactaaaactttgtacactttcaccacatcctctcctaagactctgaaaaccaccattctactctgcttctaggagttcaacttttttagatttcacatgagatcccatgcatcttttttttttgtttgtttttgagacagggtcttggtctgttgctcaggctggagtgcagtgggatgattatagccttctgcagtttcgacctcccaggatcaagtgatcctcccacctcagcctctggagtagctgggactacaggcacatcaccacacccagctaattttgtttatttttatagatacaaagtttcactatgttgcccaggctggtctccaatgcctgggcccaagtgatcctcccatctcagcctcccaaagtgctgagatcacagacatgagctaccacacccagctgcatcttttttttaaaaaaaaaaaaacattaccagctgggtgtggtggctcacgcctgtaatcccagcactttgggaggcttaagtgggttgatcacgatgtcaaaagatcgagtccatcctggccaacatggtgaaactccgtctctactaaaaatacaaaaattagctgggcgtggtggtgtgcacttgtagtatcagctactcgggaggctgaggcagaagaatcacttgaacccaggaggtggaggctgcagtgagtcaagatcacgccactgcactccagcctgggtgacagagcgagactttgtttcaaaaaaaaaaaaaaaagaaaattaccagttttcttgaattccaaacttggatgaagccaccattattgcattagtaaacatcttaagcattgggtagaccagttaaaattgtggagcctgtttcttccaaaaatagtaggatatttgctttacctaccttttgggattttgacaatacaagagtatgaagctgaaagcacttacaaataataaaaaaatactacatcaatgctactggcatacagttacataagttgatactgatttttttttttttttgagacagtctcgctctgtcgcccaggctggagtgcagtggcgcaagcttggctcactgcaacctctgcctcccgggttcaaatgattattctgcctcagcctcccaaatatctgggactgcaggcatgcaccacaatgcctagctaatttttgtatttttttttttttagtagagatggggtttcaccatgttggctgggctggtcttgaactcctgacctcagatgatccacctgcctcgacctcccaaagtgctgggattacaggcatgagcccccatgccccgccaagttgatactaatttataagatgactgtttgatctttaagttacttttatgatggctaccacaattatttatccatgcttcccccactgatacggataatcaagaattgactataaaagagcagtagtattgctaccatagacatcctgagtaaggtatacacattatttaagtacctactgcactaacttggcccttctgggattgagaaatggttaacgttatatgagttatttaattttaaagcgtagttggagttcatacttgcaaacgacacactgtctatgcagttggagagcagtgaacatgacgataacggagtaatttctcggtggggctttcacaaggcgacggaacttgtctccattcattcttattacaggtcttttgttagtccattccatcagctgactaaccttttcagataacaccatctaaaaaagacaaagtgagcatgctattaatatactcaacttggcatttaaagttcttttaatgaggcagcttacttaaaaccaatactaacaagcagaggtatacagaaaatgtgagacctaaagccaaaatttggtagttgggctggatgataattattcttaaaatacattatttcataatattttgtcagacattacacttttgatgtaattaattatgaatgaatgaatgaatgaataaacgaatgaatgacactgtctcgctctgtcatccagactgcagtgcagtggcacaatgagggctcactgtagccttgacctcctggcctcaagggatcctcccacctcagcctcccaagtgcttggaatacacacgtgttccaccatgctcagctgatttttgtattttttgtagagatggggcttctccatgttgcccaggcaggtcttgaactcctgggcttaagcaatctgcccgcctcagctaccgacagtgctgggattacaggcatgagccaccacacctggcctttatatatatatatatatatatatatatatatattttttttttttttttttttttgtagagacgggggttttactatgttgcccaggctagtcttgaactcctgggctcacatgatcctcccaactcagcctcccaagtgttggcattacagtcatgagccattgcacccagacagaattatttattatttactaataagataaaaataacaaaacctttcatttgccaaaaattccaaagaatgttgagttaaaccaatggccagttttatatacaattttacttctctcaaaaaacatacagtgaaaatcttgaaaataaagagtaaagtgggaggaatcactctattcaattttaaggtttactatgtagccacaataattaagacagtgtggtacagatgaagggatagtatcacagaacaacagaacaaaaaaacaacccagaagtagacccatacaagtgtagtcaaatgattttgcacaaaggtgcaaaaacaactcagtggaggaagaatagccttttcaacaaatggtgcagaagcaattggtcatccatagccaaaaatatgaacttcacaccttatataaaaactaactcagccgggcatggtgactcacgcctgtaatcccagcactttggaggctgaggcgggtggataacctgaggttgggagttcgaaaccagcctaaccaagatggagaaaccccgtctgtaccaaaaatacaaaattagccaggggtggtggcacatgcctgtaatcccagctacttgggagactgaggcaggagaatcgcttgaacctgggaggcagaagttgcagtgagccgagatcgtgccattgcactccagcctgggcaacaggagtggaactccatctcaaaaaaaaaaaaaaaaaaaaaaaagaaactaatacaaaatagatcatatacttaactgtaaaactataaaacttttatgaaaataaataggagaaaatattcagaagctaagggtaggcaaaggtttcttaggcctgacaacaaaagcaggatccataaaaaaaaaaaattgatatactggacctcatcaaaattcagccggatgtggtggctcatgcctctactcccagcactttgggaggccaaggtgggcagatcacttgaggctaggagtttgagaccagcctggccaaaatggcgaaacccagtctctactaaaaatacaaaattagctgagtatggtggcacatgcctaaaatcccagctgctcagaaggctgaggcatgagaattgcttgagactgggaggcagacattgcagtgagccaagatcataccactgcactccagcttgggtgacacagcgagacactgtctcaaaaaaaaaaataaaataaaataaaaaattttactctctgggccgggtgcggtggctcacacctgtaatcccagcactttgggaggccaaggtgggtggatcacttgaggtaaggagttcgagaacagcctggccaacatggtgaaaccctgtctctaataaaaatacaaaaattagccaggcatggtggtgggtgcctgtaatcccagctactcgggaggctgaggcaggagaatcgcttgaacctgggaggcggaggttgcggtgagccgagatcacgccactgcgctccaacgtgggcgacagagtgagactctgtctcaaaataaaataaaataaaataaaataaaataaaataaaataaaataaaataaaataaaatatactgacaatatcaaatgctggtgaggatgtggagaaactagatctctcatacatcactggtgggaatgtagtatggtgcagccactttggaaaacagtttggcagtcttaaaagatcaagcaactgggtgggtgcagtggctcacacctgtaatcccagcaatttgggaggccgaggcgggtggatcgcttgaggtcaggagttcaagaccagcctggctagcatgttgaaaccacatctctactaaaaaaaaaaaatacaaaaattagctgggcatggtggcacatgcctgtaatcccaggtactcaggaggctgaggcatgacaatcgcttgaacccgggagacggaggttgcagtgagccaagatcacatcattgcactccagtctgggcgacaagagcaaaactctgatgcaaaaaaaaaaaaaaaaaaaaaaagaaaaaaaaatttagccgggcatggtggtgcacgcctgtaatcccaggtacttgggaggctgaggcaggagaaatacttgaactcaggaggtagaggttgcagtgagctgagatcacgccactgcattccagcctgggtgacagagtaagactctgtctccaaaaaaaaaaaagaaaaaaagaaaaaaaaaaaagccaggcgcagtggctcatgctgtaatcccagcactttaggaggccgagatgggtagatcacctgaggtcaggagtttgagatcagcctggccaacatgataaaatcccgtctctactaaaaatacaaaaaaattagctgggtgtgttggcgggtgcctgtaatcccagctactcaggaggctgaggcaggagaatctcttgaatctgggaaggcggtggctgcagtgagccgagatcgtgccactgcactccagcctgggcaacaagagtgaaactctatctcaaaaaaaaaaaaaagaaaaaaaaaaagaaaaaaaaatctggcaactaaagatacatttaccatacaacccatcaaccacattatttggcatttgtcctatagaaatgaaaatttatgtctacacacaaaaaagagctagagtttgttcctttttggctaatcatcatgaggcagtggaagagaagcatggttagtcgacaggatttaagtttgaaattaaatgccatcatatttatcattcccctcatcttcactctcaatgttttctttttcttttttctctcgagatggagtcttgctctgtcacccagactagagtgcagtggtgcgatctcacctcactgcaacctccccctgctgggttcatgcaattctcctgcctcagcctcccaagtagctgggattacaggcacacgccaccacgcctggctaatttttgaattcttagtagagacggggtttcaccatgttggccaggctggtctggaactcttgacctcatgatctgctcgcctcggcctcccaaagtgctgggattacaggcgtgaatcactgtgtccagccccaccctcaatgtttaatccttgccatgagtagtaagaaggcaggaagggataacaaagaaaacaaaaatctcaatgtagagttaatgctaatttatgattttgctcatctttatagagatatgtatagaaaaagctgggaaatcatgcagtggttcatcattcagaaccatttgaccagttatatttcccgttacctatattctagcacttaccattttaagacactttgacgtttgattccttttctagactattagctacaagagaacagagacccacaattctttaccatacagtaggcactcagtaaatgtgtactaaatttataatcagtgaaatttaactgggaattgactgacttgcttacattaacatgtaagaaagaaatgattaactgcacacgtaaacacttacatagaaacaaaactttttttttcactttagaaagtaacatggattctaaaaatgcatgatttgccttttttttttttttttttttagacagagtctcactctgtcatgcccaggctgaagtgcgatggcatgatctgggctcactgcaacctctgactcccaggttcaagtgattctcgtgcctcagcctccaaagtagctgggattacaggaacgcactaccacccccggctaatttttgtgtttttagtagggacggggtttgaccatgttggccaggctggtcttgaactcctggcctcaaatgatccacccgcctcagcctcccaaagtgctgggattacaggcatgagccaccatgcccagcctggtctgcctttaagcatacctgaattcatctaatactgaccacaattttatgtcacaagtacatctctatgaatgatggaaaaaagctgcataaaaattagttttgtaggccaggcgcggtggctcacgcctgtaatctcagcactttgggaggccaaggcgggcagatcacgaggtcaggagttcaagaccagcctggccaacagggtgaaaccccgtctctactaaaaatacaaaaaataagctgggcgtgatggcgggtgcctgtaatcccagctactcgggaggctgaggcaggagaattgcttgaacccgggaggtggagttgcagtgagccgagaccgcaccactgcactccagcctgggtgacagagcgacactcagtctcaaaacaaaacaaaaaaaacattagttttgtagcaaatacgaaaaaattctggtaagggccacaaaaagaatatgccacacacgaaaaaccgaacacactctaaacccacagaaaaagatatacactcttgaaagattggttgttaacaggccaggtgcagtggctcacgcctgtaatcccaacactttgggaggctgaagtgggtggatcacttgaggtcaggacttcgagaccagcctggctaacatggcaaaacctcatctctactaaaaatataaaagttagctgggcgtggtggcacatgtctgtagtcccagctaccggggaggctgaggcactagaatcgcttgaacccaggaggccgaggttgcagtgagccaagatggcaccactgtactccagcctgggcaacaaagtgagaatctgtctcaaaaaaaaaaaaaaaaaaaaaaaagaaggaaagattggttataacaaataattaacaagactgcggaacaatgaaacaagtagttggtaaaggctgtgggagagaatgaaccaggaggaagatagagaatatttgatttaaattgagactgcacagatcaaatttattgtttttccaacaaaatgaattgctattatttgataccgttttaatgattctcagagcacagaaaatatgggttcacattttaaaatatgcaatctatattttgaagcaatcattaatttttgccatattttgttttttttatatatagatatttattatactttaagttctagggtacttgtgcacaatgtgcaggtttgttacatatgtatacatgtgccatgtggtgtgctgcacccattaactagtcttttacattaggtatatcacctaatgctatccctccccctccccccaccccacaacaggccccggtgtgtgatgttccccttcctgggtccaggtgttctcactgttcaattcccacctatgagtgagaacatgcggtgttaggttttttgtccttgcgatagtttgctgagaatgatggtttccagcttcatccatgtccctacaaaggacatgaactcatcattttttatggctgcatagtattccatggtgtatatgtgccacattttcttaatccaggctatcattgttagacatttgggttggttccaagtctttgctattgtgagtagtgccaaaataaacatacgtgtgcatgtgtctttatagcagcatgatttatattcctttgggtatatacccagtaatgggatggctgggtcaaatggtatttctagttctagatccctgaggaattgccacactgtcttccacaattttagaccaatatctctgatgaacatcaatgcaaaaatcctcaataaaatactggcaaaccaaatccagcagcacatcaaaaagcttatccaccatgatcaagtgggcttcttccctgggattcaaggctgcttcaacatacgcaaatcaataaatgtaatccagcatataaacagaaccaaagacaaaaaccacatgattatctcaatagatgcagaaaaggcctttgacaaaattcaacagcacttcatgctaaaaactctcaataaattaggtatagatgggacgtatctaaaaataataagagctatttatgacaaacccacagccaatatcatattgaatgtacaaaaactggaagcattccctttgaaaactggcacaagacagggatgccctcactcaccactcctattcaacatagtgttggaagttctggccagggcaatcaggcaggagaaagaaagaaagggtattcaattaggaaaagaggaagtcaaattgtccctgtttgcagatgacatgattgtatatctaattttgccatattttcaagttaaatttgacagttaccagcaaatacaaatatgatttgactattttattcagggtgactacatattctgtatggggctgagaaaaacaagtgtgaagcagtaacaggtatttacacagttttacatcctcctatctctattcaaccatatagatatataatcatgccaacaaaagaaatataagtgctttgaattagttatcaatatgtggagttttcctacacaaaaattcttgaataaacgttttcaagcaggtctacataaaaaatttatggccaggcatggtggttcaagcctgtaatccctgcactttgggaggctgaggagtgaggactgcttgagccctggagttcgagaccagcctggtcaacatagtgggacccagttactacaaaatattataaaattggtcggatgtggtggcatgtgcctgtagtcccagatactcaggaggctgaggcaggaggatcacttgagcccaggagttagaggctgcagtgagctacgatcacacatcactgaactctagcggggacaacagagcaataccctgtctctaataaatatatatttatatatataatttatatatatttatatatataaattatatatttgttatttatatataatttatattatattaatataataatataatataattataatatgtattatattaatataataacataattatattataatatatattattattaatccaggctatcattgttagacatttgggttggttccaagtctttgctattgtgagtagtgccgcagtaaacatacgtgtgcatgtgtctttatagcagcatgatttatattcctttgggtgtatatccagtaatgggatggctgggtcatcccatctgccggcagatcacgaggtcaggagatcgagaccatgtataataattattgtaatatatattataatatatgttattcctcttcctgtttattaacagactagaaagaccagacttctggctattctttctcgaaataatttatcaagtagaagaaactagttcaaaggaattatcttttttcaggctcttataaaacaaaatcacttcaaaaggctgcttaatgcagaggcaattagattacttcctgaattcattttcttttttttttttttttttttttggtgacagggtctcactctgttgcctaggctggagtgcagtggtgtgaacttggctaactgcagcctcaacctcccaggctctagtgattctcccacctcggcttcctgaatagctgggactacagatgtgcaccaccgtgccccactaatttttgtagagacggggttttgccatgttgcccaggctggtctcaaactcctgagctcaaatgatccttgccctcccaaagtgctgggattacaggcatgaaccaccttgccccgactgggttcattttctttaaaatgaattgaaaacagatcacaacaaatgaactagttttaaacttttacaggctgggagtggtggctcatacctgtcatctcagtgctttgggaggtcaagtcggatggatcacttgatgtcaggagtttgagaacagcctggccaacatcgtgaaaccccgtctctactaaaaatacaaaaattagttgggtgtggtggcacacgcctgtagtcccagctactcaggaggctgaggcacgagaatcacttgaacctgggaggtggaggttgcagtgagctgagactgcaccactgcactccagcctgggtgactgagtgagactctgtctaaaaaacaaacaaacaaaaacttttacaataaaattacatgaacatagcctggaacattataattagatgctataatccttattcacaatgacgtaatattttaagatattctaaagcaagcctctcttggatttatggagaaaataatagctactatttggaatgtctagcgggtgtcaggcagttacttcttgctttatagaatatataattaagttcaatcctcaaaacgacactataaggtaagtactctttttacatttgcttatctgttgagaaaacaggattggagaggttaaacaacttgcccaaaatgccacagttagtaagatactgaggtagaaactcaaacaggccatgatcattctaaaccagggtttctcaaaagcaacactaccgacgtcttaggccagatcattgttgtgaggagtgatcctgtcagtgcactgtaggatgttgaatagcaaccctggcttctactcactacatgccagtagcaccctcctctcccagctgcaacaaccaaaaatatctccacacactgccaaatatctcctggggagcaaaatcacccccaatcccacaatattgttcttaaaaaaaaaaaaaaggccgggcgcagtggctcaggcctgtaatcccagcactctaggaggccgaggcgggtggatcacgaggtgaggagatcgagaccatggtgaaaccccgtctctactaaaattagccgggcgcggtggcgggtgcctgtagtcccagctactcgggaggctgaggcaggagaatggcgtgaacccgggagtcggagcttgcagagagccgagatcatgccactgcacttcagcctgggtgacacagcgagactccatctcaaaaaaaaaaaaaaaaagagagagacagggtgtcactttgtcacccagactggagtgcagtggtgtgatcatagctcactgcagcctcaaaatcctgggcttaagtgatcctcccatctcagcctcccaaataactgggactacaagtatgcgccaccatgcctagctaatttttaaaagttgttgggcacagtggctcatgcctgtaatcccagcactttgggatgccgaggtgggcggatcatgaggtcaggagttcaagaccagcctgaccaacatggtgaaaccctgtctctactaacaacacaaaaattagctaggcgtggtggcgcgcgcctgtaatcccagcttcttgggaggctgaggcaggataatggcgtgaacccgggagtcagagcttgcagtgagctgagatcacgccactgcactccagcctgggcgacagagcgagactctgtctcaaaaaaaaaaaagagagacagggtgtcactttgtcacccagattggagtgcagtgacgtgatcatagctcactgcagcctcaaaatcctgggcttaagtgatcctcccatctcagcctcccaaataactgggactacaagtatgcgccaccatgcctagctaatttttaaaaactcttgttgggcgcagtagctcatgcctgtaatcccagcactttgggatgccgaggtgggcggatcatgaggtcaggagttcaagaccagcctgaccaacatggtgaaaccctgtctctactaacattacaaaaattagctaggtgtggtagcacgtgcctgtaatcccagcttcttgggaggctgaggcaggagaatcgcttgaacccgggaggcagaggttgcagtgagccgagattgagcccctgcactgaaacttgggtgacagagcgagactccgtctctaaaataaaataaaaaaatctcttttagagatagggttttgctatgttgctcaggctggtctcaaactcctggccccaatagacactcctccctcatcctcctgagtggctgggattacaggctcaaaccactatgcctagctcaagaacaactgttttgaactgaaaagaatgtacaattttacaatcttatttttatgtattcaaaaatctttaaaaatcattactgatcaaaatacaacataaaagaaagatttagtgataaagtaacccaaaacttcctagagcaagcctttatcataatggataataaactttttaaacctgtgtttctcaaagtgtggttggtataaaggagcttgttaaaaatgcagactttggccgggcacagtggctcatgcctgtaaccccagcactttgggaggccgcttgagcccaggagttcaagaccggcctgggcaacatagtgagactctgtctgtattttataaaattaaaaaaaaaatgcagacttctggccaggcatagtggtatgggcctgtagttgcggctactcaggaggctgaggtagaaggatcatttgagcccagaaatttgaggctgtagtgcactatgattgcacctggtgatagccactacacttcagcctgagcaacatagttagattccatctctaaaaaaaaaacaaaaatcaaaatccatatttctagatttcatcccccagtacatttgattcagtaagtccagggcagattccaagaatattgaattttaacatgttacacatgtgattctttatatacactgaagtttgagaatcacagctctacattctgattcttatgggttaggactacatgttatataaatttctatggacagcaaagggaaattaaataaacattaagtgaaccaaatgatgaataacaggaaaaagcatgccatttctaataataaaccaacccgtgatcctcctggaacggttgaagaatgtgatattctacttaactcaaatataatgccttaatacttcctagacacttccttcactggtcctcttttttgtcttctttagttaatagatttataagggaatttcttgttttctctctctctcttttgtttcaatttagagacagggtctcattctgttacccaggttagagttcagtggcatgattgttagctcactgcagcctcgaactcctgggctcaaatgatcctcctgcctcagcctcctgagtagctaggaccacaggtgcatgctaccatgcttggttattttcttttatttgtttgcagagatggggtcttgctatgttgcgcaggctggtcttaaactcctaggctcaagcaatccttccactttggccttcccaaagtgttgggattacaagtgggagccactatgtgtggccaggaatttcttcaaatttgaattgaaagctttcttgatcagggtaaatctctattcctaaagaagctttttcctaagggtgcctctggttctttgtcaagagcccattatttgggtatggaaaggcatggttgagaaataaaaattttgttcctctattgccactacactaaatcccactattcattttccagattcttctttatcttccaaagtcacaaccttcaaatggaaaagttaaaaatttcacctgtgcacttcagatcattctaataatacttgaaaattattaggaagaaacatatcttccaaagactataacatgtaaagataagaggtttatcaagtgaactgctcagcaactccaaaaaagcaattaattcgcaaacaactcctaatgcaaatacttttcccgctaatagtttttttgagacagagtcttgctctgccacccaggctggagtgcagtggcacgatcttggctcactgcaacttctgcttcccgggttcaagtgattctcgtgcctcagcctcctgggtagctgggactactacaggcgtgcaccaccacgcccagctaattttgtacttttagtagagacagggtttcaccatgttggccaggctggtctcaaactcttgacctcaggtgatccatccaactcggcctcccaaagtgctgtgattacaggcatgatcgactgtgcccggcctccactaatagttgttaaacattcaagaaaatatactgatctaaagctttcaatttgtattggatatattttttataaaacaaattacaggcttactatgaaaaaacacattgaatttacaagatattcacaatcaatttatttccctccttctccttggcgtacattagtctattttctaccattcaaataaaacaaaaatagcaataatactcccaattgaaatacttaccaacaaagtaaagtaagtttaaagtctttctcttctcttgaaacattttaactagtatgtccaaaaaaaatcacctcactactagaaggcaatgtctctaatcctatttgtaataatcaagtgttatagaaatctataactataagagattaagaggaccaagaaagggcagtgagacatcagtttaatttcatcttacctgcttgcataatatttaacttgattagctctaccaaagtagcttaagctttaataaccagaaattgtcctattgtcactatcactcatcaaaaatggaatataggatctattaattacgatttaaagctaaaatctgatcctgccattcaaatttcttttgaatttcagaagcaagaaagctaagtattaccagtctgaattcctctaaaatgcaactttccccaaaagcatgtttcttaaaaaaaattctgtgggtacacagtaggtatatatatttatggggtacatgagatactttgatataggcatgcattgcataataatcacatcatggtgaatgaggtgtccatgccctcaagaatttatcctttgtgttacaaaccatccaattatacttttaattattttaaaatacacaactacattatattattattattattattattttgggacagggtctggctctgtcacccaggctggagtgcaatggtacatcttggctcactgcagcctgtacctcccaggctcaggtgatcctcccatctcagcctccctagtagctgggactacaggcacacaccaccatgctctgctattttttttttttttttttttgctaggaacacggttttgccatgttgcccaggctgatctcaaactcctaggctcaagcaatctgcccactttggcctcccaaagtgctgggcttacaggtgtgagccaccacgcctggcctcattcttttttaaatttaaatttaaatttttgtgggtacatagtaggtgtgtgtgtatgtatgtgtacatatatatgtacatatatatatatatatttttttttttgacatggaatgactctgtcgcccaggctggctggagtgcagtggggcgatctcggctcactgcaagctctgcctcccgggttcacgccattctcctgccttagcctcctgagtagctgggactacaggcgcccgccaccacgcccggctaattttttgtatttttagtagagacggggtttcaccgtgttagccaggatggtctcgatctcctgaactcgtgatccgcctgcctcggcctcccaaagtgccaggattataggtgtgagccactgtgcccggccttaggtgtatatatttatgaagtacatgagatgttttgatacaggcatgcaatgtgcactcatcacatcatgtaaaacgagatatccatctcctcaagcatttatcctttgtgttacaaacaatcctattatactcttaattttttaaatctacaattaaattattattgactatagtcactccgttgtgctatcaaacagtaggtcttattcattatgttttttgttttttgtttgtactcataaagaatccccacctcccaccaccacccccagcttctggtagctatcattctactatctccatgagttcaagtgttttgatttttagctcccacacgtaagtgaggatatgcaatgtttgtctttctgtgctcggcttatttcacttaacataacgacttccagttccatccatgttgttgcaaatgataggatctcattcttttttatggctgaatagtactcccaaaacttattcgtgtctttgttctaaccatcagggtttattcataaaaattcttcatattttcacctttcctaatcatctaccagtcttcagatgttagtatgaagtagaacaaaacaaattcttagttaaggtatacatttccaactccctccttaaattaagagatctggaacagatctggaaatataacgggcagataattactgaagaagacagtgaacagagaagtgagcatttttaatccttaaatgccatctgctccattatcagttcacgtacttcctggatagagctaaaatctatccttgtcccctttccttagtttttaattttttggtggtgtctccatttaattgttctgcaactgctactaagcctgtttctctaatcagatattttctagagaactgcagggttttttgcacatgtgatactttcatgagtcatttctcaaagcaaagtttttccaatgatagcctgccttgttaaacatcccaaaaagatcaactgcaaaacatttaccacccagaggaatataatctcactttattttctaacatttacttaacatcttctatatgccaggtactgcattaggtacttcacatccctcatctcatttaattttcacaatagccaaagaaatcagcattttttccattctactgatgaggaaaatgagactcagagtaacttgttaaacatcattgggggtggattaaagcatatcctctttaaaactacagacttttttggaaaactggggagggagatctatctgccatcctagcattatgatgaccatttttattatgcttcagtatgcattgcgtgttcatcactttccacatttcatattattattattattatagattcccagaagtaaagaaatatgaataattttatcaaagaccatgcttcttcatttttatcatgctgcctctctaagataacaccagatgcgaggatgaacaacttcccttccacaacagggggaaaggattcaccataaaataaaaccagtcgctgcaaaaacaagcctttgttgcctagcacaaaacataggctttggaactagacagaccagtgtgggatcccagctcagtttcttagagctgtgcttctatgagcaagcccccaaccaccctcttgcttactgtcagttccctcatctatctatctatctatctatctatctatctatctatctatctggggtgggtagagatgagtctggctatgttgttcaggctgggctcaaactcttggcctcaagggatcctcccatcacctcaagggatcctcccacctcagcctcccaaagttctgggattataggcatgagccaccatgcctggccagtcccctcatctttaaagtccccttatctttcgaaggggttaatacttactctgcaatgttaatgtgtgtattatagataatgagtgtaaactatagtgcctggcatgtagaatgcattcgataaatatcagagaataaatggctgggctcagtggctcacgcctgtaattctgtcactttaggaggtcaaagcaggaggattgctggaggccaggagtttgaaaccagcctggtcaacatagtgagacccggtctccacaaaacatttttaaaaatttaaaaagaaaaataagtccacgttccaatgaaaacattgttaaaggtataaataataagcagggtagcattccatttagcaatagacaactatgaggaacttgagtgatttttaatcatatttatttaggggaggtatcttttaaaaagaatatacatatatgcacactttttttttttttgagacagagtctcgctctcttgttcaagcgattctcatgcctcagactcctgagtagctgggactacaggcatgtgccaccctggctggctaattttttttgtatttttagtagagacggggtttccccaagttggccagcctggtcttgaactcctgacctcaagtgatccacccgcctcggcctcccaaagtgctgggattacaggcgtgagccactgcacccagcaaaaaatagattttaagatcagacattaccctattatttaaagtcaaatttattatagtagatagacctggaatttttttaaataatgttttcaaaaattgacaaaaaaatgttctgcaacagaacacccatattttgaaactgtgtctaaggagtatcatagtagtctttttaaagacagcctaaaccattctcagagagggaaggaggaaaaactaaatcatctttagcagcctatataaattccatgcttactgatgagaaaatccaattttatgttgtgaaatctaagaaaacctacaactgaaagaacagattcccggctgaacacagtggctcatgcctgtaatcccagcactttgggaggccaaggtgggtagatcacttgagtccaggagttcaaggccagcctggacaacacagcaaaaccccatttctacaaaaaatataaaaattaactaggcatggtggcacatgcctgtagtcccagctgggaagtcttaggtgggaggatcacctgagcccagtgaggtcataaggctgtactgagctatgatcatgccactacactccagccttggcaacagagtgagaccctgtctgaaaaaaaatttttttaaatatatatatacatttataaaaagaaagaacagattcctgattttatataagtacacagttaatctgatgtttgttgaggacattttgacagaaaatgctggatgtgaggtaaagaaaaattaagaagtttttgcattcaagatgcttacagtgttagggcaaagactggcatataaacaaggacaatacaggtcaggcatggaggctcgctcctgtaatctcagcactttgggaggccaaggtgggaggatcacttgaccccaggaagtagaggctgcagtgagtcatgatagtgccattgcacagcatgcagcctgtgtaagaggccctgtctccaaataaatacatacatacctacaatgactatatgctgtgctgaattcatctcagttcacctggaggcaccaagaaaactttagccgaggaagaaagaagatactgtttgagctaagacttgaagagtaggaatcttcaggtgaatgaaagggtggggtaagagaaaaggaagatattctcgcataagtcttgtacatgcatgaaaagggtgaatgtacttccaagagagtacagaaagatcaaggaaggcatgtaatttattgccttaacataaaattcaccatattgaccattttaaagtatacaattcagtgctgattcctttaaaaaaaaaacaaaacctattttcagctaggctgttgtgcttccagttcagtgagagagtcaatgaataaatataatttcactggtagaaatgctaagttttaaaaagccttcactttttaattaaaaagaataagtggactaggcacagtggctcacacctgtaatcccaacactttgggaggccaaggcggaagcaacacttgagcccaggagtttgagactagcctgtcaacacagagagactccgtttctacaaaaagataaaaaagtagccagggatattgtggcacatgccggtagtcctagatattcgggaggtggaggtggaggtgagaggatcactagagcccaggaagtcgaggctgcagtgagccatgatcccaccactgaactccagcctgggcaacagagcgagacccggtctcaaaaaaaaaaaaaagtggtcatcgtggaaattcaggtaataccagcaataccagcatgtaaagtaaaacgtgaaaacgttcccctcatcgataatcccaactgcctagagatagccactgttaaggtattgtcatgtatccttacagagatttctctatacatacacatatacttatatataggggatgctgttgtttttaacataaaaaatttctaagacataaaattatgcattgctctgcatcttcttttccacataaccatagcttaggatcctcccaaagaaggacatcaatttctagtttcagtgtctgagcctgctcacttcacgatacttttgacaattgtatatttttattgtactctttgccaatctaataagcaactcattaagtttaacttcctagcttagtttttcttcttatggaatagttcaaatacttagaaacatagagaagatagctttctttcttaattcagctcaagtagacaagtatctgaagtgcttaactggtatttttagagtatgtgcacagtttttctctattagaggaagcacagaatgtacaggaaatagagttagaatgactgacgtagggtttgagtcctcgttcattttctaaatttaagactctttttctcatctataaaattagagggtataagtaattgctagtagtcttaaagtcctaagagtataggactccaaatcacaaacgtttgaaaacgcattgttaaaattcctctacctggattgcttaatggtgagaatactgtatctcctccacttcctaaagcctatgagttccacaagatcttagttttgttcatttatgtatatcaagtgcctagaacattgcctagcatgcttacatttgtggaatgattgaaaatggttaggagctttcaatctggtaaattgccttgaaacaattatttggacaaagtaataaatctggcataatttcactctttggtctaactctcacactcctgaaatgaaaatgctagaaaatagagaactcttacacatcattcagggagttacatcggccagcagtatagagtctcagatatcctactcctgggatctaaagtcgaactccccacccccaacacctgacggggcccacactcaaaagtgtcaaaactcatagctatgcacattcacaagactgtagaagtcgggctgtcacctacgctactccactctcagattctacatccccagaagacaaagagttacagttccttctctcacgaattccacaactccgaaaaccgcgtaattgaagccaccaaaggcatagaagcggcagggaaagggggctgggaagaggcgaacagaccctcttaagccccagtcattgggaaaagcccatgctgctggaaaccgcgttctcacctccttctttctttgggcagaggctgagggaacgtcgcaaacgatgagcagcgccaccaccatggtcacagagacacaccaaaaccgccaacgcgctgccatgttcgctcctctcccttctataagtgaaactttgctccggctaggtctgagggtggggcgtgagaacaggcaaatcggccccttgcctttcctcattggtccagctcagccctgccgggagacccctcacattacgtcacagcgcgctggcgctacac
